United States Patent 7,510,834 (GENE MAPPING METHOD USING MICROSATELLITE GENETIC POLYMORPHISM MARKERS) - sequence listing, part 5

SEQ ID NO: 22451 - DNA, 477 bp, Homo sapiens
  chr16.fa.partial9.94823
  Located on chromosome 16
  Distance between a terminus base of telomere on chromosomal short arm and 5'-terminus of this base sequence : 89992155
  Distance between 3'-terminus of neighbour sequence of sequence listing upward to telomere on chrosomal short arm and 5'-terminus of this base sequence : 10625
agtaagttagaccttaacctagcacttgttttttgatagcaaaaaagcataactagcttgttttaagtgcaggaagttgctgccatgcatagcaccacatccctttttcctccttctcccttcctcctcctcttgctcctcctcctcctcttcctcctcctcctcccccctttcctcctcctcctcctcccccttctcctcctcctcttcctccccttctcctcctcctcctctagctcttcttcctctcctccctctctctttctccccaccagcctccaagctggctccgcagttcttatccaaacaggaggtgcatctgtgggatttgccctgatttatggccagcaggagtgccagttcacacccccatatctcatcctgaacaaccagttctggccttagaccctgtttaaatgttaaaagcaaagtgtcaaggtagcgttgctttttggcttaaggttatgagccagattt

SEQ ID NO: 22452 - DNA, 250 bp, Homo sapiens
  chr16.fa.partial9.213705
  Located on chromosome 16
  Distance between a terminus base of telomere on chromosomal short arm and 5'-terminus of this base sequence : 90102481
  Distance between 3'-terminus of neighbour sequence of sequence listing upward to telomere on chrosomal short arm and 5'-terminus of this base sequence : 109849
tataactgaggcacaatacgagagtaagaacagtgaataataataaaatagaacagtaacaatatactgcaataaaagttaagtgactgaattcctctctctccctctctctccctctctctccctctctctccctctccctctctctccctctctctccctctctctccctctctctccctctctctccctctctctccctctctctccctctctctctctctaaatgtcttattgtactgtgctcacc

SEQ ID NO: 22453 - DNA, 309 bp, Homo sapiens
  chr16.fa.partial9.263916
  Located on chromosome 16
  Distance between a terminus base of telomere on chromosomal short arm and 5'-terminus of this base sequence : 90152381
  Distance between 3'-terminus of neighbour sequence of sequence listing upward to telomere on chrosomal short arm and 5'-terminus of this base sequence : 49650
ggcttttctacatgactcctaggtaccttcagaatttgcaacaaagtaggcaaagagagtaaattattttgtgcaatattagaatgcttgcttgtaatacacacacacacgcacacacccccaaatgtctgctggagagaaattgatgattgcatattattcatgtcaaaaagacatctttgatttctttctaaatcttttaagagaaattgaactgaggcaaaaatatttgttttaaaatttacattctttatgaaagaaacaaggcatgcctttataagacatatgtgccattctgtagaaatacaa

SEQ ID NO: 22454 - DNA, 157 bp, Homo sapiens
  G07925
  Located on chromosome 16
  Distance between a terminus base of telomere on chromosomal short arm and 5'-terminus of this base sequence : 90264767
  Distance between 3'-terminus of neighbour sequence of sequence listing upward to telomere on chrosomal short arm and 5'-terminus of this base sequence : 112077
gatcccaagctcttcctcttccctagatcaatacagacagacagacaggtggatagatagatagatagatagatagatagatagatagatagatatcattgaaagacaaaacagagatggatgatagatacatgcttacagatgcacacacaaacgc

SEQ ID NO: 22455 - DNA, 245 bp, Homo sapiens
  HUMUT1252
  Located on chromosome 16
  Distance between a terminus base of telomere on chromosomal short arm and 5'-terminus of this base sequence : 90264797
  Distance between 3'-terminus of neighbour sequence of sequence listing upward to telomere on chrosomal short arm and 5'-terminus of this base sequence : -127
atacagacagacagacaggtggatagatagatagatagatagatagatagatagatagatagatatcattgaaagacaaaacagagatggatgatagatacatgcttacagatgcacacacaaacgctaaatggtataaaaatggaatcactctgtaggctgttttaccacctactttactaaattaatgagttattgagtataatttaattttatatactaatttgaaactgtgtcattaggtt

SEQ ID NO: 22456 - DNA, 379 bp, Homo sapiens
  chr16.fa.O7frz.100290001
  Located on chromosome 16
  Distance between a terminus base of telomere on chromosomal short arm and 5'-terminus of this base sequence : 90307233
  Distance between 3'-terminus of neighbour sequence of sequence listing upward to telomere on chrosomal short arm and 5'-terminus of this base sequence : 42191
ccagtactcaagatatgctcagaaaacattaactcttgtgactagtatcaatgttttcttttttatttatgtgggctttactagtgtaatatatatatatatatatatatatatatatatatatctcatattatatatatatatatctcatattatatatatatatatatctcatattatatatatatatatatatatatcagcatttgttttcttttaaaaatgatgcattgaattattttcatgaaagtcaattgacagtttccagggaattctgacatgcaagaataaaaaccccttctcagcaatggggcagacttggctttgtgtcttcttttagccattgtccttcctgagacaaggaattctaacagaagta

SEQ ID NO: 22457 - DNA, 350 bp, Homo sapiens
  AC009154.5_100712
  Located on chromosome 16
  Distance between a terminus base of telomere on chromosomal short arm and 5'-terminus of this base sequence : 90615469
  Distance between 3'-terminus of neighbour sequence of sequence listing upward to telomere on chrosomal short arm and 5'-terminus of this base sequence : 307857
gacatgatttcagatgtgcagaagaggagcacaaaaatctcaagatacccttcacccagagtccccaaaattaatatttaccatatttgttgcatctctctctctctctctctctctctctctcacacacacacacacacacacacacacacacacacacacacacagaggaagttgcagacaagatgtgcctttactattaaatactgctgtgtgcatttcctgaaaacaaagggattctcttctgtaaccacaatgcaattaacaaaaccaaggatgtggcattgacacaattctattagctacagacctcattcacgttttttcaattgtcctaagactgtttgagc

SEQ ID NO: 22458 - DNA, 295 bp, Homo sapiens
  AC009154.5_103542
  Located on chromosome 16
  Distance between a terminus base of telomere on chromosomal short arm and 5'-terminus of this base sequence : 90618295
  Distance between 3'-terminus of neighbour sequence of sequence listing upward to telomere on chrosomal short arm and 5'-terminus of this base sequence : 2476
gcagtactccagtgactagctaacaggctatctgtttcacagctatgtaggataattgaggcctactattactttgaggtttaatttctgaacctaattgtgtgtgtgcatgcgtgcaggtgcgtgcgtgtgtgtgtgtgtgtgtgtgtgtgtgtgtgtgtgtgtgttcgggggagtctgtgcacccatgtgtgtgaacccagaatcatacaggagacaggtgaattggttggcgtctttgagtggtgggcttgaaggcacacagccttcctggttgaccttagaccggtaaatt

SEQ ID NO: 22459 - DNA, 313 bp, Homo sapiens
  AC009154.5_157850
  Located on chromosome 16
  Distance between a terminus base of telomere on chromosomal short arm and 5'-terminus of this base sequence : 90672542
  Distance between 3'-terminus of neighbour sequence of sequence listing upward to telomere on chrosomal short arm and 5'-terminus of this base sequence : 53952
agttccaggcagaacatctagtccaaactctcccacatcagagcctctcctgagagcaggaggcaggtggcagaagacctgggggttaatcccattatatgccgaaatccaatgtgtggcctcgggcacgtctcataacatctctggatctgcaattgcctgtggtgtggggattgagcctgatcttctgtgtgtgtgtgtgtgtgtgtgtgtgtgtgtgtgtgtacgctcatgtgtgtgtgtgtgtgactcacttcacttttattataaacaaacacagtctcagataagtacaactagcttcagaggtgat

SEQ ID NO: 22460 - DNA, 438 bp, Homo sapiens
  AC009154.5_162228
  Located on chromosome 16
  Distance between a terminus base of telomere on chromosomal short arm and 5'-terminus of this base sequence : 90676937
  Distance between 3'-terminus of neighbour sequence of sequence listing upward to telomere on chrosomal short arm and 5'-terminus of this base sequence : 4082
atggtcaagtgctaagaactttctgtatttcttctcatttaatctctctgaaggggtaatgattcccatttcaggtggctgaatgatggatccaggatctcaacaatctaacaagtggggagccaggcttcttagcaaatctcccagagtgaaccttgaccgatacattttacacacacacacacacacacacacacacacacacacacacacacacacacatatgggttcatattgggagttagtctgaacgattgtgggggctgcctgagcaagtctgccattcgtagggcaggaggacaggaaggaaatgtcctgagctggagctgcatgggcccagccaagctgcactatccacgggtgggagctctccttccctccctgtcttattgtgacatgtgtgtcatttccagcttgagacagctaaagacagtgctg

SEQ ID NO: 22461 - DNA, 101 bp, Homo sapiens
  DISD22_0010514
  Located on chromosome 16
  Distance between a terminus base of telomere on chromosomal short arm and 5'-terminus of this base sequence : 90813806
  Distance between 3'-terminus of neighbour sequence of sequence listing upward to telomere on chrosomal short arm and 5'-terminus of this base sequence : 136431
gtcactcaccattgtggcctcatttcctgaatgaatgaatgaatgaatgaatgaatgaatggtaaattatggtttatagtgctcctgctcttaaaggcacc

SEQ ID NO: 22462 - DNA, 203 bp, Homo sapiens
  D16S3074
  Located on chromosome 16
  Distance between a terminus base of telomere on chromosomal short arm and 5'-terminus of this base sequence : 91069329
  Distance between 3'-terminus of neighbour sequence of sequence listing upward to telomere on chrosomal short arm and 5'-terminus of this base sequence : 255422
tgggtttccaaagtcagtccccttgtgtgtgtgtgtgtgtgtgtgtgtgtgtgtgtacatgtatgttggtgcatgttctgtgcatgtgaatgaatgtgtacagtgtgtgtatatgcatgtcatgtaatgtgtgtgtgtgtacaggggaattgtgtgttggtgagcacatgtgtgtatatgtgttcctgttgcagaaaaacacc

SEQ ID NO: 22463 - DNA, 387 bp, Homo sapiens
  AC010230.4_146752
  Located on chromosome 16
  Distance between a terminus base of telomere on chromosomal short arm and 5'-terminus of this base sequence : 91078892
  Distance between 3'-terminus of neighbour sequence of sequence listing upward to telomere on chrosomal short arm and 5'-terminus of this base sequence : 9360
attactccaagtcagtgataggtgcagatggacgcacttgctggcaatgcaaacctctgaggtgtttctgtaaacccacatgcaaagaccgtgcctgatccactttctacccttacacacacacacacacacacacaagtcagacggagcaataatctctgcatcagctgaagtcttgtcagcttagttgtcaaattaaaacataaaaatattttaggctgaaattggtcaaacaggcatgttgagttcagtttttaaatcttgccccaaatcagtttactctgacatatgaagtctaaatatgcctttccttccttgctagtttctgaagcctgaaatattttcaactaaatgagaaaatctttgctgttgaatggcctattagag

SEQ ID NO: 22464 - DNA, 246 bp, Homo sapiens
  AC010230.4_112330
  Located on chromosome 16
  Distance between a terminus base of telomere on chromosomal short arm and 5'-terminus of this base sequence : 91081110
  Distance between 3'-terminus of neighbour sequence of sequence listing upward to telomere on chrosomal short arm and 5'-terminus of this base sequence : 1831
ggtagaataccatagtttacggaacagaagaacaagaacaaaactctctaatcaaaatcacagggacctggaaatattggtctatagcaatttggtttttgggggttttgttgttgttgttgttgtttcgggggcggggagggagttggttttggttttttggttggtttttgtttttgtttttgttttgagacggtctcactctgtcattcaggctggagtgcagtagtgcgatctccactcaat

SEQ ID NO: 22465 - DNA, 101 bp, Homo sapiens
  D16S3028
  Located on chromosome 16
  Distance between a terminus base of telomere on chromosomal short arm and 5'-terminus of this base sequence : 91185830
  Distance between 3'-terminus of neighbour sequence of sequence listing upward to telomere on chrosomal short arm and 5'-terminus of this base sequence : 104474
ggccaagcccatttctatttcttacacacacacacacacacacacacacacacacacacacacacactataaagatgaaataatatcaagactgccgacca

SEQ ID NO: 22466 - DNA, 114 bp, Homo sapiens
  D16S3077
  Located on chromosome 16
  Distance between a terminus base of telomere on chromosomal short arm and 5'-terminus of this base sequence : 91209230
  Distance between 3'-terminus of neighbour sequence of sequence listing upward to telomere on chrosomal short arm and 5'-terminus of this base sequence : 23299
tgcactccagtgtgagggacagagtgggaccctgtctcaaatatatatatgtgtgtgtgtgtgtgtgtgtgtgtgtgtaaaacatttgagccaatgctgggaataaaaccttat

SEQ ID NO: 22467 - DNA, 248 bp, Homo sapiens
  D16S3063
  Located on chromosome 16
  Distance between a terminus base of telomere on chromosomal short arm and 5'-terminus of this base sequence : 91234139
  Distance between 3'-terminus of neighbour sequence of sequence listing upward to telomere on chrosomal short arm and 5'-terminus of this base sequence : 24795
tgcctgattccaccaaaccatgtgagagactcaggaatttaaatcactgacatgagtagttttgtttttgttttttcaggccaacctaaaaggtaaaaggaaaaagactgcttctactggctggtccatgacaatacccaaacttgtgctttctctctctctctctctccgtatgtgcgtgtgtgtgtgtgtgtgtgtgtgtaaaatctttataactaaactataggaaattgttgctaaaacaagct

SEQ ID NO: 22468 - DNA, 267 bp, Homo sapiens
  D16S3048
  Located on chromosome 16
  Distance between a terminus base of telomere on chromosomal short arm and 5'-terminus of this base sequence : 91260029
  Distance between 3'-terminus of neighbour sequence of sequence listing upward to telomere on chrosomal short arm and 5'-terminus of this base sequence : 25642
agcaagccgtgactgggtcactgcactccagcctaggtgacggagcaagacctgcctcaaaataactaaataaataagaatattttattctcagtatttcttttcatatacacacacacacacgatacacacgcccacatacacacacacacacacacacacacacacacacacacacacacacacacacaccagtcaaagaacttttgaagcagattaactccaaaaccaaggttaggaaggaaatcccccaggacactactcatg

SEQ ID NO: 22469 - DNA, 396 bp, Homo sapiens
  chr16.fa.O7frz.100967671
  Located on chromosome 16
  Distance between a terminus base of telomere on chromosomal short arm and 5'-terminus of this base sequence : 91613348
  Distance between 3'-terminus of neighbour sequence of sequence listing upward to telomere on chrosomal short arm and 5'-terminus of this base sequence : 353052
aacaagagtgaaactccatctcaaaaaaatatatatatacatatatttatatatattttataatatataatatatattatttttcctgtaagtgattcaggtcgaatttctgtcattggcagccaaaagagtcctgagctcactaaggggctcaactgagccaggacaggatactctgggacttctagcagcacagagcactagctggtgcttggaaatgatgtttcctctgctcttggctagctggaatccccaggccagcatccccaagatgaaatgtgcccctccctttagaaggcaagaattgatgacagtgagttttttgtttggtttggtttgaagtagcccaaatgtccccttcctgccacgagggcaatgcagcttctatcttacagc

SEQ ID NO: 22470 - DNA, 147 bp, Homo sapiens
  D16S413
  Located on chromosome 16
  Distance between a terminus base of telomere on chromosomal short arm and 5'-terminus of this base sequence : 91890703
  Distance between 3'-terminus of neighbour sequence of sequence listing upward to telomere on chrosomal short arm and 5'-terminus of this base sequence : 276959
actccagcccgagtaacaaaagcatctcaaaaaaaaaaaaaaatacacacacacacacacacacacacacacacacacacacacacacacacacacacacacatatatatataaagaaaaaggaaatcttcgaacccacctgtgacc

SEQ ID NO: 22471 - DNA, 226 bp, Homo sapiens
  AC026467.3_27926
  Located on chromosome 16
  Distance between a terminus base of telomere on chromosomal short arm and 5'-terminus of this base sequence : 91979854
  Distance between 3'-terminus of neighbour sequence of sequence listing upward to telomere on chrosomal short arm and 5'-terminus of this base sequence : 89004
tcgttcgaatgaccataagaagagatcttacagaggagaatctctctctttctctttcctcgcgtatatatctatgtgtctctatcacatctatctatctatctatctatctatctcttatttatatccatccatccatccatccatccacccatccatccatccatcacacatatatacacatactacatacatatatgccttataaatattcagctttggattt

SEQ ID NO: 22472 - DNA, 90 bp, Homo sapiens
  D16S3023
  Located on chromosome 16
  Distance between a terminus base of telomere on chromosomal short arm and 5'-terminus of this base sequence : 92018009
  Distance between 3'-terminus of neighbour sequence of sequence listing upward to telomere on chrosomal short arm and 5'-terminus of this base sequence : 37929
gagcgcctatgttcggttctggggtgtgtgtgtgtgtgtgtgtgtgtgtgtgtgtgtgtgtgtggtgtttcactgtgatgagaaatgcag

SEQ ID NO: 22473 - DNA, 315 bp, Homo sapiens
  chr16.fa.O7frz.102951511
  Located on chromosome 16
  Distance between a terminus base of telomere on chromosomal short arm and 5'-terminus of this base sequence : 92180015
  Distance between 3'-terminus of neighbour sequence of sequence listing upward to telomere on chrosomal short arm and 5'-terminus of this base sequence : 161916
ttcacattacaaaggttctcaccttcaatgtgccccgggcaagtaggattcctctactgactggctgcccactatgtgccaggccccagggagataggggaaccagccaggtagcccccagtcttaggaaacatgttcttgggaataggggaagcagcaggcagagacatatacatatacacacacacacacacacacacacacacacacacacacacacacacacacacagatgaacctgtgtcacgacagagaggcagaggcaacagagaaacagcctacgcaaatgctgaggttgacacataaaggatggag

SEQ ID NO: 22474 - DNA, 168 bp, Homo sapiens
  DISD22_0010522
  Located on chromosome 16
  Distance between a terminus base of telomere on chromosomal short arm and 5'-terminus of this base sequence : 92323992
  Distance between 3'-terminus of neighbour sequence of sequence listing upward to telomere on chrosomal short arm and 5'-terminus of this base sequence : 143662
gagaccatgacccaccacgggcctgccctggggtgatcagcaacacgccccccagagtttgttcactcattcattcatccattcatccattcattcattcattcaataccaagcaggccccaccaggcagcgggcttggtctagggtccggggacatggtggacagtt

SEQ ID NO: 22475 - DNA, 206 bp, Homo sapiens
  D16S3026
  Located on chromosome 16
  Distance between a terminus base of telomere on chromosomal short arm and 5'-terminus of this base sequence : 93021331
  Distance between 3'-terminus of neighbour sequence of sequence listing upward to telomere on chrosomal short arm and 5'-terminus of this base sequence : 697171
ctccctgagcaacaaacaccaactccctgcgtggcttcactaaaacaagccttgaaagggaacaagaggctctgatggtcacttaaacatcacacacacacacacacacacacacacacacacacacacacaaatctgaaatcctgaccaatgaagacataagaccaacctttcagaaagcctaaatcaggcgcatataaatgacc

SEQ ID NO: 22476 - DNA, 83 bp, Homo sapiens
  D16S3121
  Located on chromosome 16
  Distance between a terminus base of telomere on chromosomal short arm and 5'-terminus of this base sequence : 93028109
  Distance between 3'-terminus of neighbour sequence of sequence listing upward to telomere on chrosomal short arm and 5'-terminus of this base sequence : 6572
catgttgtacatcgtgatgcagtacacacacacacacacacacacacacacacacacacacacacccctggaaaataaaagct

SEQ ID NO: 22477 - DNA, 283 bp, Homo sapiens
  AC005565.1_29932
  Located on chromosome 16
  Distance between a terminus base of telomere on chromosomal short arm and 5'-terminus of this base sequence : 93277701
  Distance between 3'-terminus of neighbour sequence of sequence listing upward to telomere on chrosomal short arm and 5'-terminus of this base sequence : 249509
aacaatgccaatttctagtcatttgtttccaatgtgtctccataggaaagtttttttatctacaagtcttttactgtgtgtgtgtgtgtgtgtgtgtgtgtccgtgtgcacgtgcgtgcatgtactaactatatctttagcagaaaaaaacaaactcaaaaattaatgaattaaaggtttatctgtgtggctgagcttggttccttggaatgataatatgcaatttgtgaaattcaaatacaatcatggcagtgaaaatctgtatcatttgccaatgacattc

SEQ ID NO: 22478 - DNA, 458 bp, Homo sapiens
  chr16.fa.partial16.215708
  Located on chromosome 16
  Distance between a terminus base of telomere on chromosomal short arm and 5'-terminus of this base sequence : 93798898
  Distance between 3'-terminus of neighbour sequence of sequence listing upward to telomere on chrosomal short arm and 5'-terminus of this base sequence : 520914
ggaggtcacttctaaatcttactgggggctatgcacggtggctcatgcctgtaatcccagcactttgggaagctgaggtgggaggaacacttgagcccaggagtttcaggctgcagtgagttatgattgtgccactgcactccagcctgggtgacagagtgagaccttgtctgtaataatagtaacaatcatcatcgtcatcatcatcatcatcatcatcatcatcatcatcatcccagcattttgggaggccaaggcaggcggatcacttgaggccaggaattcgagaccagcctggccaacatggtgaaaccccatctctacaaaaaatacaaaaattagctgggcaaagtggtgcacatctgcagtcccagctactcgagaagctgaggtgggagaattgttgaacctgggaggtggaggctgcagtgagccgagattctaccactgtactccag

SEQ ID NO: 22479 - DNA, 263 bp, Homo sapiens
  DISD22_0010526
  Located on chromosome 17
  Distance between a terminus base of telomere on chromosomal short arm and 5'-terminus of this base sequence : 65472
  Distance between 3'-terminus of neighbour sequence of sequence listing upward to telomere on chrosomal short arm and 5'-terminus of this base sequence : 0
tctcctagtgctcactccgcccacttctctcccccatccaatcagcgagctctgccagtgcgttgcgttcctgtccttgggggagggagtccggggtctctcggggaaacggaaacgcaggctcagatgtgcgggtccagttagggtcagggtcagggtcagggtcagggtcagggtcagagtcagggttagggtggttagggttagggttaggcaaaaggagcatggagagaaaggccttcctctctcctcatgggcttaca

SEQ ID NO: 22480 - DNA, 253 bp, Homo sapiens
  D17S849
  Located on chromosome 17
  Distance between a terminus base of telomere on chromosomal short arm and 5'-terminus of this base sequence : 168285
  Distance between 3'-terminus of neighbour sequence of sequence listing upward to telomere on chrosomal short arm and 5'-terminus of this base sequence : 102550
caattctgttctaagattattttggctgttgtcttctgtattttcatctaacttttaaaatcagcatatcaattcacacacacacactcacacacacacacacacacacacacccctgctgggattctactgtatctatagataaattgatacagtaattaggattgaattctatctatagattaattttggaataatttgccgctttttaaattgttatttattttttattgggcagcctcctcagccagag

SEQ ID NO: 22481 - DNA, 205 bp, Homo sapiens
  HUMUT269
  Located on chromosome 17
  Distance between a terminus base of telomere on chromosomal short arm and 5'-terminus of this base sequence : 282486
  Distance between 3'-terminus of neighbour sequence of sequence listing upward to telomere on chrosomal short arm and 5'-terminus of this base sequence : 113948
ctgggcaacaagagcaaaattccgtctcaaaaaaagaaaggaaagaaagaaagagagaaagagagaaagagagaaagagagaaagagagaaagagagaaagaaagaaagaaagaaagaaagaaagaaagaaagaaagaaagaaagaaggaagaaagcaagcaagcaagctgcaccttcagactgaagtcaatgaacaacaacaaa

SEQ ID NO: 22482 - DNA, 233 bp, Homo sapiens
  HUMUT211
  Located on chromosome 17
  Distance between a terminus base of telomere on chromosomal short arm and 5'-terminus of this base sequence : 282489
  Distance between 3'-terminus of neighbour sequence of sequence listing upward to telomere on chrosomal short arm and 5'-terminus of this base sequence : -202
ggcaacaagagcaaaattccgtctcaaaaaaagaaaggaaagaaagaaagagagaaagagagaaagagagaaagagagaaagagagaaagagagaaagaaagaaagaaagaaagaaagaaagaaagaaagaaagaaagaaagaaggaagaaagcaagcaagcaagctgcaccttcagactgaagtcaatgaacaacaacaaataactgaggttaaaataatggccacgaatga

SEQ ID NO: 22483 - DNA, 471 bp, Homo sapiens
  chr17.fa.O7frz.440227
  Located on chromosome 17
  Distance between a terminus base of telomere on chromosomal short arm and 5'-terminus of this base sequence : 365289
  Distance between 3'-terminus of neighbour sequence of sequence listing upward to telomere on chrosomal short arm and 5'-terminus of this base sequence : 82567
  misc_feature (1)...(471): n = A,T,G or C
gaggtcaggagatcgagatccatcatggctaacatggtgaaaccccatctctactaaaaaaaaatacaaaaaaattagccaggcgtggtggcgggtgcctgtagtcctagctactcaggaggctgaggcaagagaatggcatgaactcggaaggtggagcttgcagtgagccgagatcgcaccacgacactccagcctgggcaacggagcaagactccatctcaaaaaaaagaaaagaaaagaaaactaaaaacaaaacaaaaaaaaaaccacacacacacacacacacacacacacacacacacacgnaagtncactatgccagagaaaagggaggcatgttgttaaagagaaccattttaatttcatctgcccggtggaatctgggaaaaaaaatataaagcaggcctcttctaaacaataaagatgggcttcatccacatcttcctgaaacttctagaaactgaaatg

SEQ ID NO: 22484 - DNA, 306 bp, Homo sapiens
  D17S1308
  Located on chromosome 17
  Distance between a terminus base of telomere on chromosomal short arm and 5'-terminus of this base sequence : 455689
  Distance between 3'-terminus of neighbour sequence of sequence listing upward to telomere on chrosomal short arm and 5'-terminus of this base sequence : 89929
ttggtgacaaagcaagtctccatctcaataaataaataaaatacatacatacatacatacatacatacatacatacatacatacaaaaaattagctgggtgtggtggtgggcacctgtaatcccagctactcaggaggctgagacaggacaatctcttgaacctgggaggcagaggttgcagtgagccaagatcgtgccattgcactccagcctgggtgacacagaaagattctgtctcaaaaacaaacaaaaaccaacttcctattttgctgtaggatagggtatagtgatgacaaagtttcaca

SEQ ID NO: 22485 - DNA, 331 bp, Homo sapiens
  AL121672.13_134843
  Located on chromosome 17
  Distance between a terminus base of telomere on chromosomal short arm and 5'-terminus of this base sequence : 455697
  Distance between 3'-terminus of neighbour sequence of sequence listing upward to telomere on chrosomal short arm and 5'-terminus of this base sequence : -298
aaagcaagtctccatctcaataaataaataaaatacatacatacatacatacatacatacatacatacatacatacaaaaaattagctgggtgtggtggtgggcacctgtaatcccagctactcaggaggctgagacaggacaatctcttgaacctgggaggcagaggttgcagtgagccaagatcgtgccattgcactccagcctgggtgacacagaaagattctgtctcaaaaacaaacaaaaaccaacttcctattttgctgtaggatagggtatagtgatgacaaagtttcacagaaaacatttttctaccttgaaatttcaccgtc

SEQ ID NO: 22486 - DNA, 306 bp, Homo sapiens
  AC015884.5_40920
  Located on chromosome 17
  Distance between a terminus base of telomere on chromosomal short arm and 5'-terminus of this base sequence : 853247
  Distance between 3'-terminus of neighbour sequence of sequence listing upward to telomere on chrosomal short arm and 5'-terminus of this base sequence : 397219
ccaagtgacaaagataaactgtgacagcgtttccagcaaccctaggtttgctctcctctaccctcctgagggatgaggagaggatgccccccaggccactcagctcaggtgagcaggcagtgatgacaggtgttcaccatccctgaaccggagggagcaggggggggtatgctagaaccagagtgtggcattcccttggaaggataccttccagggtgcctcttcccaatttaataataataataataataataataataataataataataatggcactgatgataatgaccagttattgagtac

SEQ ID NO: 22487 - DNA, 450 bp, Homo sapiens
  AC015884.5_83700
  Located on chromosome 17
  Distance between a terminus base of telomere on chromosomal short arm and 5'-terminus of this base sequence : 877395
  Distance between 3'-terminus of neighbour sequence of sequence listing upward to telomere on chrosomal short arm and 5'-terminus of this base sequence : 23842
tctgagtagcatctggaaatagggaagggtttccaggcaaagaagagaaggcccgaaaggaaagggttaagcagcttcagcaacccggttgcagtggcgcacctgaaatctcaggtactcaggaggctgaggtgggaggatcgtttgagctcaagagttggaggctgcaatgagctatgatcgcaccactgcactccagcctgggcaacagagccagactctgtcttgagggagggagggagggaggaaggaaggaaggaagagaggaaggaaggcaggttaagaagcgctgcttgctagaggacagaagatgaacttggagaagtgggctgaacagcatcatggagggtgaggggcataagcacacaccacacctagctactgtttgaaatctttcgcagccactgagatttctgacaccatcaagtctaaatctcagtctccaatggt

SEQ ID NO: 22488 - DNA, 165 bp, Homo sapiens
  D17S1529
  Located on chromosome 17
  Distance between a terminus base of telomere on chromosomal short arm and 5'-terminus of this base sequence : 911636
  Distance between 3'-terminus of neighbour sequence of sequence listing upward to telomere on chrosomal short arm and 5'-terminus of this base sequence : 33791
ttgtttctatccacgcaggcacatggagacacacacacacacacacacacacacacacacacacatcacatccttgtggccccaccacctctggcccccacactccattcagcccccggcctctctgctgccataagcaccctcctaccagcaagcacagccatc

SEQ ID NO: 22489 - DNA, 257 bp, Homo sapiens
  AC002093.1_133195
  Located on chromosome 17
  Distance between a terminus base of telomere on chromosomal short arm and 5'-terminus of this base sequence : 1183892
  Distance between 3'-terminus of neighbour sequence of sequence listing upward to telomere on chrosomal short arm and 5'-terminus of this base sequence : 272091
gaccttgtgcaagtgacttaacctctctgtatctcagtttcttcacttgggaaatagggaacatgccggtacctgcgtcatggggctgctgagcctccttggatgaggcaatggacatgaagcagctttctgcagtgagtggcatatttccttattattattattattattattattattaattattgggaaaagggcgttgtgaacaaggagggatggacacccctgcccctcaaaactacctctaggctggtcac

SEQ ID NO: 22490 - DNA, 257 bp, Homo sapiens; identical to SEQ ID NO: 22489
  AC006405.1_9250
  Located on chromosome 17
  Distance between a terminus base of telomere on chromosomal short arm and 5'-terminus of this base sequence : 1183892
  Distance between 3'-terminus of neighbour sequence of sequence listing upward to telomere on chrosomal short arm and 5'-terminus of this base sequence : -257

SEQ ID NO: 22491 - DNA, 171 bp, Homo sapiens
  DISO7_10017167
  Located on chromosome 17
  Distance between a terminus base of telomere on chromosomal short arm and 5'-terminus of this base sequence : 1254688
  Distance between 3'-terminus of neighbour sequence of sequence listing upward to telomere on chrosomal short arm and 5'-terminus of this base sequence : 70539
agccgagtaacaactctggttcacacttcacctccctaggcctcagtttccgcatctgtaaaacagatcctatctatctatctatctatctatctatctatctatctatctatatctatccatctatctatcatctatctgagctttttgcaggacctggcaggtctttgt

SEQ ID NO: 22492 - DNA, 377 bp, Homo sapiens
  chr17.fa.O7frz.1731587
  Located on chromosome 17
  Distance between a terminus base of telomere on chromosomal short arm and 5'-terminus of this base sequence : 1506649
  Distance between 3'-terminus of neighbour sequence of sequence listing upward to telomere on chrosomal short arm and 5'-terminus of this base sequence : 251790
  misc_feature (1)...(377): n = A,T,G or C
aggtcaggagttcgagactagctagcctggccaacatggtgaaaacccatctctactaaaagtacaaaaattaatcgggcatggtggtgtgcacctgtagtcccagctactcgagaggctgaggcatgagaatcatttgaacccaggaggcgtaggttgcagtgagccaagtttgcgccagtgccctctagcctggacaacaaagtgagactctgtctcaaaaaaaaaaaaaaaaaaaaaaaaatatatatatantatatatatatatatatatatatatatatacacacancacacacacacacacacacacacacttttgaagagagtggtgaaatagactctctaaagtggtaaataatcatttccttaggctt

SEQ ID NO: 22493 - DNA, 230 bp, Homo sapiens
  D17S831
  Located on chromosome 17
  Distance between a terminus base of telomere on chromosomal short arm and 5'-terminus of this base sequence : 1679041
  Distance between 3'-terminus of neighbour sequence of sequence listing upward to telomere on chrosomal short arm and 5'-terminus of this base sequence : 172015
cgcctttcctcatactccagccacagttttctgatgccacaagccacccagatcccaaagaaaacaaatgcctctgtacaccttcctcctctggatcacccacagtcggctgcactgcagacctaggccatgttcacagccccaacacacacacacacacacacacacacacacacacacactcttcctctccaaataattggatgatagtaattcaagtcccgtctggc

SEQ ID NO: 22494 - DNA, 126 bp, Homo sapiens
  DISO7_10004199
  Located on chromosome 17
  Distance between a terminus base of telomere on chromosomal short arm and 5'-terminus of this base sequence : 1689489
  Distance between 3'-terminus of neighbour sequence of sequence listing upward to telomere on chrosomal short arm and 5'-terminus of this base sequence : 10218
ctacagggagcctgttgcatgctttgccaggtgtgtttctgtacatacacacacacacacacacacgcacacacactatggtaccaactcttttgctgtgccagcacagaggtctccagagcgact

SEQ ID NO: 22495 - DNA, 236 bp, Homo sapiens
  chr17.fa.O7frz.1979257
  Located on chromosome 17
  Distance between a terminus base of telomere on chromosomal short arm and 5'-terminus of this base sequence : 1738037
  Distance between 3'-terminus of neighbour sequence of sequence listing upward to telomere on chrosomal short arm and 5'-terminus of this base sequence : 48422
atctaccttctctgatactgcacgtgtgtgtgtgcgcgcacgtgtatgtctgtgtgcgtgtatgtgtctgtgtgcgtgtgtacatgtatgtgtgtgtgtacatgtgtgtatgtgtatgcgtgtatgtgtgtacatgtgtgtatatgtctctgtgtgtgtgtgtgtgtgtgcctgtctgcctccctatgtgtctgggacatggcttcattttctggtgaagattctttccaaaattc

SEQ ID NO: 22496 - DNA, 189 bp, Homo sapiens
  D17S1528
  Located on chromosome 17
  Distance between a terminus base of telomere on chromosomal short arm and 5'-terminus of this base sequence : 1793322
  Distance between 3'-terminus of neighbour sequence of sequence listing upward to telomere on chrosomal short arm and 5'-terminus of this base sequence : 55049
cagaggtggagataagggattataatataattatatgattatttatatatacacacacacatatatgtatatatgtacatgtatgtctgtctgtgtgtgtgtgtgtgtagagagagagagagtatcacccaggctggagtacagtagcatgattttgggctcactacagccttgacctcctgggctact

SEQ ID NO: 22497 - DNA, 419 bp, Homo sapiens
  chr17.fa.O7frz.2071153
  Located on chromosome 17
  Distance between a terminus base of telomere on chromosomal short arm and 5'-terminus of this base sequence : 1855325
  Distance between 3'-terminus of neighbour sequence of sequence listing upward to telomere on chrosomal short arm and 5'-terminus of this base sequence : 61814
taatgtgaaatcagccatagacacagtgtaaacaagtaagcatggttatattccaatcaactttatggacactaaaatctgacttttatacaattttcatgagtcatgaaatagtactcgtttgattttttgtttaaccatttaaaaatgtaaaccattattagcttgtgggccatggtatgctgatccctgatacaggtgcgtgcgacacacacacacacacacacacacacacacacacacacacacacacagcagaggcagacgaaagcagaggcaaagagaaagacagaggcaggcaggcagagacaggccaggacagacagacagacaggtaggtaaaaggcaaggcaggcagatacaggaagacccacatacacagaaaccccctctaacagagagatccagactggcataca

SEQ ID NO: 22498 - DNA, 266 bp, Homo sapiens
  chr17.fa.O7frz.2177344
  Located on chromosome 17
  Distance between a terminus base of telomere on chromosomal short arm and 5'-terminus of this base sequence : 1961630
  Distance between 3'-terminus of neighbour sequence of sequence listing upward to telomere on chrosomal short arm and 5'-terminus of this base sequence : 105886
ggttacagtaagccgagactactgcagcgctgcactccggcctgcgcaacaaagcgaggctccatctcaaaaaaaaataattattattttatacatatatatatatatatatatatatgtaattaaaatttttctcaatgagcaatgaaatagatatttctcccaatagcaaatcagcacatgaaaagatgcacatcattagttgctaggagaatccaataaaaaaccacaatgagttatcacttaatactcactaggtttgtgga

SEQ ID NO: 22499 - DNA, 363 bp, Homo sapiens
  chr17.fa.O7frz.2307022
  Located on chromosome 17
  Distance between a terminus base of telomere on chromosomal short arm and 5'-terminus of this base sequence : 2089731
  Distance between 3'-terminus of neighbour sequence of sequence listing upward to telomere on chrosomal short arm and 5'-terminus of this base sequence : 127835
actcaaatgtaatattcactcgaggtaaggacagtggggtggtgtgggctggcacagcagaaaatttctagaccaggggaatccacggtcctgaattgagtcttggctctgtgtgaccctgggtattgttttttgcagcctgacacatgaatgcttggactagaataatgattcttaatccttagtgggttattgacccctttgtctgtgtctgagggttctgggaaccctctctccaggaaaaaaaatacacacacacacacacacacacacacatgctcacagagcttttagaagtaactctaggaggtacatggactctctggaggtccacggaccaggttaagaacactggtcagaggc

SEQ ID NO: 22500 - DNA, 101 bp, Homo sapiens
  DISD22_0010530
  Located on chromosome 17
  Distance between a terminus base of telomere on chromosomal short arm and 5'-terminus of this base sequence : 2396049
  Distance between 3'-terminus of neighbour sequence of sequence listing upward to telomere on chrosomal short arm and 5'-terminus of this base sequence : 305955
gctgcagccactcttatgatcacacacacacacgcacacacacacataaacacacacacacacacaaatatgggaaagcgactggacacagccctctccta

SEQ ID NO: 22501 - DNA, 398 bp, Homo sapiens
  AC005696.1_126834
  Located on chromosome 17
  Distance between a terminus base of telomere on chromosomal short arm and 5'-terminus of this base sequence : 2667763
  Distance between 3'-terminus of neighbour sequence of sequence listing upward to telomere on chrosomal short arm and 5'-terminus of this base sequence : 271613
atcatgaggttaggaattcaagaccagcctgaccaagatgataaaaccctgtctttactaaaaatacaaaaattagtcgggcgtggtggcaggtgcctgtaatcccagctactcaggaggctgaagcaggagaaccgcttgaacctgggcggcagaggttgcggtcagccaagatcacaccactgcactccagcctgggtgatagagtgggactccatctcaaaacaaacaaacaaacaaacaaacaaacagagagttgcaggaatgactgtcttaggtggcttgacaggctgcggggtttgaattttgttcaaaggcctctcaaatcccaccctgcaggaactctagctactagctgcactgtgggtggcccctcttcatcctgtctgaggaaatcc

SEQ ID NO: 22502 - DNA, 296 bp, Homo sapiens
  AC002316.1_59025
  Located on chromosome 17
  Distance between a terminus base of telomere on chromosomal short arm and 5'-terminus of this base sequence : 2731731
  Distance between 3'-terminus of neighbour sequence of sequence listing upward to telomere on chrosomal short arm and 5'-terminus of this base sequence : 63570
gcagtcaggttcacgtactctgggtgacctggggcaggctgcgcaacctctctgtgccccagtttctttgtctgaggataataacagtacctgcacgtgggtgcgcttgttgtgaggcttaaatgagattatccaggtgaaatgggaacagagtgcctggtacctagtgctcaacacatgtaacctgccttaacatctctgatattattattattattattattattattattattattattattgagacagagtctcgctttgtcacccaggctggattgcagtggcataatctc

SEQ ID NO: 22503 - DNA, 151 bp, Homo sapiens
  DISO7_10004202
  Located on chromosome 17
  Distance between a terminus base of telomere on chromosomal short arm and 5'-terminus of this base sequence : 2821025
  Distance between 3'-terminus of neighbour sequence of sequence listing upward to telomere on chrosomal short arm and 5'-terminus of this base sequence : 88998
gcccacatggactaagttaagttttacctgcggttgcacggcaggcagccctgtctcccgaggacagctttttgaccagggcctgtgtgtgtgtgtgtgtgtgtgtgtgtgtgtgtgtgtgtacgtgcagaggggctcaagggagaatgaa

SEQ ID NO: 22504 - DNA, 115 bp, Homo sapiens
  DISD22_0010638
  Located on chromosome 17
  Distance between a terminus base of telomere on chromosomal short arm and 5'-terminus of this base sequence : 2966458
  Distance between 3'-terminus of neighbour sequence of sequence listing upward to telomere on chrosomal short arm and 5'-terminus of this base sequence : 145282
ttaagagctgagatctggattctgtgtgtgtgtgtgtgtatgtgtgtgtgtgtgtgagagagagagagagattgttaggctaagaagatgtttttggctcatagctaagtgggtt

SEQ ID NO: 22505 - DNA, 101 bp, Homo sapiens
  DISD22_0010639
  Located on chromosome 17
  Distance between a terminus base of telomere on chromosomal short arm and 5'-terminus of this base sequence : 3168170
  Distance between 3'-terminus of neighbour sequence of sequence listing upward to telomere on chrosomal short arm and 5'-terminus of this base sequence : 201597
aacatcttggtagcctaagaatctctctctcacacacacacacacacacacacacacacacacacactcacacacacagaatccagatctcagctcttaag

SEQ ID NO: 22506 - DNA, 335 bp, Homo sapiens
  chr17.fa.O7frz.3218402
  Located on chromosome 17
  Distance between a terminus base of telomere on chromosomal short arm and 5'-terminus of this base sequence : 3353504
  Distance between 3'-terminus of neighbour sequence of sequence listing upward to telomere on chrosomal short arm and 5'-terminus of this base sequence : 185233
actgttactttggcttactgttattttggtacatatatatatatatattattagtataataattagtatatatatatattagtaccaaaacttctaatatatatatatataatatatatatttatatctatatctatatctatttatttattttgagatggagtctcactctgtcgcccaggctggagtgcagtgccatgatctcggctcactgcaacctccacctcccaggttcaagcaatccttctgcctcagcttccccagtagctgggattacaggcacctggctaattttttttttttttttttttttgagatgaagtcttgctcagtcg

SEQ ID NO: 22507 - DNA, 264 bp, Homo sapiens
  D17S829
  Located on chromosome 17
  Distance between a terminus base of telomere on chromosomal short arm and 5'-terminus of this base sequence : 3662875
  Distance between 3'-terminus of neighbour sequence of sequence listing upward to telomere on chrosomal short arm and 5'-terminus of this base sequence : 309036
tgtaagactgaggctggagcatgtgcgtgtgcccgggagtgtgcgcacgcgtgtgtttgcctgggcctgtgtgtgtgtgtgtgtgtgtgtgtgtgtgtacccgggcgtgtgtgtgtgtgtgtgtgtgtgtgcctgggcgtgtgtgtgtgtgcctgggtgtgtgtctgcgcgcatgtatgtgtgcccgggcgtgtgtgtgtgtgtgcccagtcgctcatacatactctttaaagccccattagtaatgctaacacgctcccctag

SEQ ID NO: 22508 - DNA, 260 bp, Homo sapiens
  AF168787.1_132968
  Located on chromosome 17
  Distance between a terminus base of telomere on chromosomal short arm and 5'-terminus of this base sequence : 3718361
  Distance between 3'-terminus of neighbour sequence of sequence listing upward to telomere on chrosomal short arm and 5'-terminus of this base sequence : 55222
gtgaggcatgacatcaaattactgggcgacaaccagcattaaaaaaaataggttgggcacaggcgctcatgcctgtaatcccagcactttgggaggctgaagcaggagaaccgcttgagcccaggagttcaagaccagcctgggcaacatagcaaaactttgtctatatatatagacagacacacacacacacacacacacacacacacacacacacacacacacacacacatatatatataactagccaagtcaggcac

SEQ ID NO: 22509 - DNA, 207 bp, Homo sapiens
  D17S1828
  Located on chromosome 17
  Distance between a terminus base of telomere on chromosomal short arm and 5'-terminus of this base sequence : 4040024
  Distance between 3'-terminus of neighbour sequence of sequence listing upward to telomere on chrosomal short arm and 5'-terminus of this base sequence : 321403
ttaagccagttcggatttggtttctgttgcttgcaaatgaaatagtcctggataacactcctctccaggctgtggccccttcctcgaggaaagactctttttggagattcagggtaacgtgtgtgtgtgtgtgtgtgtgtgtgtgtgtgtgtgtgttggggtatggggtgtgtggctgtatacctgcagggcaaatctgtgagtgca

SEQ ID NO: 22510 - DNA, 410 bp, Homo sapiens
  AC067815.2_77108
  Located on chromosome 17
  Distance between a terminus base of telomere on chromosomal short arm and 5'-terminus of this base sequence : 4117101
  Distance between 3'-terminus of neighbour sequence of sequence listing upward to telomere on chrosomal short arm and 5'-terminus of this base sequence : 76870
gatctgtattcttagaaacaggaagtagcagcttcctgtaagcaaactgacctcatccccaagccctgggatggcccctgggtccaaccacttccaaagggatgtggctacctctcactcagggaagcatcatgagccaatccacacttatttatttatttatttatttatttatttatttatttatttatttgatatggagactcgctctgtcgccaaggctggagtggagtggtgtgatctcggcttactgccacctccgcctcctgggttcaagcaattctcctgccccagcccccccagtagctgggattacagtcttgtgccatgatgcccagctaattttttgtatttttagtagagacggggtttcgccatgttggccaggctggtctcgaactcctgacctc

SEQ ID NO: 22511 - DNA, 408 bp, Homo sapiens
  chr17.fa.O7frz.4035310
  Located on chromosome 17
  Distance between a terminus base of telomere on chromosomal short arm and 5'-terminus of this base sequence : 4256168
  Distance between 3'-terminus of neighbour sequence of sequence listing upward to telomere on chrosomal short arm and 5'-terminus of this base sequence : 138657
agccagaatgatctcgatctcctgacctcgtgatccgcccgcctcggcctcccaaagtgctgggattacaggcgtaagccaccgcgcccggcctgacctcttcttattatgcctaatttatacattagaatttatcataaccatatatatatatatatatatatatatatatatatatatatatcagaaaaatatatagtatatatagggttgggtactatccttggtttcaggcacccactgggggtgctggaacatctcccgcatgggtaaggagggaatactgtaatagctttcttaaaaaaccactaagtgcttaccacatgccaaaaaaaatgacgcaaatgtgaggacagagcagaaataagacagaaggtccctgccctcgtggaactatagtacatgagt

SEQ ID NO: 22512 - DNA, 104 bp, Homo sapiens
  D17S1876
  Located on chromosome 17
  Distance between a terminus base of telomere on chromosomal short arm and 5'-terminus of this base sequence : 4551459
  Distance between 3'-terminus of neighbour sequence of sequence listing upward to telomere on chrosomal short arm and 5'-terminus of this base sequence : 294883
agctgcttctgcaaagatgacctttctcttcacctactgccaaacacacacacacacacacacacacacacacacacttctccctccgtggcccaggacttgta

SEQ ID NO: 22513 - DNA, 451 bp, Homo sapiens
  chr17.fa.O7frz.4491156
  Located on chromosome 17
  Distance between a terminus base of telomere on chromosomal short arm and 5'-terminus of this base sequence : 4742458
  Distance between 3'-terminus of neighbour sequence of sequence listing upward to telomere on chrosomal short arm and 5'-terminus of this base sequence : 190895
attagccaggtgtagtgacacatgcttgtagtccccattacttggaaggccaaggcgggaggatggcttgagcctgggaggtcaaggcatcagtgagcgatggttgtgccactgcctggagatagagtgagaccctgtctcaaaaaagaaagaaagaaagaaagaaaaatccctaagacctgacctgcctactccctagaaagcaccaaataaggaaaagcactccggaagaatgaagctaagaaggctgtgctctctgaggcatccgggcagccttcactggagggacaaggtccaggtaggtgggatgacaagctgggaaggggccctgaaccagaggcaggtgatgtgggtggtggcaccagagagacaccagacagtgttaccgtaggtcttgactgtccaccttcattcctgaagttgatccagctttcttactgtcacgtaggtg

SEQ ID NO: 22514 - DNA, 255 bp, Homo sapiens
  chr17.fa.O7frz.4857402
  Located on chromosome 17
  Distance between a terminus base of telomere on chromosomal short arm and 5'-terminus of this base sequence : 4800022
  Distance between 3'-terminus of neighbour sequence of sequence listing upward to telomere on chrosomal short arm and 5'-terminus of this base sequence : 57113
ttattcaacatcaccttctcagcaagagcttcctcgaccattgtaattaaaattgcacacacacacacacacacacacacacacacatgtagtaacatggtagacatgggtgttctgggtgtaattctttcaacttctccgaatgttcaaaaattttcattataaaatattgaaaacaggctgggcgcggtggctcacacctataatcccagcactttgggaggctgaggcaggcggatcacgaggtcaggagtt

SEQ ID NO: 22515 - DNA, 334 bp, Homo sapiens
  chr17.fa.O7frz.5865115
  Located on chromosome 17
  Distance between a terminus base of telomere on chromosomal short arm and 5'-terminus of this base sequence : 5038902
  Distance between 3'-terminus of neighbour sequence of sequence listing upward to telomere on chrosomal short arm and 5'-terminus of this base sequence : 238625
ggaaagatctagaactaggcacagaggacacagtggtgatacagtctagtagtagggagagacattaatcaagtaattatttattaatgtgtgtgtgtgtgtgtgtgtgtgtgtgtgtgtgtgtgtgtgtgtgattgcaagccatgataaggactgtagtgaaaactttaacatgccgtgggcacatataacaagagttgttttgagcatatgttctcaggatctcctgagggctgtgtcatggaaaaaaaattgcttttacgagacaaaacttttataagacaaaaatatctagttgattgagagagacgtaaatcatgtcagaaagctaaac

SEQ ID NO: 22516 - DNA, 359 bp, Homo sapiens
  AC015913.4_60812
  Located on chromosome 17
  Distance between a terminus base of telomere on chromosomal short arm and 5'-terminus of this base sequence : 5046071
  Distance between 3'-terminus of neighbour sequence of sequence listing upward to telomere on chrosomal short arm and 5'-terminus of this base sequence : 6835
gttaacaatgaacatacctgctactgcccggatctcctgtcctggcctcataacctcctcaggtggcccaaattgcctatctctaaagagctgtcagtgggaggcctgctaacacaacgggctgtttgactttgcctttgaggcaatgtgatccatggagtgaacatggcatgaggagccgggtgacctggttctagttttggttccagttcattcattcattcattcattcattcattcattcagatggagtctcgctcaggctggaatgcagtggcgcagtctcagctcactgcatcctctgcctcctcggttcaatcaattctcctgcctcagcctctagcgtagctgagattaca

SEQ ID NO: 22517 - DNA, 249 bp, Homo sapiens
  chr17.fa.O7frz.5607732
  Located on chromosome 17
  Distance between a terminus base of telomere on chromosomal short arm and 5'-terminus of this base sequence : 5191602
  Distance between 3'-terminus of neighbour sequence of sequence listing upward to telomere on chrosomal short arm and 5'-terminus of this base sequence : 145172
aaagtgctgtaattacaggtgtgagccaccgcacccggcctatacttgttttatttattttttctttcttcttcctctcctcccctctcctcccttcccctcccctcccctcttttccttttctttcttccattctctttctttctctccttctttccctccctccctcccttctttctttttagagacagggacttgctttgttgcccaggctggagtgcagtgctgtaatcatagctcactgcagac

SEQ ID NO: 22518 - DNA, 223 bp, Homo sapiens
  chr17.fa.O7frz.5115836
  Located on chromosome 17
  Distance between a terminus base of telomere on chromosomal short arm and 5'-terminus of this base sequence : 5246474
  Distance between 3'-terminus of neighbour sequence of sequence listing upward to telomere on chrosomal short arm and 5'-terminus of this base sequence : 54623
agtgctaggattacagccatgagccatggcacccagcctagatttacttattaattgatgtggggtgtgtgtgtgtgtgtgtgtgtgtgtgtgtgttttacaagaaggaatgcctttagatagcttcctgattttcagagaaccctcagatgttttcatattggtagagttaattagagctagaatagtaatgccactggggttaataactattcggtccagg

SEQ ID NO: 22519 - DNA, 407 bp, Homo sapiens
  AC004148.1_1229
  Located on chromosome 17
  Distance between a terminus base of telomere on chromosomal short arm and 5'-terminus of this base sequence : 5646310
  Distance between 3'-terminus of neighbour sequence of sequence listing upward to telomere on chrosomal short arm and 5'-terminus of this base sequence : 399613
gccgtatgttctttatgtaaacagttttattcagatataattcacgtgccaattcaaccatttaaaatgtaccattcagtggtttttgctgtactcacagatgtgtgcaaccatcatcacaatcaattttacaacattttcatcacctcaagtagtaactccctgtgacccgactacaccagctaaacacacacacacacacacacacacacacacacacacacacacacacacgaaaaagtaacacttcgccctttagctaccatccttattccccctcctcccctagccttaagcaactactaacctttctgcctctatagatttccctattctggactttcctatgaatagaatcatacgatatgtggtcttttgtgtccatgttctttcacgtagccttaatg

SEQ ID NO: 22520 - DNA, 120 bp, Homo sapiens
  D17S1810
  Located on chromosome 17
  Distance between a terminus base of telomere on chromosomal short arm and 5'-terminus of this base sequence : 5998982
  Distance between 3'-terminus of neighbour sequence of sequence listing upward to telomere on chrosomal short arm and 5'-terminus of this base sequence : 352265
tgtccactgtaacccctgcaacacacaaacacgcacacacacacacgcacatgcacacacacacacacacacacacacacacacacacacacacacactgtgtttcatgccctcactagg

SEQ ID NO: 22521 - DNA, 94 bp, Homo sapiens
  D17S1854
  Located on chromosome 17
  Distance between a terminus base of telomere on chromosomal short arm and 5'-terminus of this base sequence : 6121821
  Distance between 3'-terminus of neighbour sequence of sequence listing upward to telomere on chrosomal short arm and 5'-terminus of this base sequence : 122719
ccttgctcttaggatttgaggagagtcgtgtgtgtgtgtgtgtgtgtgtgtgtgtgtgtgtgttttgtggactgaatgtctgtgacctcccaaa

SEQ ID NO: 22522 - DNA, 192 bp, Homo sapiens
  G07962
  Located on chromosome 17
  Distance between a terminus base of telomere on chromosomal short arm and 5'-terminus of this base sequence : 6359269
  Distance between 3'-terminus of neighbour sequence of sequence listing upward to telomere on chrosomal short arm and 5'-terminus of this base sequence : 237354
ctttagtctgggcaacaagagcaaaactccgtctcaaaaaaaaaaacaaaactatctttctatctgtctatctatctatctatctatctatctatctatctatctatcatctatctacctatctatctataaattagctgagtgtggtggtaggcatgcctgtggtcccagctgcttgggagactaagatgg

SEQ ID NO: 22523 - DNA, 111 bp, Homo sapiens
  HUMUT158
  Located on chromosome 17
  Distance between a terminus base of telomere on chromosomal short arm and 5'-terminus of this base sequence : 6383320
  Distance between 3'-terminus of neighbour sequence of sequence listing upward to telomere on chrosomal short arm and 5'-terminus of this base sequence : 23859
taagagataggcacaaccaactgtttaaaacacacacacacacacacacacaaagagtaatcagggctctaagaaaaatagaaaagaaaaaccctgtaaggtcagtgctgg

SEQ ID NO: 22524 - DNA, 77 bp, Homo sapiens
  HUMUT136
  Located on chromosome 17
  Distance between a terminus base of telomere on chromosomal short arm and 5'-terminus of this base sequence : 6383321
  Distance between 3'-terminus of neighbour sequence of sequence listing upward to telomere on chrosomal short arm and 5'-terminus of this base sequence : -110
aagagataggcacaaccaactgtttaaaacacacacacacacacacacacaaagagtaatcagggctctaagaaaaa

SEQ ID NO: 22525 - DNA, 231 bp, Homo sapiens
  AC007962.1_124987
  Located on chromosome 17
  Distance between a terminus base of telomere on chromosomal short arm and 5'-terminus of this base sequence : 6426617
  Distance between 3'-terminus of neighbour sequence of sequence listing upward to telomere on chrosomal short arm and 5'-terminus of this base sequence : 43219
taaaagccagcttacatgtcacctcctccaggaagccttccctgaattcctccacactgaggttgcgagtcatttaggttccaatgctcgctctatctatctctctatctatctctctatctatctatctatctatctatcatcacagctagttgccatcccagcagccatctactaacatagaaacaattttgatcaagtggggatgcgctctgagatgactggcctatc

SEQ ID NO: 22526 - DNA, 191 bp, Homo sapiens
  D17S1832
  Located on chromosome 17
  Distance between a terminus base of telomere on chromosomal short arm and 5'-terminus of this base sequence : 6429228
  Distance between 3'-terminus of neighbour sequence of sequence listing upward to telomere on chrosomal short arm and 5'-terminus of this base sequence : 2380
tgtgtgactgttcagcctctttccacctcggtgcgtgtgtgtgtgtgtgtgtgtgtgtgtgtgtgtgtgtgtgagagagagagagagagagagagcctgtgggtcaatgcccagtatgcccctctgagagtgtgtctgttagtagacaccagtgtgtgacattgcttctgtgggcaactatgtcaaggcgt

SEQ ID NO: 22527 - DNA, 309 bp, Homo sapiens
  AC007962.1_26534
  Located on chromosome 17
  Distance between a terminus base of telomere on chromosomal short arm and 5'-terminus of this base sequence : 6498816
  Distance between 3'-terminus of neighbour sequence of sequence listing upward to telomere on chrosomal short arm and 5'-terminus of this base sequence : 69397
  misc_feature (1)...(309): n = A,T,G or C
atactcatttccacatctgcagcctagcattatgcccagcacgtgggaaacattcaatcagtattggantggatggatggatggatggatggatgcatggatggatggatagatggatgaataggcagacagacagacaaccaatgataagtgggccctataactactatttattgaatacctaccattcagtgtgtgctagacatcacataattctatctattcctcacagtgaccttgcaaggtaagcttaataattaccattttacattgcattttacagtgcagttaagtgacttgccttagtgc

SEQ ID NO: 22528 - DNA, 365 bp, Homo sapiens
  AC007962.1_85071
  Located on chromosome 17
  Distance between a terminus base of telomere on chromosomal short arm and 5'-terminus of this base sequence : 6596901
  Distance between 3'-terminus of neighbour sequence of sequence listing upward to telomere on chrosomal short arm and 5'-terminus of this base sequence : 97776
catacctgaatccatgtactaaatactctttgattttcctgagccactctgacatggggacgtacaaccaaaagcctaacaaagacagctgccctaggtcaggcttcatcttctttccagaagactcttgctaggctggcttcctcactgacctccctgcctcctggctccaccgccaatccacctctcacatgggtttccaggcaaacctcaccgtgttagtgcccctgtgtgcagaaaagagttggcgttaccattcttgttttgttttgttttgttttgtttgtttgtttttgaggcagagtctcgctcctgttgcccaagctgcagtacagtggcaccatctctgctcactgaaacctctg

SEQ ID NO: 22529 - DNA, 365 bp, Homo sapiens; identical to SEQ ID NO: 22528
  AC023308.3_38891
  Located on chromosome 17
  Distance between a terminus base of telomere on chromosomal short arm and 5'-terminus of this base sequence : 6596901
  Distance between 3'-terminus of neighbour sequence of sequence listing upward to telomere on chrosomal short arm and 5'-terminus of this base sequence : -365

SEQ ID NO: 22530 - DNA, 178 bp, Homo sapiens
  D17S938
  Located on chromosome 17
  Distance between a terminus base of telomere on chromosomal short arm and 5'-terminus of this base sequence : 6737340
  Distance between 3'-terminus of neighbour sequence of sequence listing upward to telomere on chrosomal short arm and 5'-terminus of this base sequence : 140074
ccggattgctacacctaaattctcctcatatagaaagtcaagaggcaacaaagaaagcagtggacagaacatggttaaatagcaaatatttcccctacacacacacacacacatacacacacacacacacacacacacacacacacacacacacacagctgctccagaagagactgtt

SEQ ID NO: 22531 - DNA, 160 bp, Homo sapiens
  D17S796
  Located on chromosome 17
  Distance between a terminus base of telomere on chromosomal short arm and 5'-terminus of this base sequence : 6739634
  Distance between 3'-terminus of neighbour sequence of sequence listing upward to telomere on chrosomal short arm and 5'-terminus of this base sequence : 2116
agtccgataatgccaggatgtgcctctttcacagtagcctttatgctctcctgagtacttggggtatacatgcacctgtgtgtgtgtgtgtgtgtgtgtgtgtgtgtgtgtgttaaaaaatactgctccaggatttcaaggaccacatttggttccattg

SEQ ID NO: 22532 - DNA, 412 bp, Homo sapiens
  chr17.fa.O7frz.7141162
  Located on chromosome 17
  Distance between a terminus base of telomere on chromosomal short arm and 5'-terminus of this base sequence : 6812976
  Distance between 3'-terminus of neighbour sequence of sequence listing upward to telomere on chrosomal short arm and 5'-terminus of this base sequence : 73182
ttaactagtaatgattcctgaggacgtgccaggccaaagggggcttcaaaacccacacaaggtcgtttcgtgctgacccttccaactgctcccaaacaaaggctattggcattgccgcaggttgctgcctgatagaagtttcacattctctccttttttaaaaaaaaatgcatcatacccacatacgaagcatccagtgaaggaggcagcacagtatagaaaagaaaagaaaagaaaaaaaagaaaagaaaagaaaagaaaagaaaagaaaagaaaagaaaagaaaagaaagccccagcccagactcctggaaacctgatgctaatcctggagctactgcccctctctaagcctcagtttccccatctgtacaaggggttgggactgagttgcctccaaggacctagtttgc

SEQ ID NO: 22533 - DNA, 224 bp, Homo sapiens
  D17S1881
  Located on chromosome 17
  Distance between a terminus base of telomere on chromosomal short arm and 5'-terminus of this base sequence : 6978764
  Distance between 3'-terminus of neighbour sequence of sequence listing upward to telomere on chrosomal short arm and 5'-terminus of this base sequence : 165376
accagtttaaggagtttggcgccacacacacacacacacacacacacacacacacacacacacgcagattacaaaaagaaagagaattatttgcccatgtgttcaggtaattgagcctcacaaatctgtcagaactcatatgggatactctagtgctaatctttctgagacaaaaggaaaacagaaactctctaaggaagcagtacacaaggctgactgcccta

SEQ ID NO: 22534 - DNA, 373 bp, Homo sapiens
  AC004706.1_68886
  Located on chromosome 17
  Distance between a terminus base of telomere on chromosomal short arm and 5'-terminus of this base sequence : 7047289
  Distance between 3'-terminus of neighbour sequence of sequence listing upward to telomere on chrosomal short arm and 5'-terminus of this base sequence : 68301
gaagttacctcggatcctttagccagagcaaatccgccccctagtagcagcacgatgccccagggcactttctcctgggttaccttccaatccagcaggggagggggataaaatggagttttcctttctgggaagaaaaagaaacacacacacacacacacacacacacacacacacacacacacacacacacaccagagcagcattagaagacaaaagaaatctaatcaagggggaataaagctaataaggacaatgaggtaccatctcctacttataaattagctaaagtttacaataatatatacattgctggtgaggatatgatcaaactattacacacactgccaatagcatcgtaaattggtatgac

SEQ ID NO: 22535 - DNA, 351 bp, Homo sapiens
  AC004706.1_74752
  Located on chromosome 17
  Distance between a terminus base of telomere on chromosomal short arm and 5'-terminus of this base sequence : 7053073
  Distance between 3'-terminus of neighbour sequence of sequence listing upward to telomere on chrosomal short arm and 5'-terminus of this base sequence : 5411
cggaggttaggagttcaagaccagcctggccaacatggcaaaaccccatctctactaaaaaatacaaaaattagccaggcatggtggtggtgggtgcctgtaattccagctacttgggaggctgaggcagggggaattgcttgaacccaggtggtggaggttgcagcgagccgagatcataccactgcactccagcctgggtgacagagcaagacactgtctcaaaaataaataaataaataaataaataaataaataaataaataaataaaataaaataaaataaaataaagaaaggaaaagagcgctcgaaatcatgtctggcacatgatgagcactcaataaatgttg

SEQ ID NO: 22536 - DNA, 442 bp, Homo sapiens
  AC034305.2_96682
  Located on chromosome 17
  Distance between a terminus base of telomere on chromosomal short arm and 5'-terminus of this base sequence : 7121896
  Distance between 3'-terminus of neighbour sequence of sequence listing upward to telomere on chrosomal short arm and 5'-terminus of this base sequence : 68472
ttaatcacaatgcctttatcactctcaatgatgttaacaataattttcccccatcgttttggggccttgcatttaccactcttgttcattactactgctgctgctgctgctgctgctgctgcttgcttctcccttgtattctattggattgagcaagatttctttattctctttcttctttcctactgattcgtcaattttacatttatttctatcatttcaatagttacccttaacattttaatataaatacttgacttaataaagtctaaagttagtcattatctctactttccttacaaatagtatatagatttgagaacatgttaacactgtaactatcttacatgaaaatgctgccagaattttgtttcattttgctttcatactacccctctttactgattattgttgttatttatgtaactcatgcctgtttaga

SEQ ID NO: 22537 - DNA, 349 bp, Homo sapiens
  HUMUT751
  Located on chromosome 17
  Distance between a terminus base of telomere on chromosomal short arm and 5'-terminus of this base sequence : 7147267
  Distance between 3'-terminus of neighbour sequence of sequence listing upward to telomere on chrosomal short arm and 5'-terminus of this base sequence : 24929
agcaagattctgtcaaaagagaaagaaaaagaaagaaagaaaggaaagagaaagaaagaaagaaagaaagaaagagagagagagagagagagaaagaaagaaagaaagaaagaaagaaagaaagaaagaaagaaaaagaagaaggaaggaagggagggagggaaagaaagaagaaaaagaaagaaagagagagagaaagaaagaaagaaagaagaaaggaaggaaagaaaaagaaagaaagaaagaaaggaaagaaagagaaagaaaaagaaagaaagagggagaaaggtaatttgtactttttatttttatttttttctttttttgagacagtttcactctgctagaa

SEQ ID NO: 22538 - DNA, 459 bp, Homo sapiens
  AC040977.2_122344
  Located on chromosome 17
  Distance between a terminus base of telomere on chromosomal short arm and 5'-terminus of this base sequence : 7287364
  Distance between 3'-terminus of neighbour sequence of sequence listing upward to telomere on chrosomal short arm and 5'-terminus of this base sequence : 139748
aaagttaaatgttcttcatccataaaaaggaatgaacgaaaaatacaacatggatgaccctcaaaaacactatgctaagctggccgggtgcagtggctcatgcctgtaatcccagcactttgggaggatgaggtgggcagatcatgaggtcaggagttcgagaccagcctgaccaacatggtggaacctcatctctactaaaaatacaaaaattacctgggcatggtggcgcacgcctgtagtcccagctacttgggaggctgaggcaggagaatcacttgaacccaggaggcggaggttgcagtgagctgagatcgtgccactgcactccagcctgggagacagagtgaggatctgtctcaaaaacaaacaaacaaacaaacaaacaaaattatgctaaataaaggaagccagacaccgaagaccacatattgaatgattccatttataagaaatgtc

SEQ ID NO: 22539 - DNA, 436 bp, Homo sapiens
  AC040977.2_64596
  Located on chromosome 17
  Distance between a terminus base of telomere on chromosomal short arm and 5'-terminus of this base sequence : 7391873
  Distance between 3'-terminus of neighbour sequence of sequence listing upward to telomere on chrosomal short arm and 5'-terminus of this base sequence : 104050
  misc_feature (1)...(436): n = A,T,G or C
agcatcttgatcgagttaagtaataaagtcaagattggaactgggccaggcacggtggctcacgcctgtaatcccagaactttgggaggccaaggctggtggatcacttgaggtcaggagttcgagaccagcgtggccaacatggtgagacctcgtctctactaaaaataccaaaattaactgggcgttgtggtgggagcctgtaatcccagaaactcaggagactgaggcaggagaatcacttgaacccgggaggtnggaggttgcagtgagccaagatcatgccactgcactccagcctgggccacagagcaagactccatctcaaaataaataaataaataaataaataaataaataaataaataaataaaagactggaactgtgatctgattctaaagacccgagttcttaatcactatgtaatacagccac

SEQ ID NO: 22540 - DNA, 394 bp, Homo sapiens
  chr17.fa.O7frz.7725213
  Located on chromosome 17
  Distance between a terminus base of telomere on chromosomal short arm and 5'-terminus of this base sequence : 7442647
  Distance between 3'-terminus of neighbour sequence of sequence listing upward to telomere on chrosomal short arm and 5'-terminus of this base sequence : 50338
ccatcctggctaataggagaccccatctctactaaaaatacaaaaaattagctgggcatggtggcaggcgcttgtaatcccagctactcgggaggctgaggcaggggaatcgcttgaacccaggaggtggaggttgcagtgagccaagatcacgccactgcactccagcctgggcgacagagcaagactctgtctcaaataaataaataaataaataaataaataaataaataaatcgttctagaactataaagaaattgattttagccaggcatgatggctcacacctgtaatcccagcactttgggaggccgaagcgggaggatcacttgagctcaggagtttgagaccagcctgggcaacatggcaaaactccatcactacgaaacaatac

SEQ ID NO: 22541 - DNA, 336 bp, Homo sapiens
  AC007421.12_26368
  Located on chromosome 17
  Distance between a terminus base of telomere on chromosomal short arm and 5'-terminus of this base sequence : 8133002
  Distance between 3'-terminus of neighbour sequence of sequence listing upward to telomere on chrosomal short arm and 5'-terminus of this base sequence : 689961
catggtgaaactggtctctactaaaacacaaaaattagctaggcatggtggtgcatgcctgtaatcccggttactcggggggctgaggcaggaaaattgcttgaacccgggagatgaggttgcagtgagccaagattgtaccactgccctctagcctgggcgatagaacaagactctatctcaaaataataataataataataataataataataataataataatataaacattgtatttgtttgcttttgttaattgtctactggagtggcagccccaggaacacagggaccagaatagtaatagcacctgactctaagcaaatgctcattaga

SEQ ID NO: 22542 - DNA, 413 bp, Homo sapiens
  chr17.fa.O7frz.8267570
  Located on chromosome 17
  Distance between a terminus base of telomere on chromosomal short arm and 5'-terminus of this base sequence : 8339362
  Distance between 3'-terminus of neighbour sequence of sequence listing upward to telomere on chrosomal short arm and 5'-terminus of this base sequence : 206024
gcaagatgctgtctgaaagaaagaaaaaaagaaagaaagaaagagaaagaaagagaagaaagaaaaagaaagaaagagaaagagaagaaagaaagaaagaaagaaagaaagaaagaaagaaagaaagaaagaaagaaagaaagaaagaaagaaaaagaaagaaagaaaaagcaagcaggcaaacaatatgctcagaatcccacgaaggagccaggactgagggaggatgcctggctcgtgagtggggagccgagaactgctgtcatggagaaggacgctcctgtgtgggaaggaatccaagatgacaggaccatagcctggggccccagtggagtggggactgagcctatcccagaaggagcagaggcctgaagaacagactctagcgaggcttactcgaatgtacttgatgg

SEQ ID NO: 22543 - DNA, 214 bp, Homo sapiens
  DISD22_0010657
  Located on chromosome 17
  Distance between a terminus base of telomere on chromosomal short arm and 5'-terminus of this base sequence : 8526647
  Distance between 3'-terminus of neighbour sequence of sequence listing upward to telomere on chrosomal short arm and 5'-terminus of this base sequence : 186872
tcagctctccagcctctcctcgccaagctcagctcacctggctccccctgcgcaccttcacccctcccggggccacaaagacacacagacacacacagacacacacagacacacacacacacacacacagacacacacacacacacacacacacacacactcttaccgccccagttgcaaagtctctcccaaagtggttcagcagctgcttatg

SEQ ID NO: 22544 - DNA, 110 bp, Homo sapiens
  DISD22_0010675
  Located on chromosome 17
  Distance between a terminus base of telomere on chromosomal short arm and 5'-terminus of this base sequence : 8948715
  Distance between 3'-terminus of neighbour sequence of sequence listing upward to telomere on chrosomal short arm and 5'-terminus of this base sequence : 421854
agtggagtcccatgaacccgcctccccactgacacacacacatacacacacacacacacacacacacacacacacacacacacacacacatcttccctcagagattgtgc

SEQ ID NO: 22545 - DNA, 242 bp, Homo sapiens
  chr17.fa.O7frz.24288975
  Located on chromosome 17
  Distance between a terminus base of telomere on chromosomal short arm and 5'-terminus of this base sequence : 9119152
  Distance between 3'-terminus of neighbour sequence of sequence listing upward to telomere on chrosomal short arm and 5'-terminus of this base sequence : 170327
tgaaagtcaaatagcaaagtttacattataaggtgcggagagaaaaagtttgggttatagaaattttaaaggccttttaaatacacacacacacacacacacacacacacacacacacacacacacacacacacacacacaccctgacaccctatagcttttacttcagaactttttgccactagataaatagaaatttactggcttgcaaaaatatcttgttggatctaaacagtggtttt

SEQ ID NO: 22546 - DNA, 463 bp, Homo sapiens
  AC068418.3_100474
  Located on chromosome 17
  Distance between a terminus base of telomere on chromosomal short arm and 5'-terminus of this base sequence : 9379248
  Distance between 3'-terminus of neighbour sequence of sequence listing upward to telomere on chrosomal short arm and 5'-terminus of this base sequence : 259854
ctttggtgatatgcttggacagggcttcctcatctgaagagcatgaaaacagtcacttaaactgctttattttatttatttatttatttatttatttatttatttatttatttatttattttgagatggggtctcactctgtcgcccaggctggggtgcagtggcgcgatgtcggctcactgcaagctctgcctcccgctcccgggttcacgccattctcctgcctcagcctgtgaagttgctgggactacaggcacccgccaccgcacccagctaattttttgtatttttagtagaggcggggtttcaccgtgttagtcaggatggtctcgatctcctgacctcgtgatccacccgcctcggcctcccaaagtgctgggattacaggcataagccaccgcgcctggcctaaactgctttatttttttttaagactttgaactttacatttggcactgtatgt

SEQ ID NO: 22547 - DNA, 474 bp, Homo sapiens
  chr17.fa.O7frz.23979879
  Located on chromosome 17
  Distance between a terminus base of telomere on chromosomal short arm and 5'-terminus of this base sequence : 9425334
  Distance between 3'-terminus of neighbour sequence of sequence listing upward to telomere on chrosomal short arm and 5'-terminus of this base sequence : 45623
ctggagcctcagaattctctgttcttccaggccggggccagggctgacatgacttgttttttccatccagtcatcatgattggagcccagagttggttgtaagctagctagtccgtcccttccatgatgacttcctgccaaccacagggctgggagcttggagcgaggacagagacccaccggcccgatgtcacccacaggaaatctggatgcagcagggcacatgtggccacacaggccacttgtctaggagggaaactgctggggccctgcagaagatgaggctgcaggctcacgggtgaagaggcgaagcagcctcatgatctcacactctgtccgcggccttggagacagctctgtgtgtgtgtgtgtgtgtgtgtgtgtgtgtgtagcatttcccatgtgcctcctctgtgaaaacagcagcccaaattaatgacagcaaatgctgaagtctgagatggtcagatgtta

SEQ ID NO: 22548 - DNA, 453 bp, Homo sapiens
  AC026130.2_34942
  Located on chromosome 17
  Distance between a terminus base of telomere on chromosomal short arm and 5'-terminus of this base sequence : 9719425
  Distance between 3'-terminus of neighbour sequence of sequence listing upward to telomere on chrosomal short arm and 5'-terminus of this base sequence : 293617
gatccttaagcttgactggtaggctcagactgtgtaagtgtgtattactgttaaaggttattatgatgggaagtggctgtgtgtgtgtgtgtgtgtgtgtgtgtgttgcaggggttggggtgcctctggacaaggggaggaagagaaaagcaactaagtttaaccctaggcatccatccctctatctatctatctatctatctatctatctatctatctatctactatctatgtatctatctatctatctatgtatctatctatctgtctatctgtctatctctgtctgtgtaatggtattgtcctgtagtgccctcactgcatgatggttgcttaaaacaaaagattttatttgaaaacaaagaggaaaagaagagaagggggaatcaaaataagcacattcaatgacggggcccagagaaatgctcaggaactcaggaacactgagaacat

SEQ ID NO: 22549 - DNA, 329 bp, Homo sapiens
  AC002091.1_141963
  Located on chromosome 17
  Distance between a terminus base of telomere on chromosomal short arm and 5'-terminus of this base sequence : 9762092
  Distance between 3'-terminus of neighbour sequence of sequence listing upward to telomere on chrosomal short arm and 5'-terminus of this base sequence : 42214
tgtacagtgattctagagccagttatcttaactgccaatcttatttctaataatttctttctttcttttgctcgctcactcttctttcttctttctttctttctctctctgtctctctccctccccctttcctttcctttcctttcctttcctttcctttcctttcctttcctttcctttcctttcctttttcctttcctttcctttcctttccttctagatggagttttgctcttgttgcccaggctggagttcaatggcgcagtctcagctcactgcaatctccacctcccaggttcaagcgattctcctgcctaagccttcgtagt

SEQ ID NO: 22550 - DNA, 253 bp, Homo sapiens
  D17S1858
  Located on chromosome 17
  Distance between a terminus base of telomere on chromosomal short arm and 5'-terminus of this base sequence : 9781650
  Distance between 3'-terminus of neighbour sequence of sequence listing upward to telomere on chrosomal short arm and 5'-terminus of this base sequence : 19229
gacatccccgcgtgactcgtgtgtgtgtgtgtgtgtgtgtgtgtgtgggcatgcgcatgtgcgcgtgctggcccatcccggcctggggtaaatacacaaaaagttcaggtcagtaggaggaaggagattgttcagaaggaaaaggaaggcgaggttaaagcagcaggatgtggtataaagcgagttaacaagactcggagtagagaggaggggtgggtttaggcagaataagggctaaaagtaggccaagcct

SEQ ID NO: 22551 - DNA, 430 bp, Homo sapiens
  AC002091.1_66071
  Located on chromosome 17
  Distance between a terminus base of telomere on chromosomal short arm and 5'-terminus of this base sequence : 9837991
  Distance between 3'-terminus of neighbour sequence of sequence listing upward to telomere on chrosomal short arm and 5'-terminus of this base sequence : 56088
tctcttagttcagtcaatggcttcatgacaaagaagaggaatgggtttagtgctgagctgggcttgggttccagaatagctgtgagtcccaaaagaggatttgggctcttttgtaaagaattctcttttatggttgtgtgtgtgtgtgtgtgtgtgtgtgtgtgtgtgtgtgtgtgttttaattattttaaatacatgtgatttggaaaacatgtcactttcactctcggctacctatccctgtaagaagatgcccaaggttacagttctggccccactatttacctggtagttttttccttcatcataagccaaccagctcagaagagctgaaccacctctggagcgcataacatataaacccaaatggaaagtctggatcaccgtgtagcaaaagaggagggtttcatagaaaggtctgatctgcaag

SEQ ID NO: 22552 - DNA, 264 bp, Homo sapiens
  Z67616
  Located on chromosome 17
  Distance between a terminus base of telomere on chromosomal short arm and 5'-terminus of this base sequence : 9837993
  Distance between 3'-terminus of neighbour sequence of sequence listing upward to telomere on chrosomal short arm and 5'-terminus of this base sequence : -428
tcttagttcagtcaatggcttcatgacaaagaagaggaatgggtttagtgctgagctgggcttgggttccagaatagctgtgagtcccaaaagaggatttgggctcttttgtaaagaattctcttttatggttgtgtgtgtgtgtgtgtgtgtgtgtgtgtgtgtgtgtgtgtgttttaattattttaaatacatgtgatttggaaaacatgtcactttcactctcggctacctatccctgtaagaagatgcccaaggttacag

SEQ ID NO: 22553 - DNA, 149 bp, Homo sapiens
  D17S786
  Located on chromosome 17
  Distance between a terminus base of telomere on chromosomal short arm and 5'-terminus of this base sequence : 9838087
  Distance between 3'-terminus of neighbour sequence of sequence listing upward to telomere on chrosomal short arm and 5'-terminus of this base sequence : -170
ggatttgggctcttttgtaaagaattctcttttatggttgtgtgtgtgtgtgtgtgtgtgtgtgtgtgtgtgtgtgtgtgttttaattattttaaatacatgtgatttggaaaacatgtcactttcactctcggctacctatccctgta

SEQ ID NO: 22554 - DNA, 136 bp, Homo sapiens
  HUMUT79
  Located on chromosome 17
  Distance between a terminus base of telomere on chromosomal short arm and 5'-terminus of this base sequence : 9838100
  Distance between 3'-terminus of neighbour sequence of sequence listing upward to telomere on chrosomal short arm and 5'-terminus of this base sequence : -136
tttgtaaagaattctcttttatggttgtgtgtgtgtgtgtgtgtgtgtgtgtgtgtgtgtgtgtgtgttttaattattttaaatacatgtgatttggaaaacatgtcactttcactctcggctacctatccctgta

SEQ ID NO: 22555 - DNA, 343 bp, Homo sapiens
  AC003695.1_26042
  Located on chromosome 17
  Distance between a terminus base of telomere on chromosomal short arm and 5'-terminus of this base sequence : 9853343
  Distance between 3'-terminus of neighbour sequence of sequence listing upward to telomere on chrosomal short arm and 5'-terminus of this base sequence : 15107
aggtctgtatcaattatgccaggtgttaggcacacagttcccccactttcattattttcagatgaggaactggaggtcagagaggtcaagcaacttccccaaggtcacacagcgagcaagggtacgagccagaatttaaccctcaggcttattcagaagcccatgatatttccacaatctccttctgtctgttactaaaacagtgtttccaaacttttttgaccaggacctataagaaaaatccattttatatgacagcctgatacacaaacacacacacacacacacacacacacacacacacacacagctgaaatgaaatgtatcctggttacataggatg

SEQ ID NO: 22556 - DNA, 336 bp, Homo sapiens
  AC002091.1_12824
  Located on chromosome 17
  Distance between a terminus base of telomere on chromosomal short arm and 5'-terminus of this base sequence : 9891386
  Distance between 3'-terminus of neighbour sequence of sequence listing upward to telomere on chrosomal short arm and 5'-terminus of this base sequence : 37700
gtcagatgtgatttgcaaatattttctctaggtctatactttgcttcttcattttattttattattttattttattttattgttgttttgttttgttttgttttgttttgttttgtttctgagatggagtctcgctctgtcacccaggctagagtccagtggcacgatctcagctcactacaacctctgctgcccgggttcaagtgattctcctgcctcagcctcctgagtaactgggattacaggcatgagccaccacagccaactaatgtttgtatttttagtagaaatggggtttcactatattggccaggctagtcttgaactcctgacctc

SEQ ID NO: 22557 - DNA, 458 bp, Homo sapiens
  chr17.fa.O7frz.9277364
  Located on chromosome 17
  Distance between a terminus base of telomere on chromosomal short arm and 5'-terminus of this base sequence : 9952820
  Distance between 3'-terminus of neighbour sequence of sequence listing upward to telomere on chrosomal short arm and 5'-terminus of this base sequence : 61098
agtaagtgtgatctagcctgaacaagaggaagaaggaagagaaaaagaagcgtgagttggggggagggggtgtacaggacaagaccgaagactgagggaggtgatgattgatggatctaaaagattttaagggaaggatgggaggccaagatgttcatttgggctatttagttaatgtttgactttatgttttctttaatgtatgaagcccctttttccaaaggggaaaaaaaaagttgtgctacttgccatggggaattcaaggatgaataaaatgcacagtccacaccctcaagaagctaacagtctaactagaagatttacttacacacacacacaaacacacaaacacacacacaacacacacacacacacggaagcacaggacagtgtgggagatgctgcagaaaaagtattactagagtttaagaaagagaacatttctgactcaataactc

SEQ ID NO: 22558 - DNA, 388 bp, Homo sapiens
  chr17.fa.O7frz.9177616
  Located on chromosome 17
  Distance between a terminus base of telomere on chromosomal short arm and 5'-terminus of this base sequence : 10018609
  Distance between 3'-terminus of neighbour sequence of sequence listing upward to telomere on chrosomal short arm and 5'-terminus of this base sequence : 65331
actcatttcctacctcaagaagcaatacgtgtctacctgggtcagcgtttagcaagagaagtaagtagattgatagatagatagatagatagatagatagatagatagatagatagagatggatggatggatggatggatggatggatgggtgggtggatgggtggatgggtgggtggatgggtggatgggtggatgggtggatagatggatggatgggatagataaatagtagatagaagatagatggtaggtagataagataggagataatagcagatagatgatagatacatagatatagaagatagatgataaattagatgatagataaatagcaaatagaagatagataatatgtagatagatcggagatagacaatacatag

SEQ ID NO: 22559 - DNA, 227 bp, Homo sapiens
  D17S1844
  Located on chromosome 17
  Distance between a terminus base of telomere on chromosomal short arm and 5'-terminus of this base sequence : 10032550
  Distance between 3'-terminus of neighbour sequence of sequence listing upward to telomere on chrosomal short arm and 5'-terminus of this base sequence : 13553
cattccagcctgggtgagagtgagactccgtctcaaaaaccacacacacacacacacacacacacacaccgtaagctccatgagagcagggtttttttgttgttgctgctgttgctggctgcactatccccactgcctagaatggtgcttggtacaaacatcaattgttcgtaggatagatggagtgagagaatgagggatttaggaaaaacgcctcctatggatct

SEQ ID NO: 22560 - DNA, 267 bp, Homo sapiens
  DISO7_00000016
  Located on chromosome 17
  Distance between a terminus base of telomere on chromosomal short arm and 5'-terminus of this base sequence : 10315484
  Distance between 3'-terminus of neighbour sequence of sequence listing upward to telomere on chrosomal short arm and 5'-terminus of this base sequence : 282707
  misc_feature (1)...(267): n = A,T,G or C
ctccatggtcgcatgtagcccagccagaaggaatcactaaggattctttgtggtccagcctagctcagccccaagttccactggctcagccagaggtcaaagacgtgctggtctggtcctgtcctctgcaaggctcccatcgagattgtttcagctcactacagggaaatctctcctactagcagcacgttgtcttttgggaaaatagttgtgtgtgtgtgtgtgtgntgtnngtgttcctcatccctacttaaatccagtggtcaa

SEQ ID NO: 22561 - DNA, 137 bp, Homo sapiens
  D17S952
  Located on chromosome 17
  Distance between a terminus base of telomere on chromosomal short arm and 5'-terminus of this base sequence : 10646283
  Distance between 3'-terminus of neighbour sequence of sequence listing upward to telomere on chrosomal short arm and 5'-terminus of this base sequence : 330532
accttaccatgcacacagttggcattcagggagaggatgaaacctcacacacacaggcacatgtgcgtgcacacacacacacacccccacacccacacacacacacacacacacactcttctgctgtctcctgggga

SEQ ID NO: 22562 - DNA, 466 bp, Homo sapiens
  chr17.fa.O7frz.9775024
  Located on chromosome 17
  Distance between a terminus base of telomere on chromosomal short arm and 5'-terminus of this base sequence : 10923675
  Distance between 3'-terminus of neighbour sequence of sequence listing upward to telomere on chrosomal short arm and 5'-terminus of this base sequence : 277255
agacatacctgaataaggactgttacccaaaatatacagagaacttttaaaactcaacaataagaaatgggccaaagaccttaactgccacctcccctaaagaagatatacagatggcagccgggcgcagtggcttgtgcctgtaatcccagcactttgggaggctgaggcgggccgatcacctgaggtcaggagtttaagaccagcggggccaacatggtgaaaccccgtctctactaaaaatacaaaagttagccaagtgtggtggtgtgagcctgtaatcccagctactagggaggctgaggcaggagaatcacttgaacccggcagtgagatcacgccattgcacttcagcctgggggacacagcaagactctgtctcaaaataaataaataaataaataaataaataaataaataaataaataaataaataaaagaagatatacagatggcaagtaagcat

SEQ ID NO: 22563 - DNA, 383 bp, Homo sapiens
  AC069006.3_137965
  Located on chromosome 17
  Distance between a terminus base of telomere on chromosomal short arm and 5'-terminus of this base sequence : 11254948
  Distance between 3'-terminus of neighbour sequence of sequence listing upward to telomere on chrosomal short arm and 5'-terminus of this base sequence : 330807
ggaaaggtaagtggaaacattctgaacaacacccattttggcatccaggactcattcggcaacaaacaggtgcttttacccaaagatatggatgggaggacaagagaggacctgggttctacctatcgtctatctaacatctatctatctatctatctatctatctatctatcatctatctatttatctatccatccacctatatatctgtctatctgcctatccatccatccatccatccatccatccatccatccatccattaaggagtgggaaaggatagagatggaagaatgttttgttttgttaacacaaatgctgtcgaaaattctttagggtgagagcaacacaattgcagagttactgttagcatcaagatgtga

SEQ ID NO: 22564 - DNA, 253 bp, Homo sapiens
  G10221
  Located on chromosome 17
  Distance between a terminus base of telomere on chromosomal short arm and 5'-terminus of this base sequence : 11254997
  Distance between 3'-terminus of neighbour sequence of sequence listing upward to telomere on chrosomal short arm and 5'-terminus of this base sequence : -334
actcattcggcaacaaacaggtgcttttacccaaagatatggatgggaggacaagagaggacctgggttctacctatcgtctatctaacatctatctatctatctatctatctatctatctatcatctatctatttatctatccatccacctatatatctgtctatctgcctatccatccatccatccatccatccatccatccatccatccattaaggagtgggaaaggatagagatggaagaatgttttgt

SEQ ID NO: 22565 - DNA, 395 bp, Homo sapiens
  AC026591.2_157463
  Located on chromosome 17
  Distance between a terminus base of telomere on chromosomal short arm and 5'-terminus of this base sequence : 11386321
  Distance between 3'-terminus of neighbour sequence of sequence listing upward to telomere on chrosomal short arm and 5'-terminus of this base sequence : 131071
cagttatttccaaacctgtatacttctcaggatccatgaggagttccttaaaaagtccacatccagccaggtgcagtggtttgcacctgtaatcccaacacttcgggagactgaggcaggagtagtatatcacttgaggctaggagtttgagaccagcctgggcaacaacataagatcccctctctataaaataaaataaaataaaataaaataaaataaaataaataaaataaaataaaataaaataaaataaaataaaataaaataaaataaaataattatccaggcacagttgtgcacacctatagtcccagcttctctggagtccgaagcaggaggattgcttgagcccaggagttcaaggctgcagtgagctagaatcgtgctactgtac

SEQ ID NO: 22566 - DNA, 198 bp, Homo sapiens
  D17S945
  Located on chromosome 17
  Distance between a terminus base of telomere on chromosomal short arm and 5'-terminus of this base sequence : 11427217
  Distance between 3'-terminus of neighbour sequence of sequence listing upward to telomere on chrosomal short arm and 5'-terminus of this base sequence : 40501
cctgaagcctgaccccagataccaaggattcaggatggtggttctcattttgtgtgtgtgtgtgtgtgtgtgtgtgtgtgtgtgtgtgtgtgtgtgtctagggtattcctaggacccccaatcctatcatgagcccaagaaatgcttccctctctaaagatggcagttttattttacactggggagtccagattggtt

SEQ ID NO: 22567 - DNA, 237 bp, Homo sapiens
  AC005747.1_37492
  Located on chromosome 17
  Distance between a terminus base of telomere on chromosomal short arm and 5'-terminus of this base sequence : 11429315
  Distance between 3'-terminus of neighbour sequence of sequence listing upward to telomere on chrosomal short arm and 5'-terminus of this base sequence : 1900
aatcgtagacaagtcggttatcctgcgcttgcctccgtgtcttcatctgtaaaatggagataacgattgtacctttaccaagttgttatgaggaataaatatgtcaaaatatgtaaagcacttagaatagagatgggcgtagagagccaaatattaatatgggctatggtggtgatgaagatgatgatgatgatgatgatgatgatgatgatccctgaggatctgatgtctttcctt

SEQ ID NO: 22568 - DNA, 411 bp, Homo sapiens
  AC000003.1_550
  Located on chromosome 17
  Distance between a terminus base of telomere on chromosomal short arm and 5'-terminus of this base sequence : 11682791
  Distance between 3'-terminus of neighbour sequence of sequence listing upward to telomere on chrosomal short arm and 5'-terminus of this base sequence : 253239
ggaactatgtaaataagttgcctacccaagcccagggtaaggggcttgtgtgagtttgctggggctgccacaaaaaagaatcatagactgggtggcttaaaccactgaaatttatttcctcacagttctagaagctgggaatccaagctcaaggttgcttgtaaggcttctccccactggcttacaaacagccgtcttctccctatgtcttcacacggttttccctctgtgtgtatctgtgtcctcatttccctttcttaaaaggacaccagtcatacaggatgagggcccaccctaatgaccgcattttatttagttagttagttagttagttagttattttccttgacctacaacagtgtggtcaaaaattctttttctttttatttgtactttgtagagccaaggtct

SEQ ID NO: 22569 - DNA, 155 bp, Homo sapiens
  D17S1879
  Located on chromosome 17
  Distance between a terminus base of telomere on chromosomal short arm and 5'-terminus of this base sequence : 11725686
  Distance between 3'-terminus of neighbour sequence of sequence listing upward to telomere on chrosomal short arm and 5'-terminus of this base sequence : 42484
gaagtttacgaaaattgctgtccctccctggctcagtgttatccctccttgtggctcctttgcccagggccacacggtcccttcattcttgaaacacacacacacacacacacacacacacacacacatgcaggcacgcacgcagaactaccctt

SEQ ID NO: 22570 - DNA, 471 bp, Homo sapiens
  chr17.fa.O7frz.10892458
  Located on chromosome 17
  Distance between a terminus base of telomere on chromosomal short arm and 5'-terminus of this base sequence : 11736055
  Distance between 3'-terminus of neighbour sequence of sequence listing upward to telomere on chrosomal short arm and 5'-terminus of this base sequence : 10214
aaaggaatgagttggatactagtaaccaataaggaaagaaaggaagaaagaaagaaagagaaagaaagaaagaaggaaggaagggaaagaaagagagagagaaagagaaagaaggaaggaagaaagaaagaaagagaaagaaggaaggaaggaaggagaaagaaaagaaagaaagaaagaaagaaagaaagaaagaaagaaagaaagaaagaaagaaagaaagaaagaaagaaggaaagaaaagaaagagcaatgatcctggaagggcaaacatcacagtggttcaccatggcccagagtcagtcagcattcaaccgactctggagggagaagattcctccttgctatgctttgactgtcccctccaaaacacatgttgacatttaattgccagtgtaatggtattgggaggttggacctttaatgattagggcagagccctcatgaatgaattaatcctatcatgccagt

SEQ ID NO: 22571 - DNA, 370 bp, Homo sapiens
  chr17.fa.O7frz.11038614
  Located on chromosome 17
  Distance between a terminus base of telomere on chromosomal short arm and 5'-terminus of this base sequence : 11882231
  Distance between 3'-terminus of neighbour sequence of sequence listing upward to telomere on chrosomal short arm and 5'-terminus of this base sequence : 145705
caggtaatttctatgcataggagatggggaagtactgggcctctaaactctaaacgcggtctctaaactttgtgcgtggcggtgtcagggtgtgacaaatattgtttagttagattaatacccaccttagaacttgctgcatggtgtgtgtgtgtgtgtgtgtgtgtgtgtgtgtgtgtgtgtgtgtgtatggggctgtgtgtgtgtagggggtattggtctctctcatcccttgtatcactttctcctaaactatctccctttgctgcctttcttgctcttctctttatgtattttttccttcttttatgtaatgtattgtccctgcttagaatgcagaaaattcatcttaaagtcctagcactgatca

SEQ ID NO: 22572 - DNA, 381 bp, Homo sapiens
  AC005323.1_134678
  Located on chromosome 17
  Distance between a terminus base of telomere on chromosomal short arm and 5'-terminus of this base sequence : 12058478
  Distance between 3'-terminus of neighbour sequence of sequence listing upward to telomere on chrosomal short arm and 5'-terminus of this base sequence : 175877
aagttgatgtcatggtgctcttataaatccttattaaaaaataaaatggccgggcacagtgtctcatgcccataatcccatcactttgagaggccaaggtggccagatcacctgaggtcaggagttcgagaccagcctggacaacatggtgaaaccccatctctactaaaacacaaatattagccaggcatggtggcgcatgcctgtaatcccagctacttgggaggctggggcagggagaatcgcttgaacctgggaggtggaggtagctgtgagctgagatttcgccattgcactctggcctgggtgacaaagtgagactccatctcaacaaacaaacaaacaaacaaacaaaactattgtaatccaaagaggataatc

SEQ ID NO: 22573 - DNA, 202 bp, Homo sapiens
  D17S1852
  Located on chromosome 17
  Distance between a terminus base of telomere on chromosomal short arm and 5'-terminus of this base sequence : 12128723
  Distance between 3'-terminus of neighbour sequence of sequence listing upward to telomere on chrosomal short arm and 5'-terminus of this base sequence : 69864
agtaactctgaggacttgctcatatattcaggaagctcttctttgaaattaatttatatatttcttctcctataccttcagtctgactggactgtaggggaagtgtgtgtgtgtgtgtgtgtgtgtgtgtgtgtgtgtgtgtgtgtgtgtaggtacctgtatgtgaatagaacattcatggaagggcacacaagaaactgta

SEQ ID NO: 22574 - DNA, 374 bp, Homo sapiens
  AC002347.1_132316
  Located on chromosome 17
  Distance between a terminus base of telomere on chromosomal short arm and 5'-terminus of this base sequence : 12128724
  Distance between 3'-terminus of neighbour sequence of sequence listing upward to telomere on chrosomal short arm and 5'-terminus of this base sequence : -201
gtaactctgaggacttgctcatatattcaggaagctcttctttgaaattaatttatatatttcttctcctataccttcagtctgactggactgtaggggaagtgtgtgtgtgtgtgtgtgtgtgtgtgtgtgtgtgtgtgtgtgtgtgtaggtacctgtatgtgaatagaacattcatggaagggcacacaagaaactgtaaacagtgcttactttagggaggggcatggatgaactgggataccaaagagactatttttattttcagatattttgtgctgttttagactgctctttcttccattaaatgagagattagatctgaatggccacgtgatcttctgagtcccatctgtaagaatctgcatttccac

SEQ ID NO: 22575 - DNA, 204 bp, Homo sapiens
  D17S974
  Located on chromosome 17
  Distance between a terminus base of telomere on chromosomal short arm and 5'-terminus of this base sequence : 12131927
  Distance between 3'-terminus of neighbour sequence of sequence listing upward to telomere on chrosomal short arm and 5'-terminus of this base sequence : 2829
agaccctgtctcagatagatggataggtaggcagatagatagatgatagatagatagatagatagatagatagatagataggtatgacattcagttttgggtgccaccaacctgttaacaatggcacctcctcaccttaccccagtccatccttcagacagtggaattgaggagaatggacagggaggggcactttctatttta

SEQ ID NO: 22576 - DNA, 157 bp, Homo sapiens
  AC002347.1_117076
  Located on chromosome 17
  Distance between a terminus base of telomere on chromosomal short arm and 5'-terminus of this base sequence : 12144001
  Distance between 3'-terminus of neighbour sequence of sequence listing upward to telomere on chrosomal short arm and 5'-terminus of this base sequence : 11870
atcacattataccgtgaaatgaacaataatctcatgtcaccatcaatatccagtcaatagtcaaatttaccaattggaccgtgtgtgtgtgtgtgtgtgtgtgtgtgtgtgtctattttttaacagcgtgtttgtacaaagcagtatcctaacaagg

SEQ ID NO: 22577 - DNA, 98 bp, Homo sapiens
  Z66908
  Located on chromosome 17
  Distance between a terminus base of telomere on chromosomal short arm and 5'-terminus of this base sequence : 12144041
  Distance between 3'-terminus of neighbour sequence of sequence listing upward to telomere on chrosomal short arm and 5'-terminus of this base sequence : -117
catcaatatccagtcaatagtcaaatttaccaattggaccgtgtgtgtgtgtgtgtgtgtgtgtgtgtgtgtctattttttaacagcgtgtttgtaca

SEQ ID NO: 22578 - DNA, 377 bp, Homo sapiens
  AC002347.1_294
  Located on chromosome 17
  Distance between a terminus base of telomere on chromosomal short arm and 5'-terminus of this base sequence : 12260609
  Distance between 3'-terminus of neighbour sequence of sequence listing upward to telomere on chrosomal short arm and 5'-terminus of this base sequence : 116470
tgtcatttgatccagaaattactgcccagaactttcctggccaatagttctgttctcctgcctaaattccttcttcatctgactccagattccctgtttctgcctagggtgcattcattcctccctccctccctccctccctccttctcttccttccttccttccttcctccttctttctctttttctttctttttttctctttctttctttctttctttctttctttctttctttctttctttctttccttctttctttctttctttctttctttctttctttctgtctttctctctctctctctctttcttttttggaatcggggtcacactctgtcattcaggtttgagtgtagtgcttctgtcataactcact

SEQ ID NO: 22579 - DNA, 228 bp, Homo sapiens
  D17S954
  Located on chromosome 17
  Distance between a terminus base of telomere on chromosomal short arm and 5'-terminus of this base sequence : 12405225
  Distance between 3'-terminus of neighbour sequence of sequence listing upward to telomere on chrosomal short arm and 5'-terminus of this base sequence : 144239
ataaaacgcccgattctttcccaggatagtggagagtttcacagttcccttttttctttcatgctgtagcaacaccaattatcacctgctggactcttaatggggtgtgtgtgtgtgtgtgtgtgtgtgtgtgtgtgtggtcaccggaagcttttgaaacaggtagtggggtattgaatgtttttttgccatagcagtgtaaaaacagaacagccacatgatggaggt

SEQ ID NO: 22580 - DNA, 310 bp, Homo sapiens
  AC005284.1_52816
  Located on chromosome 17
  Distance between a terminus base of telomere on chromosomal short arm and 5'-terminus of this base sequence : 12451651
  Distance between 3'-terminus of neighbour sequence of sequence listing upward to telomere on chrosomal short arm and 5'-terminus of this base sequence : 46198
gaaagagttaaccattccagatttatttatttatttatttatttatttatatttatttatttatgagatggtgtcttgctctgacgcctaggctggagtgcagtggtgcaatcttgctcactgcagcttccacctcccctcgcgggttcaagtgattctcctgcctcagcctccggagtagccaggactacaggcatacgccaccacacccagctaatttttatttatttttattttttattttttgtatttttactagagacagggtttcaccgtgttggtcaggctgatcttgaactcctgatctcaa

SEQ ID NO: 22581 - DNA, 381 bp, Homo sapiens
  AC005284.1_67407
  Located on chromosome 17
  Distance between a terminus base of telomere on chromosomal short arm and 5'-terminus of this base sequence : 12466231
  Distance between 3'-terminus of neighbour sequence of sequence listing upward to telomere on chrosomal short arm and 5'-terminus of this base sequence : 14270
ataaatacggacctatttggagtatatatttttttcttttcttttcttttcttttcttttcttttgaaatggagtcttgctctgtcacccaggctggagtgtagtggcacggtcttggctcactgcaacttccacctcccgggttcaagcaatgctctgcctcagcctcccgagtagctgggattacaagcgcccatcaccacgcctggctaatttttgtattttcagtagagacaggtttcaccatcttggccagaatggtctcaaactgctgaccttgtgatccaccctcctcggcctcccagagtgctgggattaaaggcatgagccactatgcctggcctagagtatatatttcttcttgagtgatgtttgatactt

SEQ ID NO: 22582 - DNA, 241 bp, Homo sapiens
  D17S1303
  Located on chromosome 17
  Distance between a terminus base of telomere on chromosomal short arm and 5'-terminus of this base sequence : 12472865
  Distance between 3'-terminus of neighbour sequence of sequence listing upward to telomere on chrosomal short arm and 5'-terminus of this base sequence : 6253
tggtctttttccattccaaatatctatctatctatctatctatctatctatctatctatctatctatctatcatctatctatctttatatgtacatctcaaggtaagttaccataaaacaaattctaaatgactgcttagaggcagtaagttctgaaggagtttggaggagggagaggtctttgtttacaactgggggtgtttttataaaagtagatggcatttgagtgagccttggagag

SEQ ID NO: 22583 - DNA, 281 bp, Homo sapiens
  Z67133
  Located on chromosome 17
  Distance between a terminus base of telomere on chromosomal short arm and 5'-terminus of this base sequence : 12554971
  Distance between 3'-terminus of neighbour sequence of sequence listing upward to telomere on chrosomal short arm and 5'-terminus of this base sequence : 81865
caatgtgacaccactgctattacatagaaaatgctatttctgcagcaggcatatacatggtctacattgtgtgtatgtatgtgtgtgtgtgtgtgtgtgtgtgtgtgtgtgtatggggtgcaggtggtggtggggtctcttgcacttagaaaccatgcatatctcattgactcaactattcaggttctttgagttaaaggaggtagaaatcctcctcgaccagtttaagcaatataaggaaagtgattggttcatggaactaggggaatcttagggtggct

SEQ ID NO: 22584 - DNA, 433 bp, Homo sapiens
  AC005548.1_109086
  Located on chromosome 17
  Distance between a terminus base of telomere on chromosomal short arm and 5'-terminus of this base sequence : 12637207
  Distance between 3'-terminus of neighbour sequence of sequence listing upward to telomere on chrosomal short arm and 5'-terminus of this base sequence : 81955
ataatggcaagcacctataatccgagctactcaggaggctgaggcaggagaattgcttgaacctgggagacagaggttgcagtgagccaaaatcacaccactgcacaccagcctgggcaacagagcaagactccatctcaataataataataataataataataataataataataacaaatcaaatagacaatttaaaaaatatatacatataacatatatgtgtgtatatatacataagtgtatatatatatatatatatatatatatatatacacacacatatacacatcttttgggatataggcattatcacatcactgcacagatccataatttataccatacctattttgtgactgggaacaaaagtgggcaaaaagaaaaggaaaatacattgatgttgaggagctcaattcagtctgtggataaa

SEQ ID NO: 22585 - DNA, 403 bp, Homo sapiens
  AC005725.1_9912
  Located on chromosome 17
  Distance between a terminus base of telomere on chromosomal short arm and 5'-terminus of this base sequence : 12754114
  Distance between 3'-terminus of neighbour sequence of sequence listing upward to telomere on chrosomal short arm and 5'-terminus of this base sequence : 116474
ctgagcaacagagtaagaccttgtctcaagaaaaaaaagaaaagaagatcaacttcaactcttagctggtgccccaaccccaaggtaacaacatccagagaaataacaccaaaaaaagaagaagaaagaagaaagaaggaaggagaaggagaaggagaagaaggagaagaagagaaggagaaggaggagaaggagaaggaggagaagaaagaagaagaaagaagaagaaagaagaagaaaagaagaagagaaaagaagaagaagaggaagaagaagaagaagaagaagaagaagaagaagaagaagaagaagaagaagaaggaattatcactatttttaagagcaagaaaatttccccagaaaccccctgcaaacttctctcacttagtattggctagaactg

SEQ ID NO: 22586 - DNA, 434 bp, Homo sapiens
  chr17.fa.O7frz.12254841
  Located on chromosome 17
  Distance between a terminus base of telomere on chromosomal short arm and 5'-terminus of this base sequence : 13093096
  Distance between 3'-terminus of neighbour sequence of sequence listing upward to telomere on chrosomal short arm and 5'-terminus of this base sequence : 338579
agcaaggccacttactatctagagaccatatatttaaacttttcatgcttcagtcaacccatctgtaaaaggggattagaactgtcctcggtcatatggtttttgtgaggatgaaataagttactatgtgtagagcacttaaaagagcacttagcatagaataactcaataaatcttagaagaaattgtgactaattcccatataatggttgtataaggtgtcgtgggggtggtaagctatataaatttcctcctgtctcaaagagtgaccattctaaacaatcctacatccttgcaaaacctagacatttgcaatggttatacctcctgtcaatcagaactttctagagactccctcatatatttaaaacatatatatatatatatatatatgttactttaagtgggagggtacatccagtctgagttaatcc

SEQ ID NO: 22587 - DNA, 345 bp, Homo sapiens
  chr17.fa.O7frz.12333530
  Located on chromosome 17
  Distance between a terminus base of telomere on chromosomal short arm and 5'-terminus of this base sequence : 13172055
  Distance between 3'-terminus of neighbour sequence of sequence listing upward to telomere on chrosomal short arm and 5'-terminus of this base sequence : 78525
attcctgagttacttcacttagaataatggtctccaagtccatccaggttgctgcaaatgccattatttcattccttttcatggctgagtagcattccatggtgtgtgtgtgtgtgtgtgtgtgtgtgtgtgtgtagaactagataaaagataaaaatttagagaaaaagataaaaatttcttctgttcatggagcttctgttcagtggtttttgtctaaaaatatttaaattatcaaaaggcaaacattatttaaggcctaattactaagttttgtatttgacctaagggacctttatgactaccctggaggttgtgtaatatattggataaatgcagagctac

SEQ ID NO: 22588 - DNA, 340 bp, Homo sapiens
  AC005209.1_42665
  Located on chromosome 17
  Distance between a terminus base of telomere on chromosomal short arm and 5'-terminus of this base sequence : 13335445
  Distance between 3'-terminus of neighbour sequence of sequence listing upward to telomere on chrosomal short arm and 5'-terminus of this base sequence : 163045
taacttcaacagctacctaaagacttgttctagaaatgggaaaattttgtttttctgatacccattgcttttctggagtgaaccacattcacctttacatcatatccattgttttcaactttttagctatagtgtttcgttcattcttacctccctcagtctcatctttttcattgagaaaactgatgtcatttagtttgggcctcacagctactttatacatcacagtctgtctccattattactattattattattattattattattatttgcagttttctcttttcctccattattaccattcctcctttccaaggtcaacttttcgtctgagcta

SEQ ID NO: 22589 - DNA, 316 bp, Homo sapiens
  AC005209.1_141985
  Located on chromosome 17
  Distance between a terminus base of telomere on chromosomal short arm and 5'-terminus of this base sequence : 13434877
  Distance between 3'-terminus of neighbour sequence of sequence listing upward to telomere on chrosomal short arm and 5'-terminus of this base sequence : 99092
ctgctaccagatatgttcaaagaaacagttttccattcagtgtctttgcagccagattctcgaaactttgctttgggtcttgttttcattgttcctgaccccattcttttttcttgtatttggttgggtgtttttttgttttgttttgttttgttttgttttgttttgttttgttttgagacaggctctcactgtgttgcccacgctggagtgcagtggcgccatcttggctcattgccacctctacctcccaggctcaagtgatcctcttgcctcagcctcccaggtagctggactataggcatatgccactatg

SEQ ID NO: 22590 - DNA, 132 bp, Homo sapiens
  G07950
  Located on chromosome 17
  Distance between a terminus base of telomere on chromosomal short arm and 5'-terminus of this base sequence : 13458453
  Distance between 3'-terminus of neighbour sequence of sequence listing upward to telomere on chrosomal short arm and 5'-terminus of this base sequence : 23260
aactgcagtgttgcatcatagaaactcagaactgagtggatgaccggatagatagatagatagatagatagatagatagatagatagatagtgatagattagatagatggatagatgaatgacagattagat

SEQ ID NO: 22591 - DNA, 330 bp, Homo sapiens
  AC005209.1_165474
  Located on chromosome 17
  Distance between a terminus base of telomere on chromosomal short arm and 5'-terminus of this base sequence : 13458463
  Distance between 3'-terminus of neighbour sequence of sequence listing upward to telomere on chrosomal short arm and 5'-terminus of this base sequence : -122
ttgcatcatagaaactcagaactgagtggatgaccggatagatagatagatagatagatagatagatagatagatagatagtgatagattagatagatggatagatgaatgacagattagatagatgatagatagatagatattgtatataactgtatattgatatactgtatctggatatagatagatattgtatataactgtatattgatatactgtatctggatatagatagatagatttgtcattgctgctcatcacttcagcttcacatggcccacaggggccaccttttggcccaagtctgtcttatggctttctagtttgatt

SEQ ID NO: 22592 - DNA, 301 bp, Homo sapiens
  AC005244.1_125870
  Located on chromosome 17
  Distance between a terminus base of telomere on chromosomal short arm and 5'-terminus of this base sequence : 13612475
  Distance between 3'-terminus of neighbour sequence of sequence listing upward to telomere on chrosomal short arm and 5'-terminus of this base sequence : 153682
attgttcagttttatggtgcactcttcagagaggtaggaataaactgggttttagctgactaatgaatatctaattgggacaaatgaagatggcaggattcgattctattcttaaatgccatacattagtaataagttaatatctcagtatcttagtgtttaaccatggtaatttacatattaacttctgactctttttgcggtggtgggtaaggggtgaatcacacgtgtgtttgtgtgtgtgtgtgtgtgtgtgtgtgtgtgtgtattttagtattggtggctgtcatttgtaaatctc

SEQ ID NO: 22593 - DNA, 363 bp, Homo sapiens
  chr17.fa.O7frz.12974886
  Located on chromosome 17
  Distance between a terminus base of telomere on chromosomal short arm and 5'-terminus of this base sequence : 13811895
  Distance between 3'-terminus of neighbour sequence of sequence listing upward to telomere on chrosomal short arm and 5'-terminus of this base sequence : 199119
tcctcagatattgctacaataaacattcatcttataaatgaataaatcagtttccagcttggggttgaagagtgggggaaggtgtagactctagaaaatgcagagatgtagactctagagaaattctaggaataatttctccttaagttgggtaaattaagctaagtctaaaataagccagaaattaaagttccccattcaaatatcaatccattcttacaatctgatttatacttaccattaagaaactatattcattcctttgtttatttttccttttgtccatctatccatccatccatccatccactcaattatccattcatctatccaaacatgagctaaacatctgctacgacctaa

SEQ ID NO: 22594 - DNA, 292 bp, Homo sapiens
  AC005245.1_146948
  Located on chromosome 17
  Distance between a terminus base of telomere on chromosomal short arm and 5'-terminus of this base sequence : 13883540
  Distance between 3'-terminus of neighbour sequence of sequence listing upward to telomere on chrosomal short arm and 5'-terminus of this base sequence : 71282
ttcttgaagtttcctgaaacacacacacacacacacacacacacacatgcacacactattattgctcagaaaaaaaaggcaacatagtttttcatttttaaaagtcaggaaataaaaatcatagaagttttttttctttctttcttttcctttttttctttctttctttctttctttcttttttttttttttttttttgttagatatgaagcctctgtctgtcacccaggctggagtgcagtggcgtgatcaccgctcactgctgcctcaacattcctgtactcaaaccatc

SEQ ID NO: 22595 - DNA, 257 bp, Homo sapiens
  AC005245.1_150907
  Located on chromosome 17
  Distance between a terminus base of telomere on chromosomal short arm and 5'-terminus of this base sequence : 13887447
  Distance between 3'-terminus of neighbour sequence of sequence listing upward to telomere on chrosomal short arm and 5'-terminus of this base sequence : 3615
gcttgaaactatggatagtaacagaccctagccaaggtcacattttacttaaaggaagcactttatttatttattattattattattattattattattattattattattattattattgagacagagtctcactctgttgcccaggccggagtgcagtggcgtaatctcggctcactgcaacctccgcctcccaggttcaagcgattctcctgcctcagcctcccgagtacctgggattaaaggtaccagccacc

SEQ ID NO: 22596 - DNA, 314 bp, Homo sapiens
  AC005245.1_157460
  Located on chromosome 17
  Distance between a terminus base of telomere on chromosomal short arm and 5'-terminus of this base sequence : 13893862
  Distance between 3'-terminus of neighbour sequence of sequence listing upward to telomere on chrosomal short arm and 5'-terminus of this base sequence : 6158
gaactttctccttagttcagctaaaaccaggctcttgtcacatggccaggaaagatgaggctcgcagacacatagaagggtgaggaaaatgaaatttattgggcaaaaaggaaaaaaaaaacaaaactctcagtaaagcgagatagagtcctgctagcaggtttcctgcctcacagattgaatcccaggtcaccacacaggaacaggtcaggccaggccaggccaggccaggccaggcccattcccatctcaaatggcatgaactttccgaggctccaccccatcctcccagtgtgcaggtaagcattattcac

SEQ ID NO: 22597 - DNA, 451 bp, Homo sapiens
  chr17.fa.O7frz.13295465
  Located on chromosome 17
  Distance between a terminus base of telomere on chromosomal short arm and 5'-terminus of this base sequence : 14075903
  Distance between 3'-terminus of neighbour sequence of sequence listing upward to telomere on chrosomal short arm and 5'-terminus of this base sequence : 181727
cctgagctcaagtgactgtgcaactcagcatcccaaagtgctgggattagaggcatgagccaccacgcctggcccagtctatagattctccttccttccttccttccttccttccttccttccttccttccttccttcctccctccctccctccctccctccctcccttcttccctctctccctccctcccttccccacccgcattccttccttccttccttcctctcttcctcccttcctccttttcttccttcctctctttccttcttctacttgtctggttttagaatcagagttatgatgatctcataaattgagttgggaagtgttttctcttctacattttagaagagatattgtagaattgatgttcttttaaaatgtttaataaaattattcataaataacatgggcctggagaattttgtcagatagtcttaaactgcaaat

SEQ ID NO: 22598 - DNA, 296 bp, Homo sapiens
  chr17.fa.O7frz.16488621
  Located on chromosome 17
  Distance between a terminus base of telomere on chromosomal short arm and 5'-terminus of this base sequence : 14116162
  Distance between 3'-terminus of neighbour sequence of sequence listing upward to telomere on chrosomal short arm and 5'-terminus of this base sequence : 39808
ttactttcagtttcaaaggtaaagataatacacttgaattttactttgaagagtagggaccaatatgtctccacacatattttattaatcatgggcgttttgccagactgatgggatgcatctggtaaattcactctgtgtgtgtaagtgtgtgtgtgtgtgtgtgtgtgtgtgtgtgtcactgacttaccacatgtaatgattaaatgatacatgtaattacattatttatttatggtaattgaaaagaaagtactactaaggtaattattgactttcctaatatcagaccactt

SEQ ID NO: 22599 - DNA, 157 bp, Homo sapiens
  chr17.fa.O7frz.16382142
  Located on chromosome 17
  Distance between a terminus base of telomere on chromosomal short arm and 5'-terminus of this base sequence : 14222762
  Distance between 3'-terminus of neighbour sequence of sequence listing upward to telomere on chrosomal short arm and 5'-terminus of this base sequence : 106304
ggcttgctatgtagaaatgagactgtgtgtgtgtgtgtgtgtgtgtgtgtgtgtgtgtatgaaatctggactccttctatgactgcctttcctgtttgttctgacccatgaagcaggtatggttctttcatgttcctcaagcgtatcaaatgttact

SEQ ID NO: 22600 - DNA, 452 bp, Homo sapiens
  chr17.fa.O7frz.16268904
  Located on chromosome 17
  Distance between a terminus base of telomere on chromosomal short arm and 5'-terminus of this base sequence : 14335846
  Distance between 3'-terminus of neighbour sequence of sequence listing upward to telomere on chrosomal short arm and 5'-terminus of this base sequence : 112927
ctctatgttggtcaggctagtcttgaactcccgacctcaggtgatctgcctgtcttggcctcccaaagtgctgggattacaggtgtgagccaccacgcctggccctagtaaaatcacattctaattctacatcccccagagtatgtattctttgacccagacctctaaataggtaagggtgtgtgtgtgtgtgtgtgtgtgtgtgtgtgtgtagaagtgatggcacattaactccaacatataggtactatgggccttttaaatctatataactcttagagcttattaaagttcctttatgtattatctcatgtgattctccccaagagggaagaatgaccattatgtaccatgtaacctcatgttacaggtaggtaactaatactgagagaagtaaaataatttattgaaggttgcatgtagtagagatagtaatgctcactaaacgttcc

SEQ ID NO: 22601 - DNA, 370 bp, Homo sapiens
  AC005703.2_17208
  Located on chromosome 17
  Distance between a terminus base of telomere on chromosomal short arm and 5'-terminus of this base sequence : 14461077
  Distance between 3'-terminus of neighbour sequence of sequence listing upward to telomere on chrosomal short arm and 5'-terminus of this base sequence : 124779
aactcagtcatgatcagatgacggaaaaatctcagcctggcagttcccttctcctaactactgtctcagagattctcaatggaagcatcatgaagttatctcctttcggtggccaactgcttggagtgcagataggttccctgccctgccctacgcagggggttcttcatgcccttcccatgaattaggaaaactggggctatttcaatggtacaacagggttggtctataaaaacccctttcgtttgccaaaacaaacaaacaaacaaacaaacaaaaaaaacctttgtatctctggtgatacggtatagaagaatatgtccccaaaagcccaccgcatctcgcaccctaagtagattcgatttgctga

SEQ ID NO: 22602 - DNA, 476 bp, Homo sapiens
  chr17.fa.O7frz.16070310
  Located on chromosome 17
  Distance between a terminus base of telomere on chromosomal short arm and 5'-terminus of this base sequence : 14534279
  Distance between 3'-terminus of neighbour sequence of sequence listing upward to telomere on chrosomal short arm and 5'-terminus of this base sequence : 72832
atagaatttgaggcttacactttcttccagcccttttaaaatgttgtttgtcttctggtttgggtagtttctgacaataattcagcactaattcttatcttcgttctttttttccaaatatgtccttcctgtctgattttcaaattttctctctatccctggttttcagcattttgattatgagccttggagtggtggtggcagcagggggttgtgtgtgtgcacgtatgtgtgtgtgtgtgtgtgtgtgtattcttggagtttgtggagcttcttgacctaggtatttatagttttcagcaaatttgggaaatattcagccattatttcctcaaatatttttgtctctctacttttttttatggcactgcaaaaccttaatattagaacctttgctattgcaccataggttaccaaggtgcttttaattttcttttttagttaaaaaaaaagtctgagctcactaatttctaatg

SEQ ID NO: 22603 - DNA, 302 bp, Homo sapiens
  AC005703.2_162257
  Located on chromosome 17
  Distance between a terminus base of telomere on chromosomal short arm and 5'-terminus of this base sequence : 14606148
  Distance between 3'-terminus of neighbour sequence of sequence listing upward to telomere on chrosomal short arm and 5'-terminus of this base sequence : 71393
tgctcatatttctaaagtgcttacttagaacagtcctgagtatgttgtgatcacataagtgttggttaaataaataaatgtccaaatggcataaaacaaagtaataatttctagagcaaatctaacttataaaatgacctgtggaggaaagaaaacactgccatgtctttagacttttttttctacttgcatatgcactttcatttataaatctttatctatctatctatatctatctatctatctatctatctacctacctacctacctacctatcagagttacaagctactttagtgcag

SEQ ID NO: 22604 - DNA, 258 bp, Homo sapiens
  HUMUT1860
  Located on chromosome 17
  Distance between a terminus base of telomere on chromosomal short arm and 5'-terminus of this base sequence : 14618017
  Distance between 3'-terminus of neighbour sequence of sequence listing upward to telomere on chrosomal short arm and 5'-terminus of this base sequence : 11567
tgttgagctttcctgtaatctgtccccaaacgtccttggccacctccattgtctaagggcagtacctgcagcccctcatttcccagtgacaacaggtgggtctgctctgccacagtgtgtgggcgggaccagcaccagacgctgagaagatgaccacttactactcttcttttccatttaaacagcagcagcagcagcagcagcagcagcagcagcagcaacagcaaactcatgactatcaataggttgtgtgaggaa

SEQ ID NO: 22605 - DNA, 381 bp, Homo sapiens
  chr17.fa.O7frz.15890271
  Located on chromosome 17
  Distance between a terminus base of telomere on chromosomal short arm and 5'-terminus of this base sequence : 14714285
  Distance between 3'-terminus of neighbour sequence of sequence listing upward to telomere on chrosomal short arm and 5'-terminus of this base sequence : 96010
tgtttcctctcaagtactcattattcttcaaactaccatgttgtgagctctatgatagaaatcatctggaaataaaatatgccattttaccacaagagggtgtatttgacctttgtaggcaacaaagcttactatttaaagcttcacttcatagacatggacttttcagagggtttaatatgcatgagatcaattccaaatgtatcatcaaattatttaggaaagttattcatgtgtctgtgttgtgtgtgtgtgtgtgtgtgtgtgtgtgtgtgtgtgtgtgtccaggaagtgtatatatccctcccatgtgttttctgatgactatggaatgggaaccgtattttgacaacattttctccatcaaacagtaaatctttg

SEQ ID NO: 22606 - DNA, 452 bp, Homo sapiens
  chr17.fa.O7frz.15809760
  Located on chromosome 17
  Distance between a terminus base of telomere on chromosomal short arm and 5'-terminus of this base sequence : 14794828
  Distance between 3'-terminus of neighbour sequence of sequence listing upward to telomere on chrosomal short arm and 5'-terminus of this base sequence : 80162
agtcagacagctgtagaattacagtgttgcgcctctagttctagtttcccagcatcctgctttcctcaaaaagcctccagtcaaacctctgtgctgtgttctcttcaataagtaaccagctgggtactgtgtcctggccattgcaggagacacattttgtaagcacttctgtcttggctgtttggccaagactgaaagtcatactctaattctttattattattatttattattattattattattattattttgagatggagtttcgcttttgttgcccaggctggagtgcaatggctctgtcgcagctcactgcaacctccacctcccgggttcaagtgattctcctgtctcagcctcccaagtaactgggattacaggtgcccaccatcacacctggctaatttttgtattttcttttagtagacatgggatttcaccatgttgcctag

SEQ ID NO: 22607 - DNA, 366 bp, Homo sapiens
  AC005773.1_24725
  Located on chromosome 17
  Distance between a terminus base of telomere on chromosomal short arm and 5'-terminus of this base sequence : 14873414
  Distance between 3'-terminus of neighbour sequence of sequence listing upward to telomere on chrosomal short arm and 5'-terminus of this base sequence : 78134
atcgagactcctggctaacacggtgaaaccccatctctattaaaaatacaaaaaattagccgggcttggtggcgggtgcctgtagtctcaactacttgggaggctgaggcaggagaatggcgtgaacccaggaggcggagcttgcagtgagctgagatcacgccactgcactccagcctgggcgactgagtgagactccatctcaaagaaataaaaaaagaaaatactactactactactactactactactaataataataataatacatggtattttaagcctgcattaaaactgtggggattagaaatcaagaaatgtcagagtaataaaattgatattgtctatgcattaagaaatcagcag

SEQ ID NO: 22608 - DNA, 252 bp, Homo sapiens
  chr17.fa.O7frz.15610675
  Located on chromosome 17
  Distance between a terminus base of telomere on chromosomal short arm and 5'-terminus of this base sequence : 14994071
  Distance between 3'-terminus of neighbour sequence of sequence listing upward to telomere on chrosomal short arm and 5'-terminus of this base sequence : 120291
aaactctggaaattaaccaaaggcttgcttgcagcaatccaaagagtctcacacacacacacacacacacacacacacacacacacacacacacgtcttggtaaaaacaatgagctttgtgttattttattttaataatatgtagtcccattccctcctctcctcttgagattgcctgtagtttcacataggacaaaatcaaccctccgcaatcacagccccaggaaggagtagaatgcagtaggaactcct

SEQ ID NO: 22609 - DNA, 435 bp, Homo sapiens
  AC013248.5_24361
  Located on chromosome 17
  Distance between a terminus base of telomere on chromosomal short arm and 5'-terminus of this base sequence : 15158208
  Distance between 3'-terminus of neighbour sequence of sequence listing upward to telomere on chrosomal short arm and 5'-terminus of this base sequence : 163885
tatccaaagagttgtcactagaaccctgttcttcttaatccttaaccagtttcatctcacagactatcctgcaaattgtattgtattgtattgtattgtattgtattgtattgtattgtattgtattgtattgtattgtattgtattgtaatttctttgaaaattagtaaaccatcaaatcactgatggttgtttcaaagccaaatgtgttcacttggggttctcataaaataatttggtcatggagcttttgaagttctttgagtgccttggaagaatgctagtttaatgtgatgatactgctccttttaaagccaatctcctgtcttgtgtgataatctcaagcccatcttcatgtggacttgagatcatctgtttctcttttaccatccattagatgttcctttcctactcatagcaatttgagtatctacc

SEQ ID NO: 22610 - DNA, 253 bp, Homo sapiens
  AC005900.1_138667
  Located on chromosome 17
  Distance between a terminus base of telomere on chromosomal short arm and 5'-terminus of this base sequence : 15216924
  Distance between 3'-terminus of neighbour sequence of sequence listing upward to telomere on chrosomal short arm and 5'-terminus of this base sequence : 58281
tgacaaacctttagctagactaattgagaaataagggagaagactaaaataaattaaagcagaaatgagagaggagacattataactgatactacaaaaatacaaaggatcataaggctaccataaatcttgtattatatacatatggatatctatctatctatctatctatctatctatctatctatctatctttctatctgtttatactagttttacgtatatacacatagtggaatgctattcaggtata

SEQ ID NO: 22611 - DNA, 157 bp, Homo sapiens
  D17S839
  Located on chromosome 17
  Distance between a terminus base of telomere on chromosomal short arm and 5'-terminus of this base sequence : 15288547
  Distance between 3'-terminus of neighbour sequence of sequence listing upward to telomere on chrosomal short arm and 5'-terminus of this base sequence : 71370
agaccctggaagatcaactaccttaataaactgtgtgtgtgtgtgtgtgtgtgtgtgtgtgttacagttgactttttgcatgttctatactttttgttttttgagacagagtttcgctgttgttgctcaggctggagtgcaatggcacgatctcggc

SEQ ID NO: 22612 - DNA, 303 bp, Homo sapiens
  HUMUT405
  Located on chromosome 17
  Distance between a terminus base of telomere on chromosomal short arm and 5'-terminus of this base sequence : 15578737
  Distance between 3'-terminus of neighbour sequence of sequence listing upward to telomere on chrosomal short arm and 5'-terminus of this base sequence : 290033
tgagtggaaagtacagagagttcccatatatctcccttaacacagacacacagacacacacacacacacatacacacacacacacacacacacactgtattagtctgttttcacactgctataaagaaatacctgattgatactgggtacttcataaaataaagaggtttaattgactcacagttccacatgggttgagaggcctcaggaaacttacaatcatggcagaaggcgaaggggaaagaagcaccctcttcagaaggcggcagaagagagaagagagcagggaaaccaccacttata

SEQ ID NO: 22613 - DNA, 291 bp, Homo sapiens
  AC005224.1_97183
  Located on chromosome 17
  Distance between a terminus base of telomere on chromosomal short arm and 5'-terminus of this base sequence : 15619438
  Distance between 3'-terminus of neighbour sequence of sequence listing upward to telomere on chrosomal short arm and 5'-terminus of this base sequence : 40398
caatagagccagactctgtctaaggaaaacacacacaaacatacacacacacacacacacacacacacacacacaatagataacatcgaaaataaaagttaagaaataacactataaagatactatttagagatatataccagaaggcatacagtaattaaagggttaaatacaagtagtgggacttagagatgaaaagtgtcagttttcattgtaagtgctattaaaattttgaataaacatatgcccatattgatttgataaaaaattaaacttgaggctaggttcagt

SEQ ID NO: 22614 - DNA, 186 bp, Homo sapiens
  D17S922
  Located on chromosome 17
  Distance between a terminus base of telomere on chromosomal short arm and 5'-terminus of this base sequence : 15742616
  Distance between 3'-terminus of neighbour sequence of sequence listing upward to telomere on chrosomal short arm and 5'-terminus of this base sequence : 122887
ttgaggtactggctaggcaggccttctaagttcaatgctgtaatttaaaaaccacacacacacacacacacacacacacacacacacacatacacacactcttaaagattcaaattactattaaaaatgcaacttttgaaaaaaattaaaaacacttctaaaggtggtgctaactttgatgtggcc

SEQ ID NO: 22615 - DNA, 117 bp, Homo sapiens
  D17S1856
  Located on chromosome 17
  Distance between a terminus base of telomere on chromosomal short arm and 5'-terminus of this base sequence : 15856729
  Distance between 3'-terminus of neighbour sequence of sequence listing upward to telomere on chrosomal short arm and 5'-terminus of this base sequence : 113927
tcatggaagacaattttgcgtgtgtgtgtgtgtgtgtgtgtgtgtgtgtgtgtgtgtgtgtgtgatggagttttgctcctgtcacccaggctggagtgcagtggcaccatctcagct

SEQ ID NO: 22616 - DNA, 174 bp, Homo sapiens
  chr17.fa.O7frz.14664849
  Located on chromosome 17
  Distance between a terminus base of telomere on chromosomal short arm and 5'-terminus of this base sequence : 15939917
  Distance between 3'-terminus of neighbour sequence of sequence listing upward to telomere on chrosomal short arm and 5'-terminus of this base sequence : 83071
atcagttgattgtaaccatcactgtttgtaataacggtgtatgtgtgtgtgtgtgtgtgtgtgtgtgtgtgtgttgagagctagtacagcaattgacaatgtttggatgatctccatttaggggaacagcaaagatctggtttatttaaactgttaagcttggtatcaatcctt

SEQ ID NO: 22617 - DNA, 408 bp, Homo sapiens
  chr17.fa.O7frz.14587890
  Located on chromosome 17
  Distance between a terminus base of telomere on chromosomal short arm and 5'-terminus of this base sequence : 16016869
  Distance between 3'-terminus of neighbour sequence of sequence listing upward to telomere on chrosomal short arm and 5'-terminus of this base sequence : 76778
ttctcctgctcattgaattagtcagggttctttagagcaatagaaccaatagggttgtgtgtgtgtgtgtgtgtgtgtgtgcatgtgtatacatataaagagatttataagaaatcaggtcatacgatcatagatgctgagaagtcccaaaatctgtagttggcaaggtagaggcccaggaaagctgatgttgtagttgtaggaccagttcaaaggcctgagaaccaggagaaccaaagtttcagttcaaattcaaagacaggaaaagactgataccccagctcaagcagtcaggcaagaagaattccctcttactcagtctttttgttctattcagatcgtcagtggattggatgaggcacacccatgtaagaaagggcaacctgctttactcaacctatgaatgca

SEQ ID NO: 22618 - DNA, 395 bp, Homo sapiens
  AC015842.9_49910
  Located on chromosome 17
  Distance between a terminus base of telomere on chromosomal short arm and 5'-terminus of this base sequence : 16112922
  Distance between 3'-terminus of neighbour sequence of sequence listing upward to telomere on chrosomal short arm and 5'-terminus of this base sequence : 95645
tatgccacctagctacttgtaataatataaaataaaataaaataaaataaaataaaataaaataaaataaaataaaataaaacaaaacaaaacaaaacaaaacaaaataaaaaactagtagtaatcctagctacttgggaggctgaggcaggagaactgtttgatcctgggaggcagaggttgcagtgaaccgagattgcactactgcactccagcctaggtgaccaagctagattccatttccagaaaaataaaaaataaaaaaagtactgatgcctcacccaaagcaaatgagttaaaatcttagaagggtagggtcgcagccttctttgaacctcctcggtgattctaatgtgcagccgaggtagagaaactactaagcgtggaaatagctt

SEQ ID NO: 22619 - DNA, 190 bp, Homo sapiens
  chr17.fa.O7frz.14418446
  Located on chromosome 17
  Distance between a terminus base of telomere on chromosomal short arm and 5'-terminus of this base sequence : 16186301
  Distance between 3'-terminus of neighbour sequence of sequence listing upward to telomere on chrosomal short arm and 5'-terminus of this base sequence : 72984
attgattacttggaggaaataaacaaatcccttgacaaacacagattttttaaattgggcacacacacacacacacacacacacacacacacaatagaaaatttgaatatccctgtgtcttttaaatacacttaaacaaaatataatcttttccacaaggaacactaggtctagatggcataaatgtgaa

SEQ ID NO: 22620 - DNA, 210 bp, Homo sapiens
  AC005411.1_66094
  Located on chromosome 17
  Distance between a terminus base of telomere on chromosomal short arm and 5'-terminus of this base sequence : 16274691
  Distance between 3'-terminus of neighbour sequence of sequence listing upward to telomere on chrosomal short arm and 5'-terminus of this base sequence : 88200
ctcacatagaccagatgcttacttcatgagaagagtgttgcagagcaaacaaaactctctgatatcaacaacaacaacaacaacaacaacaacaaccaaaaaggcctcgtatctctccgggacacagttgaacaattgcaaattgcaatcaccatcagtcaaattgctgggcccagtcgggaacttgatattcttagctcgtttccttag

SEQ ID NO: 22621 - DNA, 95 bp, Homo sapiens
  D17S936
  Located on chromosome 17
  Distance between a terminus base of telomere on chromosomal short arm and 5'-terminus of this base sequence : 16340572
  Distance between 3'-terminus of neighbour sequence of sequence listing upward to telomere on chrosomal short arm and 5'-terminus of this base sequence : 65671
aggtatatgcccaccccaacccgtgtgtatgtgtgtgtgtgtgtgtgtgtgtgtgtagttacataaattgattgattgctgttgtggtttcaaat

SEQ ID NO: 22622 - DNA, 299 bp, Homo sapiens
  AC005375.4_54107
  Located on chromosome 17
  Distance between a terminus base of telomere on chromosomal short arm and 5'-terminus of this base sequence : 16433677
  Distance between 3'-terminus of neighbour sequence of sequence listing upward to telomere on chrosomal short arm and 5'-terminus of this base sequence : 93010
tagatacatgctgaagcatttcagagtaaagcattaagttgtttataacttactctcatatgagctcagaaacaaacatatatatagaatagaatagaatagaatagaatagaatagaatagaataggtacatatatacactcaaacatatattcatacatcagtctaacccaggagaacccaagagcttccttttcaggattagaataaaacattgagagaaggctcatatgaatggaaataatattgttgaaatgaaagaaaaaaaataaggtttatttcaccatgttcaaatgtac

SEQ ID NO: 22623 - DNA, 190 bp, Homo sapiens
  D17S799
  Located on chromosome 17
  Distance between a terminus base of telomere on chromosomal short arm and 5'-terminus of this base sequence : 16602790
  Distance between 3'-terminus of neighbour sequence of sequence listing upward to telomere on chrosomal short arm and 5'-terminus of this base sequence : 168814
gaccagcatatcattatagacaagcaaaggtggtgtgtgtgtgtgtgtgtgtgtgtgtgtgtgtgtgcgtgtgtgtgcatattttaaggaaaagaaccttgctttgaggtgagtatgcatgggtcaaaggaacgaaaaggaagtaaagaacatggaaattcttcaagtgaaataactgacggctggcaat

SEQ ID NO: 22624 - DNA, 318 bp, Homo sapiens
  AC003664.1_49687
  Located on chromosome 17
  Distance between a terminus base of telomere on chromosomal short arm and 5'-terminus of this base sequence : 16638249
  Distance between 3'-terminus of neighbour sequence of sequence listing upward to telomere on chrosomal short arm and 5'-terminus of this base sequence : 35269
tctgtaagttccttgaggacagggactgtgcttttcttatttgcataaaccctcagcacctaaaacaatgtctatttcactatatataaaaggccctcagtaaaatatatatgtatgtgtatatgtgtgtgtgcatatatgtatatatgtatgtgtgtacatatatatacacacacagatatgtgtgtgtgtgtgtgtgtgtgtgtgtatatatatatattcatagagagagagaaagagagaaagtgttcaggtagaaaatctgtctccaaacatatcaaaattattacctcctactcttccaatgtcaaacacaat

SEQ ID NO: 22625 - DNA, 278 bp, Homo sapiens
  D17S1808
  Located on chromosome 17
  Distance between a terminus base of telomere on chromosomal short arm and 5'-terminus of this base sequence : 16638291
  Distance between 3'-terminus of neighbour sequence of sequence listing upward to telomere on chrosomal short arm and 5'-terminus of this base sequence : -276
gcataaaccctcagcacctaaaacaatgtctatttcactatatataaaaggccctcagtaaaatatatatgtatgtgtatatgtgtgtgtgcatatatgtatatatgtatgtgtgtacatatatatacacacacagatatgtgtgtgtgtgtgtgtgtgtgtgtgtatatatatatattcatagagagagagaaagagagaaagtgttcaggtagaaaatctgtctccaaacatatcaaaattattacctcctactcttccaatgtcaaacacaatga

SEQ ID NO: 22626 - DNA, 305 bp, Homo sapiens
  AC005303.1_16116
  Located on chromosome 17
  Distance between a terminus base of telomere on chromosomal short arm and 5'-terminus of this base sequence : 16702105
  Distance between 3'-terminus of neighbour sequence of sequence listing upward to telomere on chrosomal short arm and 5'-terminus of this base sequence : 63536
gttaactgaaatgaaggcaataattgccaaagtttaccaattttgaaggtaattgaaagaaatttattcaaagagtcacatttaaaaatacattctttagaaaataccagtgacaagatattaaagagatggcaaagaaatttattttttaaatatttatttatttatttatttattttgagacagaggctcactctgatgccatcagagtgcagtggtgtgatctcggctcactgcaatctctgcctcctgggttcaagcaattctcgtgcctcggcctcctaagtagcaaggaatacagatgt

SEQ ID NO: 22627 - DNA, 338 bp, Homo sapiens
  AC005303.1_36184
  Located on chromosome 17
  Distance between a terminus base of telomere on chromosomal short arm and 5'-terminus of this base sequence : 16722071
  Distance between 3'-terminus of neighbour sequence of sequence listing upward to telomere on chrosomal short arm and 5'-terminus of this base sequence : 19661
caacctcatgaaacagtatgacctcaaatccatgatttctgccttctcttgagttttcagcaatctgtgacaatttgtccgtttttctttcatcagatctacctcttggccaggcacggtggctcacacctgtaaccccagctactcgggaggctgaggcaggagaattgcttgagccctggaggcggaggttgcggtgagcccagatcgcgcgattgcactccaacctgggcaacaagagcgaaactccatctcaaacaaaacaaaacaaaacaaaacaaaacaaaacaaaaatctaccacttatttttcagggtgactatttcaaacttctaccac

SEQ ID NO: 22628 - DNA, 253 bp, Homo sapiens
  AC005303.1_65743
  Located on chromosome 17
  Distance between a terminus base of telomere on chromosomal short arm and 5'-terminus of this base sequence : 16751772
  Distance between 3'-terminus of neighbour sequence of sequence listing upward to telomere on chrosomal short arm and 5'-terminus of this base sequence : 29363
agtttacctccaatgaaactattcttatgaaatgacttgtaaaacaagaggataaaccaagatagagaaagatgtggaatcttcaatcaatccaatgcagaaaaggaggaaagagaaagaaagaaagaaagaaagaaagaaagaaagaaagaaagaaagaaagaaagaaagaaagaaagaaaaagaaaagaaaagaaaggagagagaaaggaaggaagggaaaaagagggtaaactctggaattacctagctc

SEQ ID NO: 22629 - DNA, 261 bp, Homo sapiens
  AC005277.1_73892
  Located on chromosome 17
  Distance between a terminus base of telomere on chromosomal short arm and 5'-terminus of this base sequence : 16847941
  Distance between 3'-terminus of neighbour sequence of sequence listing upward to telomere on chrosomal short arm and 5'-terminus of this base sequence : 95916
aacaagagtgaaactccatctcaaaaaagaaagaaagaaagagagagagagagagagagagagagagagagagacagaaagaaagaaagaaagaaagaaagaaagaaagaaagaaagaaagaaagaaagaaagaaagaaagagagaaagaaagaaattagcacctgaataaggcacttaccatgaatggaacttgcaggattgtaagttgcctggggtgcatcagtgagtgaatgtgaaggtctaggacattgctgtacgt

SEQ ID NO: 22630 - DNA, 325 bp, Homo sapiens
  AC005277.1_104639
  Located on chromosome 17
  Distance between a terminus base of telomere on chromosomal short arm and 5'-terminus of this base sequence : 16878717
  Distance between 3'-terminus of neighbour sequence of sequence listing upward to telomere on chrosomal short arm and 5'-terminus of this base sequence : 30515
tagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttacttttgacaacgatttgtac

SEQ ID NO: 22631 - DNA, 337 bp, Homo sapiens
  AC005274.1_76534
  Located on chromosome 17
  Distance between a terminus base of telomere on chromosomal short arm and 5'-terminus of this base sequence : 16967261
  Distance between 3'-terminus of neighbour sequence of sequence listing upward to telomere on chrosomal short arm and 5'-terminus of this base sequence : 88219
ctagaatgcagatagaaccttgagaattaagggaaggaaagacagactgtcccagagtttcgatatagtcaatctgacatttctgagatgactattctctctaaaactatcttgggcacaagcaacacagtttgtaggatgacccagacaataagcctcattctaatatccactccattcctccaaacacacacacacacacacacacacacacacacacacacacacacactctctctctctctcctctctctctctctctctctctctctctctctctctctctctcatatattccctatcttggaaaattcttgtctactgtcctctaattcca

SEQ ID NO: 22632 - DNA, 198 bp, Homo sapiens
  AC005274.1_94368
  Located on chromosome 17
  Distance between a terminus base of telomere on chromosomal short arm and 5'-terminus of this base sequence : 16985198
  Distance between 3'-terminus of neighbour sequence of sequence listing upward to telomere on chrosomal short arm and 5'-terminus of this base sequence : 17600
actttggcagtttgtcataaacttgaacatacacttgccatatgacccagcagagccactctagagaaaagaacatttatgttacacacacacacacacacacacacacacctactctgtgaatgtccatagagctttatttgtaatactaaaaatctggaagcaactcaaatgcccttcaacaggtgaatggataaa

SEQ ID NO: 22633 - DNA, 258 bp, Homo sapiens
  AC005274.1_121907
  Located on chromosome 17
  Distance between a terminus base of telomere on chromosomal short arm and 5'-terminus of this base sequence : 17012747
  Distance between 3'-terminus of neighbour sequence of sequence listing upward to telomere on chrosomal short arm and 5'-terminus of this base sequence : 27351
gacataatctttagcaacacctagtgatatctgctaactaaatctgcaagtcccctttggaatggggcaggatataaataaataaataaataaataaataaataaataaataaataaataacatgggcaaccgaagcaataaagtttgtggtggttggggtatcctgttatggaaaatacggtcactagtcatttcctataaaagacatctagctccaagctattctaccataatagaataacttcaccaggacaact

SEQ ID NO: 22634 - DNA, 193 bp, Homo sapiens
  chr17.fa.O7frz.13410452
  Located on chromosome 17
  Distance between a terminus base of telomere on chromosomal short arm and 5'-terminus of this base sequence : 17194321
  Distance between 3'-terminus of neighbour sequence of sequence listing upward to telomere on chrosomal short arm and 5'-terminus of this base sequence : 181316
cttatggtcaagacatttctgtgtgtgtgtgtgtgtgtgtgtgtgtgtgtgtgtgtgtgtgtgtgtgcgtgcgcgcgcagggggagggtgctaagtctaaaattgtattctatatcaagtaagaggattaaaatatgtaatcaaattttatttagtgtccacgtcctctaaatcttcacttaaatctttgcct

SEQ ID NO: 22635 - DNA, 75 bp, Homo sapiens
  HUMUT178
  Located on chromosome 17
  Distance between a terminus base of telomere on chromosomal short arm and 5'-terminus of this base sequence : 17287069
  Distance between 3'-terminus of neighbour sequence of sequence listing upward to telomere on chrosomal short arm and 5'-terminus of this base sequence : 92555
ggaatttatcatgtaaagacgggagtaacacacacacacacacacacacaccactctgctacaaccacaagaaac

SEQ ID NO: 22636 - DNA, 172 bp, Homo sapiens
  chr17.fa.O7frz.22208318
  Located on chromosome 17
  Distance between a terminus base of telomere on chromosomal short arm and 5'-terminus of this base sequence : 17344586
  Distance between 3'-terminus of neighbour sequence of sequence listing upward to telomere on chrosomal short arm and 5'-terminus of this base sequence : 57442
gccataccttttgttcttaaacacacatgtttattggttgagagatggctttagaagtatttaagatcccttccagaatgttgatgattaaacgtattctttctttcttttctttctttcttccctttctttcttcttctcttttcttttcttttctttatttgaaacggag

SEQ ID NO: 22637 - DNA, 216 bp, Homo sapiens
  DISO7_10006607
  Located on chromosome 17
  Distance between a terminus base of telomere on chromosomal short arm and 5'-terminus of this base sequence : 17551035
  Distance between 3'-terminus of neighbour sequence of sequence listing upward to telomere on chrosomal short arm and 5'-terminus of this base sequence : 206277
gaattcaacctgagaaagctgaaggaggaggaggaggaggaggaggaggaggaggtggcagcagtagcaaggagaaggagaagaagaaggaggaggagaaggagaaggatgaggaggagggagaggagaagaagaagaagacgaagaagaagaggaggaggaggaagaggaggaggagaaaacaaagaaaaaaagtggttaggagccagggagaat

SEQ ID NO: 22638 - DNA, 212 bp, Homo sapiens
  chr17.fa.O7frz.21359505
  Located on chromosome 17
  Distance between a terminus base of telomere on chromosomal short arm and 5'-terminus of this base sequence : 17615644
  Distance between 3'-terminus of neighbour sequence of sequence listing upward to telomere on chrosomal short arm and 5'-terminus of this base sequence : 64393
ttaaggtacagtcaaagttgaaactcactgggttaaagaattccagagaccacaggaaattaattaattaattaaataattaaataaataaataaataattaaggtaattgaagaaactcaagcaataaggaaatagggggtgggagggagttgagcccaaaaggcacaggttagaaacccaaagtgcaggtcacattacagctaggaaatg

SEQ ID NO: 22639 - DNA, 334 bp, Homo sapiens
  chr17.fa.O7frz.21125940
  Located on chromosome 17
  Distance between a terminus base of telomere on chromosomal short arm and 5'-terminus of this base sequence : 17632003
  Distance between 3'-terminus of neighbour sequence of sequence listing upward to telomere on chrosomal short arm and 5'-terminus of this base sequence : 16147
gtgacacattgttatttggaagtggacttgaattaattgtaaatgtatattgcaaacttttggggaaccactaagaaaaagtttttaaaaaagaaaaagaaacacaggctaggcaaggtggcccacgcctgtaatcccagcaatttgggagctgaggtgggaggattgcttaagcctcggagttcaaaaccagcctgggcaacgtagcaagatcccatctctattaaaataataataataataataataaaataaagctattttaaatataaagacatctagattaaaggcaaagggatgcagaaagatatattatgctaacgcttatcaacag

SEQ ID NO: 22640 - DNA, 216 bp, Homo sapiens
  D17S805
  Located on chromosome 17
  Distance between a terminus base of telomere on chromosomal short arm and 5'-terminus of this base sequence : 17683114
  Distance between 3'-terminus of neighbour sequence of sequence listing upward to telomere on chrosomal short arm and 5'-terminus of this base sequence : 50777
aatgagataccgatccatgctccaacatggatgaactttggaagcacatgcaaaggaaagaaggcagtcacagaggaccatgtgtacactccatttatgggtgtgtgtgtgtgtgtgtgtgtgtgtgtgtgacggagtttcattctttcgcccaggctggggtgcaatggtgcaatctcagcccactgcaacctccgcccctcgggttcaagtgat

SEQ ID NO: 22641 - DNA, 371 bp, Homo sapiens
  chr17.fa.O7frz.21685205
  Located on chromosome 17
  Distance between a terminus base of telomere on chromosomal short arm and 5'-terminus of this base sequence : 17748126
  Distance between 3'-terminus of neighbour sequence of sequence listing upward to telomere on chrosomal short arm and 5'-terminus of this base sequence : 64796
catctgtaaagtcagattcaagtcatgagtgcactgattcaacaaatgtttactgagcacctactaagtgctgggcacagtgctaggttctgaggagtcagggtgaccaaaacagagaaagtaatggcagtaaagtgttgagacatcgaccgggcatggtggctcacacctgtaatctcagcactttgagaggccgaggtgggtggattgcttcagctcaggagttcgagaacagtctgggcaacttggtgaaaccctgtctgtacatacacacacacacacacacacacacacacacacaattagtcaggcatggtggtgcacagctgctcaggaggctgaaatgggaggatcacttgagcctaggaagt

SEQ ID NO: 22642 - DNA, 407 bp, Homo sapiens
  chr17.fa.O7frz.21236652
  Located on chromosome 17
  Distance between a terminus base of telomere on chromosomal short arm and 5'-terminus of this base sequence : 17887671
  Distance between 3'-terminus of neighbour sequence of sequence listing upward to telomere on chrosomal short arm and 5'-terminus of this base sequence : 139174
aacttctggagtagcggagattacaggcacacaccaccatgcctggctaatttttgtattttgggttagagatagggtctccctgtgttgcccattgcttgaattcctgggctaaagcaatcctcctgcctcggcctcccaagagctgggattataagcataagccaccttgcccagcctgttattgctttaatagtatagcaataataataataataataataataataacagggcaggtttctgaaatccagccctcccagtagcctgatccccttgatgtgggggacctctccaggtctccagggatgagcactagactgacatgctggggacctcaccttttctctttgtatgtacatatatgtataccattgtgtttattacaaatgtcatgcatatttact

SEQ ID NO: 22643 - DNA, 131 bp, Homo sapiens
  DISO7_10004953
  Located on chromosome 17
  Distance between a terminus base of telomere on chromosomal short arm and 5'-terminus of this base sequence : 18000676
  Distance between 3'-terminus of neighbour sequence of sequence listing upward to telomere on chrosomal short arm and 5'-terminus of this base sequence : 112598
ggaaccaagaatcaggtctcaaattaattaagaagatctctcttcgtgtgtgtgtgtgtgtgtgtgtgtgtgtgtgtggtgtgtgtgtttaatgaagtagcaaatgaaaggttcggaataccagggacaga

SEQ ID NO: 22644 - DNA, 101 bp, Homo sapiens
  DISD22_0010686
  Located on chromosome 17
  Distance between a terminus base of telomere on chromosomal short arm and 5'-terminus of this base sequence : 18097241
  Distance between 3'-terminus of neighbour sequence of sequence listing upward to telomere on chrosomal short arm and 5'-terminus of this base sequence : 96434
ccctataggcttctcagcctccccaccttgctcctccttctcctcctcctcctcctcctcctcctcctcggcctcagtgagcccgggctccactaagatca

SEQ ID NO: 22645 - DNA, 296 bp, Homo sapiens
  AC006251.3_2494
  Located on chromosome 17
  Distance between a terminus base of telomere on chromosomal short arm and 5'-terminus of this base sequence : 18724589
  Distance between 3'-terminus of neighbour sequence of sequence listing upward to telomere on chrosomal short arm and 5'-terminus of this base sequence : 627247
accatttcacttaacatcacagtgtccaagaacctctcagtgccattaagtgaggacttattagaaagaaagaaccagacttttgtctcccaggctccctgaactccatgaggaatcttgtagtatttatttatttatttatttatttatttatttatttatttattttttgtattttgtgccttatatggctttctttccccaggattataatcttagttcttctttattttctttttataatgttgtaattttggtttttaagcttagccatctggaactcatctctaggaaac

SEQ ID NO: 22646 - DNA, 199 bp, Homo sapiens
  D17S1843
  Located on chromosome 17
  Distance between a terminus base of telomere on chromosomal short arm and 5'-terminus of this base sequence : 18995536
  Distance between 3'-terminus of neighbour sequence of sequence listing upward to telomere on chrosomal short arm and 5'-terminus of this base sequence : 270651
aattcaaaggctaaaagcaaacacacacagacacacacacacacacacacacacacacacacacacacacactccctcacctgtttttgtttttgtttttgtttttgagatggagtctcactctttttgcccaggctggagtgcagtggcacaatctcagctcactgcaacctctgcctcccgggttcaggtgattctc

SEQ ID NO: 22647 - DNA, 271 bp, Homo sapiens
  AC005971.5_95066
  Located on chromosome 17
  Distance between a terminus base of telomere on chromosomal short arm and 5'-terminus of this base sequence : 19098790
  Distance between 3'-terminus of neighbour sequence of sequence listing upward to telomere on chrosomal short arm and 5'-terminus of this base sequence : 103055
tgactcttaataccagaaacagattagctgctctagaaaataactgcctagctctttgaaatgcctcacctagaatgtcctcacaaggagttttgtgtatgccatgtaacctttaagtcaaactagtcttcccaaacacatcgtcattattattattattattattattattattattattattattattattattttgagacagagtctcactcttgcccaggctggagtgcagtggcgtgatctcagctcactgcaggttactcactgc

SEQ ID NO: 22648 - DNA, 183 bp, Homo sapiens
  D17S1857
  Located on chromosome 17
  Distance between a terminus base of telomere on chromosomal short arm and 5'-terminus of this base sequence : 19332764
  Distance between 3'-terminus of neighbour sequence of sequence listing upward to telomere on chrosomal short arm and 5'-terminus of this base sequence : 233703
tgcacaggccaattccttacaataaatctctctctgtctctgtctctctctctctctacacacacacacacacacacacacacacacacacacacacacacacgcatcctgttggttcttttcctctggagaaccctaatacagttgcaaattgcagaaactcacctgaaagcagtttaggca

SEQ ID NO: 22649 - DNA, 468 bp, Homo sapiens
  chr17.fa.O7frz.20003684
  Located on chromosome 17
  Distance between a terminus base of telomere on chromosomal short arm and 5'-terminus of this base sequence : 19432821
  Distance between 3'-terminus of neighbour sequence of sequence listing upward to telomere on chrosomal short arm and 5'-terminus of this base sequence : 99874
caagtgaatatggagcattaaccaaaaaatagaggctgggccataaagtaagtctcaacaaacttaaggattaaaataatatagtatgaggccgagcacggcagctcatcacctgtaatcccagcacattgggaggccgaggcaggtggatcacttgaggtcaggagttcaagaccagcctgaccaacatggtgaaaccccatctctactaaaaatacaaaaaaattagctggttgtggtggcacacacccataatcccagctatccaggaggctgagacacaagaatcacttgaacccaggaagcagaggttgcagtgagccaagattgtgccactgcactccaaccttggcaacagagtgaggctctgtctcaaaataataataaaataataataataataataataataataataataataataatatagtgtgttctttgatcacattggaattaaactaggta

SEQ ID NO: 22650 - DNA, 247 bp, Homo sapiens
  DISO7_10004207
  Located on chromosome 17
  Distance between a terminus base of telomere on chromosomal short arm and 5'-terminus of this base sequence : 22740888
  Distance between 3'-terminus of neighbour sequence of sequence listing upward to telomere on chrosomal short arm and 5'-terminus of this base sequence : 3307599
atagtatttcctgctggcgtgattgtgtgtgtgtgtgtgtgtgtgtgtgtgtgtgtgtgtgtgaatattttggattagctttcaaaatattttacatttgatgaaacccaaaactcattttgcctggagtaatttttattcattgttaaatctctgtaaaattagaaatataaatatgtgtctggtttatttactcttcacaaaatatggtgtctagacctgtttgtttatgatgcctcttaggctc

SEQ ID NO: 22651 - DNA, 152 bp, Homo sapiens
  HUMUT57
  Located on chromosome 17
  Distance between a terminus base of telomere on chromosomal short arm and 5'-terminus of this base sequence : 22924610
  Distance between 3'-terminus of neighbour sequence of sequence listing upward to telomere on chrosomal short arm and 5'-terminus of this base sequence : 183475
ctctttgtgcttggcagggtgtgtgtgtgtgcagggtgtgtgtgtgtgtgtgtgtgtgtgtgtgtgtgtgtgtgtgtgtgtgtgtgtgtctcagagtcaatgcacatgcctgccaggggacctgtgtgtgttggcatcctgcattaaatgta

SEQ ID NO: 22652 - DNA, 349 bp, Homo sapiens
  chr17.fa.O7frz.18921611
  Located on chromosome 17
  Distance between a terminus base of telomere on chromosomal short arm and 5'-terminus of this base sequence : 22979283
  Distance between 3'-terminus of neighbour sequence of sequence listing upward to telomere on chrosomal short arm and 5'-terminus of this base sequence : 54521
gctcgaaatcctagactctaacgatccttctacctcagcctccagagtaactgggactacaggtgcatgccaccatgcccagcttattattattattattattattattattattatcattatttagagagacagggtttcaccatgttgcccaggagggttttgaacccctgggctccagcgatccacttgccttggcttcccaaagtgctgggattataggcatgaatcactgtgcccagtcctgcccccacttctgacaccagttgtgagtccggaggtttccaaaaccaccttcagtttcaaaaattcactagaatgactcacaggattcaggaaagtactgtct

SEQ ID NO: 22653 - DNA, 248 bp, Homo sapiens
  chr17.fa.O7frz.19143498
  Located on chromosome 17
  Distance between a terminus base of telomere on chromosomal short arm and 5'-terminus of this base sequence : 23128508
  Distance between 3'-terminus of neighbour sequence of sequence listing upward to telomere on chrosomal short arm and 5'-terminus of this base sequence : 148876
aagtcactccgaattgatctacagatttagtgcacttccaaccaaaccaaggaagttttgtgtgtgtgtgtgtgtgtgtgtgtgtgtgtgtgtgtgtgtgtgtagatatagacaagctcattctaaaatttatatggaaagtcaatgaaactagaatagttaaaacaattttgaaaaagaagttgtgggactcacaatacctaatattaagacttactatgaagctaaagtaatcaagacagtttgct

SEQ ID NO: 22654 - DNA, 290 bp, Homo sapiens
  chr17.fa.O7frz.19253949
  Located on chromosome 17
  Distance between a terminus base of telomere on chromosomal short arm and 5'-terminus of this base sequence : 23246227
  Distance between 3'-terminus of neighbour sequence of sequence listing upward to telomere on chrosomal short arm and 5'-terminus of this base sequence : 117471
ctattctagttggaggcacagccatgaacaaaacaggcagaaattgctgccagttctaatagggagagacaaacaaaataaagtgtgcgtgtgtgtgtgtgtgtgtgtgtgtgtgtgtgcatgcgcacgcatgtgcatgcagtgagagctattccaggcttgtgatgttgagggtctacatttttggtcaaaagagcattcacagctttctctcaggggcaatggatccagctgcttgctgaggttaagtcagcagcaacttaacacggctttattcagcatgacgattc

SEQ ID NO: 22655 - DNA, 269 bp, Homo sapiens
  DISO7_00046387
  Located on chromosome 17
  Distance between a terminus base of telomere on chromosomal short arm and 5'-terminus of this base sequence : 23376732
  Distance between 3'-terminus of neighbour sequence of sequence listing upward to telomere on chrosomal short arm and 5'-terminus of this base sequence : 130215
gaagctggtctgagtccacggtgcagtgtgtatgtgtgtgtgtgtgtgtgtgtgtatgtgtgtggactcagaggtggatgtcttgtagaatgcatgccccatgaagacaggagtaaaagtttaccaccatccacatcaagctacaggacactcccagctccccagaaagttgcttagttctaggcagggatttcccttattcacagccgggagcagtgcctggcatagtgtgggcactcagcactcagcacatgctcactggatgagtg

SEQ ID NO: 22656 - DNA, 402 bp, Homo sapiens
  chr17.fa.O7frz.19536359
  Located on chromosome 17
  Distance between a terminus base of telomere on chromosomal short arm and 5'-terminus of this base sequence : 23518786
  Distance between 3'-terminus of neighbour sequence of sequence listing upward to telomere on chrosomal short arm and 5'-terminus of this base sequence : 141785
aagcactgctctaaacttcatatggattaactcactgcatctttacttcagtaccgtgaggtctgtactgttattctcctgattgtaaagatggggacactgaggcacagagaggtaaatggcctgttcagtatgtggtggagccaggagtcaacccagaacttgccctgaaggacttcgccacacaaccaacctctccaagacaaacggagaggaaaaaggaagctgccgaggaagagcccacagtatgtcctcacttggggaaaaagaaaactatgcatggattggtatatgtaatatacatacatacatacatatatatatatatatatatatatatatatatatatgcattaagtgagtaacaaaaagtctggaaggatacgttcaaactattaactg

SEQ ID NO: 22657 - DNA, 201 bp, Homo sapiens
  DISO7_00046396
  Located on chromosome 17
  Distance between a terminus base of telomere on chromosomal short arm and 5'-terminus of this base sequence : 23878310
  Distance between 3'-terminus of neighbour sequence of sequence listing upward to telomere on chrosomal short arm and 5'-terminus of this base sequence : 359122
taggacaggcctttggatgtcctttcctgcctgtccctccacccacacaggagcaggcacatccacacgcattttcctggacagacacacacacacacacacacacacacacacacacacacacacacacacactgagtacctttatcttcaagagcgtccaggagggaggacaaagagacagacaagaacagaatggagt

SEQ ID NO: 22658 - DNA, 172 bp, Homo sapiens
  D17S1871
  Located on chromosome 17
  Distance between a terminus base of telomere on chromosomal short arm and 5'-terminus of this base sequence : 24186469
  Distance between 3'-terminus of neighbour sequence of sequence listing upward to telomere on chrosomal short arm and 5'-terminus of this base sequence : 307958
cgtggcctattatgagacttcttagcctctgaaatcagataagccaattctcctaataaatgtcttctcttcacttcttctctcgctctctgtctatacacacacacacacacacacacacacacacacatcttctatcagttctgtttctctggagaaccctacctaaatc

SEQ ID NO: 22659 - DNA, 282 bp, Homo sapiens
  chr17.fa.O7frz.22892205
  Located on chromosome 17
  Distance between a terminus base of telomere on chromosomal short arm and 5'-terminus of this base sequence : 24284077
  Distance between 3'-terminus of neighbour sequence of sequence listing upward to telomere on chrosomal short arm and 5'-terminus of this base sequence : 97436
  misc_feature (1)...(282): n = A,T,G or C
ttctttcacactgaagtttgagaacctttgatttaagatttctaccattagctactacaaggagaagaggaaaataattgttgattttagccaaaaagaacaaacagtctttttaatgtgagtcacttactcctggaaaatggcttagaaatccagaagacctggcctctactcctcactcgngatttaatgggtgaacttaagagtctcgtacatgtatccttccttccttccttccttccttccttcctttcttttttgagatggagtttcactcttgtt

SEQ ID NO: 22660 - DNA, 116 bp, Homo sapiens
  D17S842
  Located on chromosome 17
  Distance between a terminus base of telomere on chromosomal short arm and 5'-terminus of this base sequence : 24396015
  Distance between 3'-terminus of neighbour sequence of sequence listing upward to telomere on chrosomal short arm and 5'-terminus of this base sequence : 111656
agctcactgtagcctatcctcagatcacacacacacacacacacacacacacacacacacacacacggaaactcactcccatgtgggcccctttctacaagtttgactctgcattt

SEQ ID NO: 22661 - DNA, 261 bp, Homo sapiens
  AC005730.1_99105
  Located on chromosome 17
  Distance between a terminus base of telomere on chromosomal short arm and 5'-terminus of this base sequence : 24487950
  Distance between 3'-terminus of neighbour sequence of sequence listing upward to telomere on chrosomal short arm and 5'-terminus of this base sequence : 91819
actataatgaatagccttcaacatacatacatacatacatacatacatacatatacacacacacacacacacacacacacacatacacacctgcacatatgaatgagcatatctgagggctaggtcttagaaagagtggcctaaatgacatgcatattttatactgatttccaaattgctttccaaagagtcttcaccagattatattatcactaaataggaggggtatttccctgcatcttcactgacattcaaattgtc

SEQ ID NO: 22662 - DNA, 388 bp, Homo sapiens
  chr17.fa.O7frz.23171244
  Located on chromosome 17
  Distance between a terminus base of telomere on chromosomal short arm and 5'-terminus of this base sequence : 24779763
  Distance between 3'-terminus of neighbour sequence of sequence listing upward to telomere on chrosomal short arm and 5'-terminus of this base sequence : 291552
ctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatc

SEQ ID NO: 22663 - DNA, 362 bp, Homo sapiens
  chr17.fa.O7frz.22461393
  Located on chromosome 17
  Distance between a terminus base of telomere on chromosomal short arm and 5'-terminus of this base sequence : 24824385
  Distance between 3'-terminus of neighbour sequence of sequence listing upward to telomere on chrosomal short arm and 5'-terminus of this base sequence : 44234
gatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcg

SEQ ID NO: 22664 - DNA, 228 bp, Homo sapiens
  chr17.fa.O7frz.22977074
  Located on chromosome 17
  Distance between a terminus base of telomere on chromosomal short arm and 5'-terminus of this base sequence : 25147294
  Distance between 3'-terminus of neighbour sequence of sequence listing upward to telomere on chrosomal short arm and 5'-terminus of this base sequence : 322547
actttattcgtttctcctgaaggatattaaccatatctgtcacagaggtcccagatatcctttgtgtgtgtgtgtgtgtgtgtgtgtatatatatatatgcacacacacacatacacacacacacacacattatataaatacacatactcctttgttctggatggccatttatttcagcatcacttatttcatcatctctcttgaactacctgataggcctaggtatg

SEQ ID NO: 22665 - DNA, 367 bp, Homo sapiens
  chr17.fa.O7frz.22690173
  Located on chromosome 17
  Distance between a terminus base of telomere on chromosomal short arm and 5'-terminus of this base sequence : 25396610
  Distance between 3'-terminus of neighbour sequence of sequence listing upward to telomere on chrosomal short arm and 5'-terminus of this base sequence : 249088
gattccagtttctctttatgaatattttctttctcctctcctctcctctcctttctctttctttctttctctttctttctttccttccttccttccttctctttctttctttctttctttcttctttccttccttctttttttttgacaaggtcttgcttgttgccaaaattggagtgcagtggcaagatctcggctcactgaagccttgacttcccaggctcaagcgatcctcccacctcagcctcccaagtggctgggaccacaggtgcgcagcaccaggcctgactaatttcttatttttcgtagagatggggtcttgctatgttgcccaggctgctctccaactcctagatccaagtgatctt

SEQ ID NO: 22666 - DNA, 133 bp, Homo sapiens
  D17S959
  Located on chromosome 17
  Distance between a terminus base of telomere on chromosomal short arm and 5'-terminus of this base sequence : 25635443
  Distance between 3'-terminus of neighbour sequence of sequence listing upward to telomere on chrosomal short arm and 5'-terminus of this base sequence : 238466
tcagattgaactctcggtattgcatatgctttgatcaggaggcataatgtgtagtttgtgtgtgtgtgtgtgtgtgtgtgtgtgtgtgtgtgtttagtgatgttagtggtcactgatcattgcctgtgtcagc

SEQ ID NO: 22667 - DNA, 101 bp, Homo sapiens
  DISD22_0010721
  Located on chromosome 17
  Distance between a terminus base of telomere on chromosomal short arm and 5'-terminus of this base sequence : 25881335
  Distance between 3'-terminus of neighbour sequence of sequence listing upward to telomere on chrosomal short arm and 5'-terminus of this base sequence : 245759
gcttgctatgtagaaatgagaccatgtgtatgtgtgtgtgtgtgtgtgtgtgtgtgtgtgtgtgtgtgtgtgtatgaaatctggactccttctatgactgc

SEQ ID NO: 22668 - DNA, 241 bp, Homo sapiens
  D17S783
  Located on chromosome 17
  Distance between a terminus base of telomere on chromosomal short arm and 5'-terminus of this base sequence : 26016598
  Distance between 3'-terminus of neighbour sequence of sequence listing upward to telomere on chrosomal short arm and 5'-terminus of this base sequence : 135162
taacagaaaacttggagccgcaagtgagtcctgggagagtttgggttaactggccccgaagccatcctgtgtgtgtgtgtgtgtatgtgtgtgtgtgtgtgtgtgtgtgtgtgtgtatgtgtgttccactatgtgtttttccctgtgtggcctctgtgtgtgtgtgtttgcctgaactggtttcagtggtgaaaatcctggtgctgacatggacagaatccatgaaagcatttcgagtcct

SEQ ID NO: 22669 - DNA, 270 bp, Homo sapiens
  DISO7_10006644
  Located on chromosome 17
  Distance between a terminus base of telomere on chromosomal short arm and 5'-terminus of this base sequence : 26142761
  Distance between 3'-terminus of neighbour sequence of sequence listing upward to telomere on chrosomal short arm and 5'-terminus of this base sequence : 125922
catcctagcctaacaaatcttgttttgtgtgtgtgtgtgtgtgtgtgtgtgtgtgtgtgtgtatcatagatctttatatagtgtatatataggtagatctagatatatatctttataatatatataatttgtttgtatgcatatatatgtgtgtgtatatatatatacacacacatacatatatatgataatcttacctcctaaaggaaatttgaagagatatgtataactatatatagatacaactggatttattagtctaggatgtga

SEQ ID NO: 22670 - DNA, 190 bp, Homo sapiens
  HUMUT265
  Located on chromosome 17
  Distance between a terminus base of telomere on chromosomal short arm and 5'-terminus of this base sequence : 26475967
  Distance between 3'-terminus of neighbour sequence of sequence listing upward to telomere on chrosomal short arm and 5'-terminus of this base sequence : 332936
gccagggagtgtactacctcccatttctttctttctttcttttttgaaagtcatcttagtatttcttttcttttccttccttccttcctttctttctttctctttcttcctttctttcttttctttctttcttttgagatggagtctcactctgctgcccaagtgggagcaaagtggcacaatctcagct

SEQ ID NO: 22671 - DNA, 287 bp, Homo sapiens
  DISO7_10006659
  Located on chromosome 17
  Distance between a terminus base of telomere on chromosomal short arm and 5'-terminus of this base sequence : 26792378
  Distance between 3'-terminus of neighbour sequence of sequence listing upward to telomere on chrosomal short arm and 5'-terminus of this base sequence : 316221
cgaatatgattagtgagatgagatgataatagtacctaacattgtgtgtgtgtgtgtgtgtgtgtgtgtataaatttacacagtattttttatgtattatcttttttggcttcataataatcttttggttaacatagaaattatcagtctcattttacaaaactaagtattgagcacacttgtctaagtgaagcggctatgaaatgctggagtatagatttaaatccaagtcatcagtcccccaagtccagtgtgttcttggttatatcattctgctttcttcggtg

SEQ ID NO: 22672 - DNA, 362 bp, Homo sapiens
  AL354047.4_85930
  Located on chromosome 17
  Distance between a terminus base of telomere on chromosomal short arm and 5'-terminus of this base sequence : 26866129
  Distance between 3'-terminus of neighbour sequence of sequence listing upward to telomere on chrosomal short arm and 5'-terminus of this base sequence : 73464
taactcactgcagcctttaactcctgggcccaagcgatcctcctgcctcagcctcccaagtagctaggactgcaggcatgtgccatcttgctcagctaatttttttccttattattattattattattattattattattattattattttatagagtctcactatgttgcccaggctggtctcgaactactggcctcaagtaatcctcctgcctcagcctcccaaagtgctggaattacaggtgtgaactaccttgtctggcgctgggggcttcacttttgcacctttggcctcccactgaccccccacctgcccaccaagaaaaaagcttcagaaagagtcaaacaagaaaactcctttc

SEQ ID NO: 22673 - DNA, 387 bp, Homo sapiens
  DISO7_00046565
  Located on chromosome 17
  Distance between a terminus base of telomere on chromosomal short arm and 5'-terminus of this base sequence : 27063968
  Distance between 3'-terminus of neighbour sequence of sequence listing upward to telomere on chrosomal short arm and 5'-terminus of this base sequence : 197477
cagaagttctggaaacagtgagacttgattattttccagccattgctcctccttggcacacctgccctggacagccaaccccagaatcaccccattcagaacaggacttctctaaggaagccagaagggaaacagctgaggctgggggcagtgggggcagagggaaggggctggtgcaagtccaggtgatggtagactttggagcacctgggttttagaattggcatagcagccaattgctagatgtaagtagcattgcctccctttttaaacaggtcataaagatgtctatgtttaattgtgtgtgtgtgtgtgtgtgtgtgtgtgtgtgtgttttgagccagaacaagagtgagttttcagtatttccttcctagaattgaggca

SEQ ID NO: 22674 - DNA, 171 bp, Homo sapiens
  D17S1837
  Located on chromosome 17
  Distance between a terminus base of telomere on chromosomal short arm and 5'-terminus of this base sequence : 27075450
  Distance between 3'-terminus of neighbour sequence of sequence listing upward to telomere on chrosomal short arm and 5'-terminus of this base sequence : 11095
agctaatgccttcaaacatcatcacacacacagatacacacacacccaggatgcccgtgctaatgcctaaatctcacacaaacacacacacacacacacacacacacacacacacacacacacaggttctggccagatgctgcctgcactggcccttgggccttctgcagt

SEQ ID NO: 22675 - DNA, 375 bp, Homo sapiens
  DISO7_00046569
  Located on chromosome 17
  Distance between a terminus base of telomere on chromosomal short arm and 5'-terminus of this base sequence : 27194005
  Distance between 3'-terminus of neighbour sequence of sequence listing upward to telomere on chrosomal short arm and 5'-terminus of this base sequence : 118384
attagtggctgcagggtccacagacacccaaaactttgaggaacggaaatctttccccctctgattgagagctgtgggccaggggcagtggatcatgcctgtaatcccagtactgtgggaggccaaggtggatcacttgtggccaggagcaggagaccagcctggacaacagactgagactgtgtgtgtgtgtgtgtgtgtgtgtgtgtgtgtgtgtatgtatgtatatacattcatacacacacatacgtgtttgcgtgtttatttttcaaaagagttgtagtcccaagaaggagaacccccatagctttcttttctctgtgtcttcctgctgcctggccctgaacacggacacaatcataggaagtctgcagt

SEQ ID NO: 22676 - DNA, 223 bp, Homo sapiens
  DISD22_0010730
  Located on chromosome 17
  Distance between a terminus base of telomere on chromosomal short arm and 5'-terminus of this base sequence : 27297250
  Distance between 3'-terminus of neighbour sequence of sequence listing upward to telomere on chrosomal short arm and 5'-terminus of this base sequence : 102870
gactgagaggcttcctgcatgtgaggaaaaactgagggctcagcagaaaataaaagctgggcatatttgaaaactacatgctctccctacacatacacacacacacacacacacacacacacacacacacacacacacacacaccacacacacacacacacacacacacacacacacacggtataagccttattagctcaaaatgcctgagcacaacctttaa

SEQ ID NO: 22677 - DNA, 137 bp, Homo sapiens
  DISD22_0010738
  Located on chromosome 17
  Distance between a terminus base of telomere on chromosomal short arm and 5'-terminus of this base sequence : 27445707
  Distance between 3'-terminus of neighbour sequence of sequence listing upward to telomere on chrosomal short arm and 5'-terminus of this base sequence : 148234
ggccattagagaatagaattctgttttgttgttgttgttgttgttgttgttttgagactgagtctcgcttttgtcgcacaggctggaatgcaatggcacaatatgttgtgggccaaggctaatgtggccacagcttt

SEQ ID NO: 22678 - DNA, 194 bp, Homo sapiens
  DISD22_0010744
  Located on chromosome 17
  Distance between a terminus base of telomere on chromosomal short arm and 5'-terminus of this base sequence : 27522091
  Distance between 3'-terminus of neighbour sequence of sequence listing upward to telomere on chrosomal short arm and 5'-terminus of this base sequence : 76247
ttaggcggctatgattacacacagtaatccagaagtttctttcatgtctcaacttttaaagtattatttttctaaaagttgtttcctatttatagacgttagttcacacacacacacacacacacacacacacacacacacacacacacagatacaccactacctataacttttgttgctaacaagtctggctg

SEQ ID NO: 22679 - DNA, 216 bp, Homo sapiens
  DISO7_00046580
  Located on chromosome 17
  Distance between a terminus base of telomere on chromosomal short arm and 5'-terminus of this base sequence : 27676343
  Distance between 3'-terminus of neighbour sequence of sequence listing upward to telomere on chrosomal short arm and 5'-terminus of this base sequence : 154058
cactggtcagtcggtcagtctctgcagctgcagcctgagatcagccaagcccctcctgaggctcctacctggctcactttgccctttctccacaggggtctgatctctctgctctgcttttccaaactatttctctttctctctctcgctctctggttctctctctctctctctctctctctctctctctctctctcatcagatggctgactggag

SEQ ID NO: 22680 - DNA, 101 bp, Homo sapiens
  DISD22_0010757
  Located on chromosome 17
  Distance between a terminus base of telomere on chromosomal short arm and 5'-terminus of this base sequence : 28033083
  Distance between 3'-terminus of neighbour sequence of sequence listing upward to telomere on chrosomal short arm and 5'-terminus of this base sequence : 356524
gctctggtgaagtggtccaactaaggctgaaccgtgtgtgtgtgtgtgtgtgtgtgtgtgtgtgtgtgtgtgtgtgtggtgaagaccacctcttgtgatgt

SEQ ID NO: 22681 - DNA, 260 bp, Homo sapiens
  DISO7_00046609
  Located on chromosome 17
  Distance between a terminus base of telomere on chromosomal short arm and 5'-terminus of this base sequence : 28180964
  Distance between 3'-terminus of neighbour sequence of sequence listing upward to telomere on chrosomal short arm and 5'-terminus of this base sequence : 147780
ctagaaggcaaaggctgggagaggcagttctttgtcctctttttcccttaactaggtgggtcctcgctgtccagatctcagcctcctacccaagtcatgaggcaggatttggccatggatggggaaaggagacacacacacacacacacacacacacacacacacacacacatatccaaggcaagagctgaaacaggcagaaaaatcaaggaaaaggggagaggcaaagagagaaagcgttcagccatcagaaagacagt

SEQ ID NO: 22682 - DNA, 105 bp, Homo sapiens
  DISO7_10000019
  Located on chromosome 17
  Distance between a terminus base of telomere on chromosomal short arm and 5'-terminus of this base sequence : 28181056
  Distance between 3'-terminus of neighbour sequence of sequence listing upward to telomere on chrosomal short arm and 5'-terminus of this base sequence : -168
agtcatgaggcaggatttggccatggatggggaaaggagacacacacacacacacacacacacacacacacacacacacatatccaaggcaagagctgaaacagg

SEQ ID NO: 22683 - DNA, 123 bp, Homo sapiens
  DISO7_10000176
  Located on chromosome 17
  Distance between a terminus base of telomere on chromosomal short arm and 5'-terminus of this base sequence : 28307440
  Distance between 3'-terminus of neighbour sequence of sequence listing upward to telomere on chrosomal short arm and 5'-terminus of this base sequence : 126279
aatggcagaaattggaggggtctgggagaaaaggacaacccactctaaattctgcagagtgtgtgtgtgtgtgtgtgtgcgcgcgcgtgcgtgtgtatgtggcgcctaggccattcctaagct

SEQ ID NO: 22684 - DNA, 269 bp, Homo sapiens
  D17S841
  Located on chromosome 17
  Distance between a terminus base of telomere on chromosomal short arm and 5'-terminus of this base sequence : 28368852
  Distance between 3'-terminus of neighbour sequence of sequence listing upward to telomere on chrosomal short arm and 5'-terminus of this base sequence : 61289
tggactttcttacatggcagcccaggcttcgggagcaagtatttcagcgatcaaagtagatgctctatggcctgttacaactgagcctcagaaggtacttgccatcacttctgcctatgctaatagacctactgtttgggtcaaggcagtcacaagtccaccaacatttaaggagaagggacagagaacacttagaaactttacacacacacacacacacacacacacacacacacacacacacacgctgtgacatagactactaacct

SEQ ID NO: 22685 - DNA, 429 bp, Homo sapiens
  chr17.fa.O7frz.30315521
  Located on chromosome 17
  Distance between a terminus base of telomere on chromosomal short arm and 5'-terminus of this base sequence : 28480549
  Distance between 3'-terminus of neighbour sequence of sequence listing upward to telomere on chrosomal short arm and 5'-terminus of this base sequence : 111428
gatcctatcagcaatacatgaccgggcgcggtggcttacacctgtaatcccagcactttgggaaaccgaggcgagcagatcacatgaggtcaggagttccagaccagcctagccaacatggtaaaacctcgtctctactaaaaatacaaaaattagctgggcgtagtggcatgcgcatgtaatcccagctacttgggaggctgaggcaggagaattgcttgaacccgggaggcagaggttgcagtgagccaaggtagtgccactgcactccagcctcggcgatagagcaagactctgtcaaaagaaagaaagaaagagagagagagagagagagagagggagggagggaggcaaggaaggaaggaagggagggagggagggagggaaggaatctcgtcccacaccctagacctactgaatcagactctg

SEQ ID NO: 22686 - DNA, 230 bp, Homo sapiens
  DISD22_0010767
  Located on chromosome 17
  Distance between a terminus base of telomere on chromosomal short arm and 5'-terminus of this base sequence : 28900702
  Distance between 3'-terminus of neighbour sequence of sequence listing upward to telomere on chrosomal short arm and 5'-terminus of this base sequence : 419724
attctccctagaataaggtcaatagtttaaaatgattttcatattagtgactgatattattattatttattttaatttttttgagatggagtctcgctgtcaaccacgctggagtgtagtgactgatattataatgagagtatgtatatatacacacacacacacacacacacacacacacacacatatatgtatatacgtatacatatacacagagtgagactccgtct

SEQ ID NO: 22687 - DNA, 259 bp, Homo sapiens
  G07969
  Located on chromosome 17
  Distance between a terminus base of telomere on chromosomal short arm and 5'-terminus of this base sequence : 28977923
  Distance between 3'-terminus of neighbour sequence of sequence listing upward to telomere on chrosomal short arm and 5'-terminus of this base sequence : 76991
agtcatgggacttctcggcttccataattgcatgagccaattccccatctgtccatccatccatccatccatccatccatccatccatccatcatccacccatccatccatcatccacccatccatccatcatccacccatccatcctattctgtctctctggaaaactctgactaatatatcctctactactctgctggacgtccagatttccctttgtatataaaaagaaaatcaacactgcacacttggaatccta

SEQ ID NO: 22688 - DNA, 433 bp, Homo sapiens
  AC023266.2_35478
  Located on chromosome 17
  Distance between a terminus base of telomere on chromosomal short arm and 5'-terminus of this base sequence : 29203271
  Distance between 3'-terminus of neighbour sequence of sequence listing upward to telomere on chrosomal short arm and 5'-terminus of this base sequence : 225089
cgtgcctgtatttctagctactcgggaggctgaggcaggagaattgcttaaacctgggaggcggaggttgcagtgagccgagattacaccgctgcactccagcctggctacagagtgaaactctgtctcaaaaataaataaataaataaataaaaaattagctgggcatggtggcgtgcacctgtaatttcatctactcgggaggctgaggcaggagaattgcttgaacccaggaggcggaggttgcagtgagtagataccgcaccactgcactccagcctgggtgacagagggagactccgtctcaaaataaataaataaataaaatctgtagactacatcttaggttggttgtgtgtctttcccaccattaataagatctgatgttttccctttcttttttttaatacactttgccttgactataagcttt

SEQ ID NO: 22689 - DNA, 436 bp, Homo sapiens
  AC024065.5_57463
  Located on chromosome 17
  Distance between a terminus base of telomere on chromosomal short arm and 5'-terminus of this base sequence : 29262903
  Distance between 3'-terminus of neighbour sequence of sequence listing upward to telomere on chrosomal short arm and 5'-terminus of this base sequence : 59199
aattatcttatgcatagcacaaagagattgatggatgctgccatctgtgatcaattaaaattaagtctaaagatgatgggtgacatttatttatttatttatttatttttgagatagggtctccctctgttgcacaggctgaagtgcagtggcatgaacacagctcactgcagccttaacctcccgggctcaagcaatcctcctgcttcagcctcctgaagagctgggaccataggcatgcaccaccacactcagctaatttttaaattttttgtagagatgggatctcaccatgttgcccaggctggactcaaactcttaggctcaagtgatcctcctgcctcagcctcccaaagggctaagattacaggtttgagcaactgcacctggcccagtgggtgatatttaaaaccataattggtgtaacatttcctgt

SEQ ID NO: 22690 - DNA, 174 bp, Homo sapiens
  Z67368
  Located on chromosome 17
  Distance between a terminus base of telomere on chromosomal short arm and 5'-terminus of this base sequence : 29375827
  Distance between 3'-terminus of neighbour sequence of sequence listing upward to telomere on chrosomal short arm and 5'-terminus of this base sequence : 112488
cattatggattactgagcaattaactatacacacacacacacacacacacacacacacacacacacacttagcaacaatgatatttaggagattgttataaacagaatttaaacagtggattgaggctagaaaactgaaaacaatttctttaagtcatcaaatcacattgttgg

SEQ ID NO: 22691 - DNA, 411 bp, Homo sapiens
  chr17.fa.O7frz.31286915
  Located on chromosome 17
  Distance between a terminus base of telomere on chromosomal short arm and 5'-terminus of this base sequence : 29446743
  Distance between 3'-terminus of neighbour sequence of sequence listing upward to telomere on chrosomal short arm and 5'-terminus of this base sequence : 70742
tgtaattccagcactttaagaggccaaggtgggaggattgcttgtgcccaggagttcgagaccagcctgggcaaaatagtgagacactgtctctacaaaaaaaaaaaaagagaaaaatttacattatgcaggatattcctttgtttacaactatttaaacttaagatgaaaacttgtgaataccaacttaaaaatttgtgaagcgtcgcatattttttcagttattttagtattaacaaacaaattgaagatcattggtttatataaccccctgagagactaatagtagaatagaacagaataatagaatagaatagaacagaatagaataatagaatagaataataatagaataatagaaactcgcttatttatgattgttaataagtaggataaattgcagatcattta

SEQ ID NO: 22692 - DNA, 381 bp, Homo sapiens
  chr17.fa.O7frz.31382887
  Located on chromosome 17
  Distance between a terminus base of telomere on chromosomal short arm and 5'-terminus of this base sequence : 29542873
  Distance between 3'-terminus of neighbour sequence of sequence listing upward to telomere on chrosomal short arm and 5'-terminus of this base sequence : 95719
tatggctagaactatgtttaagcttttgcttcttcataaatattgttttttaatgttaatgtaattttttacttgctccaaaagcacatatttttgcctggaaaaagagtaaatcagtttttgtaaatgaatgccatacttaaacacacacacacacacacacacaactttgtaatgaattgtttttaccagctctccttaatactctttttatataaaaataaatgctgttaggttttagcaatttatgttatggatgacaaatttcttttgctatatggtggataaagtaactttcgtttttggcttctctttccctgagtctgtcagtcagaagaaaatactgactttgaattagtgtcaagcttgtaactacttgtt

SEQ ID NO: 22693 - DNA, 257 bp, Homo sapiens
  D17S1863
  Located on chromosome 17
  Distance between a terminus base of telomere on chromosomal short arm and 5'-terminus of this base sequence : 29652263
  Distance between 3'-terminus of neighbour sequence of sequence listing upward to telomere on chrosomal short arm and 5'-terminus of this base sequence : 109009
gtacctttgatttcaatatgctgtataaattttagttacttggtaataaccttattgcggaattgcctttttactgaaaggtataaacatttcttgcatggtgacacacacacacacacacacacacacacacacacactcacacactcacacactcatacactgtctttctgaaatatttgaaccgtgagagctctgcccacaattgatattagacctttccacatattattcttaaaaccacagtcagtgaattg

SEQ ID NO: 22694 - DNA, 197 bp, Homo sapiens
  DISD22_0010771
  Located on chromosome 17
  Distance between a terminus base of telomere on chromosomal short arm and 5'-terminus of this base sequence : 29735345
  Distance between 3'-terminus of neighbour sequence of sequence listing upward to telomere on chrosomal short arm and 5'-terminus of this base sequence : 82825
aatcttctctgaggcaacgggacacacacacacacacacacacacacacacaggcacaatcacacacagacacacacaaaatgaaccccccctcctcaatttctttaccaactatttttcccccaggcagaaaatgaaccattattaaaacaacacggcaaccggccgggaaaacccattcacagcgatttatatcg

SEQ ID NO: 22695 - DNA, 402 bp, Homo sapiens
  AC004666.8_39548
  Located on chromosome 17
  Distance between a terminus base of telomere on chromosomal short arm and 5'-terminus of this base sequence : 29938507
  Distance between 3'-terminus of neighbour sequence of sequence listing upward to telomere on chrosomal short arm and 5'-terminus of this base sequence : 202965
ggccaatctggttcttatttatttatttatttatttatttatttatttatttatttatttttgagatagagtcttgctctgttgtccaggctgaagtgcaatggcgtgatctgaggtcactgcaacctctgcctcccagattctaaccattctcctgcctcagcctcctgagtagctgggattacagacacgtgccgccatgcctggctaatttttgtatttttagtagagatggggtttgaccatgttggtcaggctgttcttgaactcctgacctcgtgatccacctgcctcggcctcccaaagttctgggattacaagcatgagccactgtgcccagccaatctcattcttttttatggctgtgtagtattctatgatgtttatgtaccacatttccat

SEQ ID NO: 22696 - DNA, 335 bp, Homo sapiens
  AC027793.3_68534
  Located on chromosome 17
  Distance between a terminus base of telomere on chromosomal short arm and 5'-terminus of this base sequence : 30071989
  Distance between 3'-terminus of neighbour sequence of sequence listing upward to telomere on chrosomal short arm and 5'-terminus of this base sequence : 133080
gcttccgtattaatgttaggtcagatttataatgtggtagactctgaatagaactatgtttatactatgttgtatatacacttttattattattattattattattattattattatttgagaccgagtctcattctgttacccaggctggagtgcagtggcatgatcttggctcactgcaacctctacttcctgagttctagtgattcttgtgcctcagcctcccaagtagctgggattacaggcatgtgccaccacacctggctaatttttgtatttttagtagaaatgggatttcactatgttgcccaggctggtttcgaactcctggactc

SEQ ID NO: 22697 - DNA, 467 bp, Homo sapiens
  chr17.fa.O7frz.32169719
  Located on chromosome 17
  Distance between a terminus base of telomere on chromosomal short arm and 5'-terminus of this base sequence : 30141812
  Distance between 3'-terminus of neighbour sequence of sequence listing upward to telomere on chrosomal short arm and 5'-terminus of this base sequence : 69488
tcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacataggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttt

SEQ ID NO: 22698 - DNA, 396 bp, Homo sapiens
  AC004222.1_17733
  Located on chromosome 17
  Distance between a terminus base of telomere on chromosomal short arm and 5'-terminus of this base sequence : 30238615
  Distance between 3'-terminus of neighbour sequence of sequence listing upward to telomere on chrosomal short arm and 5'-terminus of this base sequence : 96336
cttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaac

SEQ ID NO: 22699 - DNA, 278 bp, Homo sapiens
  chr17.fa.O7frz.32358496
  Located on chromosome 17
  Distance between a terminus base of telomere on chromosomal short arm and 5'-terminus of this base sequence : 30330694
  Distance between 3'-terminus of neighbour sequence of sequence listing upward to telomere on chrosomal short arm and 5'-terminus of this base sequence : 91683
atgtctagtgcatgtctcagagccagagaaaagctagttatttgcacagtctccttcaaggcataattatatatatatatatatatatgtatataattatataggattatatgtaggattatatttataatataatcctacatataatcctatataattatatacatatatatatatatatatatatgtatataattatgccttgaaggagactgtgcaaataactagattttatatatatattatatagaactgtagaaatctggtgacatttctag

SEQ ID NO: 22700 - DNA, 458 bp, Homo sapiens
  chr17.fa.O7frz.32468209
  Located on chromosome 17
  Distance between a terminus base of telomere on chromosomal short arm and 5'-terminus of this base sequence : 30440491
  Distance between 3'-terminus of neighbour sequence of sequence listing upward to telomere on chrosomal short arm and 5'-terminus of this base sequence : 109519
tatgacttgcaggaaacttaacattggcacaatttgttacctattgtaaaatctacattcaaattttcccaattatatatatatatatatatattttttttttttttttttttttgacacggagtcttgctctgtcacccaggctggagtgcaatggcgtgatctccgctcaccgcaacctccgcctcctgggttcaaacgattctcctgcctcagcctcccgagtagctgggattacaggtgcatgccaccactcccggctaattttttttttgtatttttagtagagactgggttttaccatgttggccaggctggtctcgaactcctgacctcgtgatccacccacctcggcctcccaaagtgctgggattacaggtgtgagccaccgcacccagccatcccaataatatttttatagcttttatttttatctcaaatctaatacaggatcacac

SEQ ID NO: 22701 - DNA, 441 bp, Homo sapiens
  AC019148.4_36973
  Located on chromosome 17
  Distance between a terminus base of telomere on chromosomal short arm and 5'-terminus of this base sequence : 30579793
  Distance between 3'-terminus of neighbour sequence of sequence listing upward to telomere on chrosomal short arm and 5'-terminus of this base sequence : 138844
tgcatcttatccagtgttaaagaaaaagctggaaatgtgggtgggtggccctgggaccctgagaggtaggtgcctaccatgtgccaatgatcatgtgccataattctcacctttcacctgtctagaccaatgttattttccccctgtggattccagggcttgaaagataatatctactaaaccccatacaggaagccagaatccacttccccaaatgtattcttcaaggcatatgcacaactcactgtctcagctgactgctccatcactacacaagccaagggaaggacctggagttgaaatcattccagccgtaggcaaagaggacgatgatgatgatgatgatgatgatgatgatgatgatgatgagcttggcaccaacaaattatggactcctcccagaggtctggaggatgtcaggttggcaatctcagtttagtc

SEQ ID NO: 22702 - DNA, 441 bp, Homo sapiens; identical to SEQ ID NO: 22701
  AC003101.1_175137
  Located on chromosome 17
  Distance between a terminus base of telomere on chromosomal short arm and 5'-terminus of this base sequence : 30579793
  Distance between 3'-terminus of neighbour sequence of sequence listing upward to telomere on chrosomal short arm and 5'-terminus of this base sequence : -441

SEQ ID NO: 22703 - DNA, 278 bp, Homo sapiens
  AC003101.1_182473
  Located on chromosome 17
  Distance between a terminus base of telomere on chromosomal short arm and 5'-terminus of this base sequence : 30587306
  Distance between 3'-terminus of neighbour sequence of sequence listing upward to telomere on chrosomal short arm and 5'-terminus of this base sequence : 7072
taatgtcattctgaagtccttaatgaattaattgcttgaagcttccatggctgctaacatcaggaacaaataattggacattatgtgcctcctaatagaagaatttgatgccagctaaggacatggtcttatgtgtgtgtgtgtgtgtgtgtatctatctatctatctatctatctatctatctatctatctatctataacttgaatctgatcaagcctctacttccaactgccaacttttaggaaaaacagaggatagaggaacatgttgaactaca

SEQ ID NO: 22704 - DNA, 426 bp, Homo sapiens
  AC003101.1_199866
  Located on chromosome 17
  Distance between a terminus base of telomere on chromosomal short arm and 5'-terminus of this base sequence : 30604684
  Distance between 3'-terminus of neighbour sequence of sequence listing upward to telomere on chrosomal short arm and 5'-terminus of this base sequence : 17100
ccaggattacagtaacattgattcagtaaaaggtagagctgaggaatttggaaaaagagtagtaaaaatcctgacattgagtcaccaaagcccaccctgcctcagaattttgtgagatgcaaaattcactcaaatgtctaaactaggttgggttgaaatctctggtacacacacacacacacacacacacacacacacacacaccaactgatactagccatgggttagacgctgttgcctagggagagtgtggatgggcctgcacgtgagtggaccaggaggaaggctactgaaagttttccaaagaaggggtgctgggatccctggacgcagccatcctggaaattttcctatgtggagtctgggtctcttctagtgaagagaaaacctcaggtctttgtgccagacaagctagatttgaacagc

SEQ ID NO: 22705 - DNA, 270 bp, Homo sapiens
  D17S1800
  Located on chromosome 17
  Distance between a terminus base of telomere on chromosomal short arm and 5'-terminus of this base sequence : 30604821
  Distance between 3'-terminus of neighbour sequence of sequence listing upward to telomere on chrosomal short arm and 5'-terminus of this base sequence : -289
ctaaactaggttgggttgaaatctctggtacacacacacacacacacacacacacacacacacacaccaactgatactagccatgggttagacgctgttgcctagggagagtgtggatgggcctgcacgtgagtggaccaggaggaaggctactgaaagttttccaaagaaggggtgctgggatccctggacgcagccatcctggaaattttcctatgtggagtctgggtctcttctagtgaagagaaaacctcaggtctttgtgccaga

SEQ ID NO: 22706 - DNA, 470 bp, Homo sapiens
  AC021852.4_71936
  Located on chromosome 17
  Distance between a terminus base of telomere on chromosomal short arm and 5'-terminus of this base sequence : 30644694
  Distance between 3'-terminus of neighbour sequence of sequence listing upward to telomere on chrosomal short arm and 5'-terminus of this base sequence : 39603
gtcctttcaaatgtaaactgtaaaagaggcatgccagaaaacaatgctgtatcatagggacagcaagcatcccttcctgaggtaaagagaccttcttagagccgggtgcagtggctcacgcgtgtaatcccagaactgtgggaggccaacaggggcagatcacaaggtcaagagattgagaccatcctggccaacacagtgaaaccccatctctactaaaaatacaaaaattagctgggcatggtggtgcatgcctgtagtcccagctacttgggaggctgaggcagctgaatcgcttgaacccaggaggcggaggttgcagtgagttgagatctcatcactgcactccagcctggtgatagagagagactccatctcaaacaaacaaacaaacaaacaaacaaacacaacctccttaggctatacctgaagactgaactacaacagacctcaccagagatactagtgat

SEQ ID NO: 22707 - DNA, 480 bp, Homo sapiens
  chr17.fa.O7frz.33145745
  Located on chromosome 17
  Distance between a terminus base of telomere on chromosomal short arm and 5'-terminus of this base sequence : 30703911
  Distance between 3'-terminus of neighbour sequence of sequence listing upward to telomere on chrosomal short arm and 5'-terminus of this base sequence : 58747
cgtgatagttaaactctgcctgttgaaaaaaaacaaaccggggatggtggcaaagtcacgcctgtaatcccaacactgtgagaggccgatgcagaaggactgattgagtccaggagcttgagaccagcctgggcaacatggagaaaccctgtctctacaaaaaatacaaaaattagctaggcatgctggtgcatgcctgtagtcccagctactcgggaggcctaggtgggtgggaagattgcttgagcctgggaggttgaggctgcagtgagccaagatggagccatagcctgggtgacaaagcgacaccctgtctcaaataaataaataaataaatgagtcacagcttactttggattatgtttaattaagaaaagcaaagtgcatacagagatttataactttaaaaacaaaaaaaaaaagtctttttatatgatccaaagaataaactcaaaagtccatgacaaatagaagttctaa

SEQ ID NO: 22708 - DNA, 396 bp, Homo sapiens
  chr17.fa.O7frz.32746201
  Located on chromosome 17
  Distance between a terminus base of telomere on chromosomal short arm and 5'-terminus of this base sequence : 30869806
  Distance between 3'-terminus of neighbour sequence of sequence listing upward to telomere on chrosomal short arm and 5'-terminus of this base sequence : 165415
cagccatatgaattcatttaacctttattacctcctaaaagctgctgtctccaaatgtcgtcccatggggagttaaggcttcagcagatgaacttgggtgggggacacaattcaatctataatacttgccttctagaaattcttccaaagaattccaactcttctagaatcccaagacactccattaaccaaagcacaagaaaatacaattcccaaccggcaccagctcattcattcattcattcattcattcatcaccatggatgtgcgggtcctgatgaacactagggacagagaagggccttgccttcacattcataatgacttcaaaacaggggccctgagctcttaggaaacttctggaagaggagaacgtcatagacatcaagcactttc

SEQ ID NO: 22709 - DNA, 264 bp, Homo sapiens
  AC023278.3_128660
  Located on chromosome 17
  Distance between a terminus base of telomere on chromosomal short arm and 5'-terminus of this base sequence : 31140368
  Distance between 3'-terminus of neighbour sequence of sequence listing upward to telomere on chrosomal short arm and 5'-terminus of this base sequence : 270166
gccaataaatggaaactttaactcaaaagaaggaaggaaggaagggaggaagggagggaggggagggagggaagggagggaagggaaagaaggagggagggagggaaatgaggaaagaaagagaaagaaagaaagaaagaaaagaaaaaattgtaaaaccataaggttaaagtaaaccttttttcttcatacagagtaagcacgtgagttcagattacagctttgcttcttcatagcttggtgacctaggacaagttatgtaac

SEQ ID NO: 22710 - DNA, 121 bp, Homo sapiens
  DISD22_0010780
  Located on chromosome 17
  Distance between a terminus base of telomere on chromosomal short arm and 5'-terminus of this base sequence : 31404363
  Distance between 3'-terminus of neighbour sequence of sequence listing upward to telomere on chrosomal short arm and 5'-terminus of this base sequence : 263731
gccattgttaatttggaggggattatatatatatatatatatatatatatatatatatatatatatataaagaatactactaaaggatgtatttttattgtgtcaccatttacactgttca

SEQ ID NO: 22711 - DNA, 192 bp, Homo sapiens
  D17S1880
  Located on chromosome 17
  Distance between a terminus base of telomere on chromosomal short arm and 5'-terminus of this base sequence : 31841585
  Distance between 3'-terminus of neighbour sequence of sequence listing upward to telomere on chrosomal short arm and 5'-terminus of this base sequence : 437101
agggattgcttgagccctggaagttgaggctgcagtgccataattgtgccactgcactccagggtgataagagtgagatcctgtttcaaaacacacacacacacacacacacacacacacacacacacacaccaaaaaacaaagaacaaaaactaaatacacaggtacttacaaagtgttcaaattctgtca

SEQ ID NO: 22712 - DNA, 209 bp, Homo sapiens
  D17S798
  Located on chromosome 17
  Distance between a terminus base of telomere on chromosomal short arm and 5'-terminus of this base sequence : 32141318
  Distance between 3'-terminus of neighbour sequence of sequence listing upward to telomere on chrosomal short arm and 5'-terminus of this base sequence : 299541
tattcttgggagtgcagtatgttcttgggatgaaggaaggagatgctggaaaaacacaactttatatccccatccttcagagtataacagatctttatcttgatcaaatgtccaatgtcaacttttttacatgtaaaatgggatgcgtgtgtgtgtgtgtgtgtgtatggagggagggtagcagagactactaaacatctttctcatgg

SEQ ID NO: 22713 - DNA, 375 bp, Homo sapiens
  AC003687.1_94148
  Located on chromosome 17
  Distance between a terminus base of telomere on chromosomal short arm and 5'-terminus of this base sequence : 32156767
  Distance between 3'-terminus of neighbour sequence of sequence listing upward to telomere on chrosomal short arm and 5'-terminus of this base sequence : 15240
tccttcaatggttacgtcttacacagctatagtgtaataccactgtcaggacattgacattgctacaatgtgtatatagttctatgccattttataacatgtgtagatgtgtgtgtgtgtgtgtgtgtgtgtgtgtgtatgtgtttgagacggagtctttctccatcgcccatgctggagtgcagcggtgggatctctgcctcccaggttcaagtgattactcccacctcagcctcccattagcatggctaatttttatatttttagtagagatggggtttcaccatgttggccaggctggtctcgaactcctgacctcaagtgatctgcccgtctcagcctcccaaagtgctgggattaataggcgtgagccac

SEQ ID NO: 22714 - DNA, 378 bp, Homo sapiens
  AC003687.1_92283
  Located on chromosome 17
  Distance between a terminus base of telomere on chromosomal short arm and 5'-terminus of this base sequence : 32158653
  Distance between 3'-terminus of neighbour sequence of sequence listing upward to telomere on chrosomal short arm and 5'-terminus of this base sequence : 1511
taagttagccttctccagaaacagaataggatgtctgtctatctgtctgtctatctatctatcatctatctatctatctatctatctatctatctatctatctatctatctatctatatcatctatctatctatctatcttctaacaaataattttctaccaacttcacgtgagtggtatataagtcagagttctccagagaaatagaaccaataggatatctatctatctatgtatctatgcatctatctatctatctatccattttcatactgctatgaagaaaaagacgtttatggactcatggttccacatggctggggaagcctcacaatcatagtggaaggtgaaggaggagcaaagtattgtcttacatgg

SEQ ID NO: 22715 - DNA, 326 bp, Homo sapiens
  AC003687.1_75350
  Located on chromosome 17
  Distance between a terminus base of telomere on chromosomal short arm and 5'-terminus of this base sequence : 32175516
  Distance between 3'-terminus of neighbour sequence of sequence listing upward to telomere on chrosomal short arm and 5'-terminus of this base sequence : 16485
aggtcttccatcagtctgaattggggtcccagataggagactgccttagggctataggaatggagggaggattgtttctgatggagggggagagggatagggttgtacctgtgcttccggagtggttgagacaggattggatttaggcgagtggagtgtgtgtgtgtgtgtgtgtgtgtgtgtgtgtagagagagagagagagacagacagatacacactcacacacacacacacacacctggatgtctcctgttctctcattgtgtttctctgcctatcaccccagatttgttgaatcctaatctcaaggataccgttatctgtg

SEQ ID NO: 22716 - DNA, 281 bp, Homo sapiens
  AC003687.1_28390
  Located on chromosome 17
  Distance between a terminus base of telomere on chromosomal short arm and 5'-terminus of this base sequence : 32222520
  Distance between 3'-terminus of neighbour sequence of sequence listing upward to telomere on chrosomal short arm and 5'-terminus of this base sequence : 46678
ctttaagctttgatgtcataagagcctctgcagttttgtttccatctgtccatccatccacccacccacccattatctgtccatctgttcatccatctacccatccatccatccatccatccatccatccatccatccatccaaccatccatccatccatcttcccatgccccccacccatccaccttctatgtgtccaataaatattttttatttttttattttttttgagagtgagccttgctctgtcacccaggctggaatgcaatggtaagatcttg

SEQ ID NO: 22717 - DNA, 405 bp, Homo sapiens
  chr17.fa.O7frz.34278231
  Located on chromosome 17
  Distance between a terminus base of telomere on chromosomal short arm and 5'-terminus of this base sequence : 32475861
  Distance between 3'-terminus of neighbour sequence of sequence listing upward to telomere on chrosomal short arm and 5'-terminus of this base sequence : 253060
gttatgcaaatggtgataagagccacattacttttaatattaaaattcactggccaggtgcagtggctcacgcctgtaatccagcactttgggaggccaagatgggcagattgcttgagctcaggagtttgagaccagcctgggcaacatggcaaaaccctgtctctacaaaaaacacaaaaaattacctggatgtggtggtgcacgtctgtagttctagttactcaggaggctgaagtggggggatcctgagcctgcaaggtcgagactgcagtgaactgtgatcatgccactgtactccagcctcgggcatcagagtgagaccctgtctcaaaataaataaataaataaataaataaataaataaataaataaataataaagtttattgatgttatgaggcac

SEQ ID NO: 22718 - DNA, 452 bp, Homo sapiens
  chr17.fa.O7frz.34406371
  Located on chromosome 17
  Distance between a terminus base of telomere on chromosomal short arm and 5'-terminus of this base sequence : 32596111
  Distance between 3'-terminus of neighbour sequence of sequence listing upward to telomere on chrosomal short arm and 5'-terminus of this base sequence : 119845
gaggacagttgccactttatgatccaggacactcactgggccatgttttactaacgaggaagtcctctgtgggtgaagagtccacaacatctgtgtgatgtcccctttgctgtctggctgctgtgaagtgaggaggccaggcaggactggagtcctcagggaaggcccgactaggctttctctgttctaccccttctgtgcttgcagcccagtcaaccctattttgttgacccagctatcttggaatcgggagccagaggccccactctggctctcagcatgtatgtatgtgtgtgtgtgtgtgtgtgtgtgtgtgtgtgtgtgtgtgtgtgtgtgtgcagccatgctccagtgtgactgtcaagcacattaaggactcattcagctgtgaaaagatattcttgtttatcttgccagtcatctttgggaataacttcctagtttgaaactcc

SEQ ID NO: 22719 - DNA, 255 bp, Homo sapiens
  chr17.fa.O7frz.34622070
  Located on chromosome 17
  Distance between a terminus base of telomere on chromosomal short arm and 5'-terminus of this base sequence : 32782651
  Distance between 3'-terminus of neighbour sequence of sequence listing upward to telomere on chrosomal short arm and 5'-terminus of this base sequence : 186088
tcacaaagctagttagaatcagaccccagcctagaaccttcatctcatatctcctgggtcagtggttgttctacttctataattgccctacacacatatattacttcattctctctctctctctctctctctctcaagttctgaggaacccaggtagactttgaatctccagcagaaatcctgacactctgacagttggaggctgatttagctgcatgttctcataattgagtctgtaacttgcacagatctaat

SEQ ID NO: 22720 - DNA, 256 bp, Homo sapiens
  DISO7_00046658
  Located on chromosome 17
  Distance between a terminus base of telomere on chromosomal short arm and 5'-terminus of this base sequence : 32856162
  Distance between 3'-terminus of neighbour sequence of sequence listing upward to telomere on chrosomal short arm and 5'-terminus of this base sequence : 73256
ctatggtgcctggttcaatccacacacacacacacacacacacacacacacacacacactgtagaggtgagggtgtcacagcccagaaggaggaagagaggaattggcctaaagttgctaggggtgtcagtgggactttactgcagctcctgacacccagtccacagccgatcactacaccatattctcccaagactgtctgactctcctttgcaaaaagagacagacttttaaatcaggattgccctatgtcaga

SEQ ID NO: 22721 - DNA, 268 bp, Homo sapiens
  D17S1850
  Located on chromosome 17
  Distance between a terminus base of telomere on chromosomal short arm and 5'-terminus of this base sequence : 32988446
  Distance between 3'-terminus of neighbour sequence of sequence listing upward to telomere on chrosomal short arm and 5'-terminus of this base sequence : 132028
tgtcaggagatgccgctacattgttatttatagaaaaaaggaaagatgaatgtttttatgtaaaaaagattatcagggtatgcactaaaggattagcatgtggcacccttaataggtcccattctggaaggatattttccaaaacgaactatgcacacacacatacacacacacacacacacacacgtgcattcacacacacactccagtataacaactaatgatagaaaaaagggaaacaaaaatcagtgactctcctatcctggcc

SEQ ID NO: 22722 - DNA, 370 bp, Homo sapiens
  chr17.fa.O7frz.34975403
  Located on chromosome 17
  Distance between a terminus base of telomere on chromosomal short arm and 5'-terminus of this base sequence : 33095556
  Distance between 3'-terminus of neighbour sequence of sequence listing upward to telomere on chrosomal short arm and 5'-terminus of this base sequence : 106842
actgaatagttcctgaatggtcttccacactccggtttcttcttctttaatctattctcatgaatgagtctttttaatgaaaatcttataataaacctcatttccccagaaactttcatgattaccttgacttttgaataaaataaatataattcaacaaacattaattatagcacctcctctgtgtcagacactgtgttaggcattgtgaggaagacaaaattaaaatgaatattatatttctagggccttatgatccagtagtttagcttaccagaccataaagcccggtacacacacacacacacacacacacacgtgcatgtgcacacacacacacacacacacacaggtactgaataacgtgaac

SEQ ID NO: 22723 - DNA, 391 bp, Homo sapiens
  DISO7_00003663
  Located on chromosome 17
  Distance between a terminus base of telomere on chromosomal short arm and 5'-terminus of this base sequence : 33152282
  Distance between 3'-terminus of neighbour sequence of sequence listing upward to telomere on chrosomal short arm and 5'-terminus of this base sequence : 56356
caacgttaaggaagcagatttaaagatctctgagctcacttctctttggtgtcttactccagcagccattgtgcttatgtgtgtgtatgtatgtgtgtacaacctcagctggctttgcctgcctggcaccccagccctatccctggatttttccttgggcagtcaccctccatctggcggcatgcagtctcagtggtggtatccatcaaggtatgctgcccggcaggtggacaggagacttaggcaagtccagccagcttctcttttcctagacactgacctgaattgagtgctgttaggtgataggaacctatctatccatccatccatccatccatccatccatccatccatccatagagccctgccacaaagacagtgcccatgaatt

SEQ ID NO: 22724 - DNA, 438 bp, Homo sapiens
  AC011193.2_31574
  Located on chromosome 17
  Distance between a terminus base of telomere on chromosomal short arm and 5'-terminus of this base sequence : 33326669
  Distance between 3'-terminus of neighbour sequence of sequence listing upward to telomere on chrosomal short arm and 5'-terminus of this base sequence : 173996
ttccatgtgagctaagtaatgggggcatgagcatgcacatcctcccttgaggttcagcttagacacaacttcccccaggaaatctctcctacaactctcccctcatccccaggctccagtatgttcccatagcaccaaatcttggcaggtagtatagtggcctgtttgcaggtccgtcatctggatcctgcagcagcctttgagccctaaccacagggacagggtctcattcacctatgggtccaggtcctggcatatcttagactttaacaaagccttactgaacatatggttggatggatgactggatggacagatggatggagggatggatggatggatggatggatggatggatggacagatggacagatggatggatggatgacccaggatgcaaatgaactctatgcacagctacagctatagaagcaaggc

SEQ ID NO: 22725 - DNA, 320 bp, Homo sapiens
  AC005691.1_145893
  Located on chromosome 17
  Distance between a terminus base of telomere on chromosomal short arm and 5'-terminus of this base sequence : 33387318
  Distance between 3'-terminus of neighbour sequence of sequence listing upward to telomere on chrosomal short arm and 5'-terminus of this base sequence : 60211
accaatgcagtcgatacaggtcagcctcactggcacaggtagtagggaatggatctggagggcagatggaagatattcagtacacacagctaactcttaaatgtcagagtaagaacttgaatcagggctatcagacccctgccactacaatgccatttcctgtagatcctcagtaaatggtcattgaatggttgaaaggatggatggatggatgggtggatggatggatggatggatggatggatggatggatggatggatgggtaattcatgaagacttcattcatgtgcctttggttaatcttgtcacctgactagaa

SEQ ID NO: 22726 - DNA, 294 bp, Homo sapiens
  AC005691.1_124137
  Located on chromosome 17
  Distance between a terminus base of telomere on chromosomal short arm and 5'-terminus of this base sequence : 33409237
  Distance between 3'-terminus of neighbour sequence of sequence listing upward to telomere on chrosomal short arm and 5'-terminus of this base sequence : 21599
agtccaagctcttcaaacttactgggccctccatgacctgggctcctctctcctctcctctcctctcctctcctctcctctcctctcctctcctctcctcccacagcctttgcttctgcagatgaaatgccttaaattctggatcacagcaggctccacacttaaggtgggctctccctgtttcccagaacactccttactcctcaacggcgctggctaactatgccaccaggtctcaccgaagaccccatcttcctcaggcaatgagtgcccttctcatatgcgctcaggata

SEQ ID NO: 22727 - DNA, 183 bp, Homo sapiens
  D17S1842
  Located on chromosome 17
  Distance between a terminus base of telomere on chromosomal short arm and 5'-terminus of this base sequence : 33485656
  Distance between 3'-terminus of neighbour sequence of sequence listing upward to telomere on chrosomal short arm and 5'-terminus of this base sequence : 76125
gcagcccgtttgttaagtttgagcgtatatgagtgtgtgtgtgtgtgtgtgtgtgtgtgtgtgtgtgtggcagggtggggaaagagagttctgctcttaatgaacccagcaggggatccacccttgggagtctgccctgaggtttgccatggggcacctggattgatattcccagtggggcat

SEQ ID NO: 22728 - DNA, 284 bp, Homo sapiens
  D17S1293
  Located on chromosome 17
  Distance between a terminus base of telomere on chromosomal short arm and 5'-terminus of this base sequence : 33637720
  Distance between 3'-terminus of neighbour sequence of sequence listing upward to telomere on chrosomal short arm and 5'-terminus of this base sequence : 151881
tggaggctaggagttttccttcttttctgctcttccttccttcctttcttccttccttccttccttcctctctctctttctttctttctttctttctctctctctttctttctttctttcctttccttccttccttctttctttcttctttctttctttctttctttctttctttctttctttctttctttctttctttctttctttcattattttttttttacagggtctcattctgtcacccactctggagagcagtggcgcaatcacaactcactgcctcc

SEQ ID NO: 22729 - DNA, 424 bp, Homo sapiens
  chr17.fa.O7frz.35448181
  Located on chromosome 17
  Distance between a terminus base of telomere on chromosomal short arm and 5'-terminus of this base sequence : 33751382
  Distance between 3'-terminus of neighbour sequence of sequence listing upward to telomere on chrosomal short arm and 5'-terminus of this base sequence : 113378
gcttgtagtccacagttgtaacacaaggtagaaagtatgaaccagcagaaggaatgaactgataaattgctgtgggaattcatagagagggggagtgggctcttccagggctggttgtgtgtgtgtttgtgtgtgtgtgtgtgtgtgtgtgtgtgtctgtgtagagaaagggaagctcatagaggaattgactttagagctggactttgaagaatgagtcacattcaggcatgaggagatggggttgtggaggctggctttggaggcacacaaaataagaggtaaaggaagagatcctctaagcattaacctgggagcataatgcatttaacaggtaaaaatagacatcaaactgtatacatgttgtataaaaattaggctaacaaagcagtgtttttatttatgctgtctcacttgatacaat

SEQ ID NO: 22730 - DNA, 388 bp, Homo sapiens
  chr17.fa.O7frz.35523647
  Located on chromosome 17
  Distance between a terminus base of telomere on chromosomal short arm and 5'-terminus of this base sequence : 33826744
  Distance between 3'-terminus of neighbour sequence of sequence listing upward to telomere on chrosomal short arm and 5'-terminus of this base sequence : 74938
cttcctacttcattagaatcatgttattggcctaaaatactgtatgtaaaggatgctctggggcccatctggaagcctgcattctctggggatataattacgctaagcaatttttcaccagggacagcatgacttagcttctacctgggcatcctctggcaacacagccctcagttcttccaaagggattggctgctgtcccttcaggccttcttcttggtgtgtgtgtgtgtgtgtgcgtgtgtgtgtgtgtgtgtgtgattcaagggtatgacccacttttattttgtatgagctgttttatccataaaaacaaagataatttgttgcatctttgtgtgtcctcaacagggagggtatgcatgcctttggaatagtaaaggtcacc

SEQ ID NO: 22731 - DNA, 310 bp, Homo sapiens
  AC004100.1_44547
  Located on chromosome 17
  Distance between a terminus base of telomere on chromosomal short arm and 5'-terminus of this base sequence : 34066149
  Distance between 3'-terminus of neighbour sequence of sequence listing upward to telomere on chrosomal short arm and 5'-terminus of this base sequence : 239017
ataggtttgcatttcagacaaggttgctgacaagctcagtcttgaagagatctccatggtgcaagagagaggaggcatgtgcctcctaccttgggtcagttgggcaagttattcttcagtgggagccctgcgttaactacacacaccacacacaggtgcgtgctcacgtacacacacacacacacacacacagttcctgctggccctttgacttgactggctccccggatggcagggaacattaacatttctgcctccagcaagtcctctagtctggaggtttggcccagaggatcctcatttactttcc

SEQ ID NO: 22732 - DNA, 192 bp, Homo sapiens
  D17S933
  Located on chromosome 17
  Distance between a terminus base of telomere on chromosomal short arm and 5'-terminus of this base sequence : 34100472
  Distance between 3'-terminus of neighbour sequence of sequence listing upward to telomere on chrosomal short arm and 5'-terminus of this base sequence : 34013
tgtggtttccttatagactgtagatacaattccttttttggatatatgtgaataatatgtgtgtgtgtgtgtgtgtgtgtgtgtgtgtgtgtgtatacacatatacctaaaaaaggaatttgatatatatcctatatatatcaaattcataatacatatcaagatataagcatttccaggaccccagtgagt

SEQ ID NO: 22733 - DNA, 478 bp, Homo sapiens
  AC060766.3_127358
  Located on chromosome 17
  Distance between a terminus base of telomere on chromosomal short arm and 5'-terminus of this base sequence : 34540331
  Distance between 3'-terminus of neighbour sequence of sequence listing upward to telomere on chrosomal short arm and 5'-terminus of this base sequence : 439667
cactcatagtggaagctgaacaatgaaaacacatggacacagggaggggaacatcacacaccagggcctgtcagggggtgggggcataggggagggatagcattagtagaagtacctaatgtaggtgatgggttgatgggtgcagcaaaccaccatggcacatgtatacctatgtaacaaaactccacattctgcacatgtatcccagaacttaaagtataataaaataaataaatatataataaataaataaataaataaataaaaagcaagactcaatgatctgttgcctataagaaacatgtttcacccatacagatacacataggccgaaaataaagggatggaaaaagatattctatgctaatggaaaccaaaaaagagcaggagtagctatacttgtgtcagacaaaatagattacaagacaaaacttttggccaggtgcagtggctcatgtttataattccagaactttca

SEQ ID NO: 22734 - DNA, 170 bp, Homo sapiens
  D17S1846
  Located on chromosome 17
  Distance between a terminus base of telomere on chromosomal short arm and 5'-terminus of this base sequence : 34569271
  Distance between 3'-terminus of neighbour sequence of sequence listing upward to telomere on chrosomal short arm and 5'-terminus of this base sequence : 28462
tccttctgtggctggcttatttcacttagcataatgtcctccaggttcatccaccttgttgcagatgacagaattttcttcttttctaagtctgaatagtattcccgtgtgtgtgtgtgtgtgtgtgtgtgtgtgtgtcttactttctttaatcacacatgcatcaatgg

SEQ ID NO: 22735 - DNA, 445 bp, Homo sapiens
  AC015911.4_120523
  Located on chromosome 17
  Distance between a terminus base of telomere on chromosomal short arm and 5'-terminus of this base sequence : 34706461
  Distance between 3'-terminus of neighbour sequence of sequence listing upward to telomere on chrosomal short arm and 5'-terminus of this base sequence : 137020
ctcaactcactggctaatacaggtgagatgctagaaacacagaagaaaatatcaactagggctgggtgtggtggcttatgcctgtaatcccagcagtttaggaggccgaggcaggtggattgcttgagcccaggagtttgagaccagcctgggcaatatggtgaaaccctgtcacaaaaagaaagaaaagaaagcaaggaaggaaggaaggaaggaaggaaggaaggaaggaaggaaggaaggaaggaaggaaggaaggaaagaaggaaggaaggagaaaatatcaactgatcaactgggagattaaagagctgaacatcactttcatcagcctcacggtgctcaggaaacacaaattgtaattcaactcccagccaagtagaagggtcttggtaaataccccagactttaagaccccagaagagccatgacctagtaattagtg

SEQ ID NO: 22736 - DNA, 352 bp, Homo sapiens
  AC004134.1_59271
  Located on chromosome 17
  Distance between a terminus base of telomere on chromosomal short arm and 5'-terminus of this base sequence : 34878665
  Distance between 3'-terminus of neighbour sequence of sequence listing upward to telomere on chrosomal short arm and 5'-terminus of this base sequence : 171759
cgagatacgccactgtactccagcctgggtgacagaacaagactctgtctcaaaatacatgcatacatacatacatacatacatacatacatacatacaaataaaacaataataaaggtagaaagggaaaaatgggcaacagtgaaaatgtccctcaatagtggactaataattaatggtgcagtgggcattacagtggaaaagtgcagtcgtatatatcaacatggagagcaacttcagaacagtatatataatatgaaactggttttatatgaaataagtgtgtgtgtgtgtgtgtgtgtgtgtgtgtgacccatctggacagatatataccacattactaatcatggct

SEQ ID NO: 22737 - DNA, 469 bp, Homo sapiens
  AC023247.2_78787
  Located on chromosome 17
  Distance between a terminus base of telomere on chromosomal short arm and 5'-terminus of this base sequence : 34984455
  Distance between 3'-terminus of neighbour sequence of sequence listing upward to telomere on chrosomal short arm and 5'-terminus of this base sequence : 105438
ggtgaatgacagatagacaaataaatctaaggctgggtgtggtggctcatgcctgtagttccaacactttgggaggctgaggtgggtggatcgcttgagcccaggagttggagaccagcctggccaacatggcgaaaccccttctctactaatacaaaaattagccaggcgtggtggtgggcgcctgtaatcccagctacttgggaggctgaggcaggagaatcacttgaacctgagaggcggaggttgcagtgagccgagatcgtgccactgcacaccagcctgggcgacaaagactccatctcaaaaataaataaataaataaataaataaataaataaataaataaatagtcagatggtgatccattccagggagacaaataaaggaataaaggaggcgagggtatgtgtggaattttctataagatggttaaaggcctcagggataaggtgataattgagcaaag

SEQ ID NO: 22738 - DNA, 325 bp, Homo sapiens
  chr17.fa.O7frz.38576603
  Located on chromosome 17
  Distance between a terminus base of telomere on chromosomal short arm and 5'-terminus of this base sequence : 35308975
  Distance between 3'-terminus of neighbour sequence of sequence listing upward to telomere on chrosomal short arm and 5'-terminus of this base sequence : 324051
ctgctacttctacaagcttgacttttttagatgccacacataagtgagattaagcagtatttgtttttctgtgcctggcttatttcactttgcataatgtcctccaggtccatctatgttgctgcaaatgacaggatttccttattttttaaggctgaacagtattccattgtgtgtgtgtctgtgtgtgtgtgtgtgtgtgtatctatatctcacattttctttattcattcatccattggcatacatgtaggctgtttccatgtcttggctatggtgaataatgctgcaatggatatgggagtacagataccttgacatgcag

SEQ ID NO: 22739 - DNA, 198 bp, Homo sapiens
  AC004099.1_101283
  Located on chromosome 17
  Distance between a terminus base of telomere on chromosomal short arm and 5'-terminus of this base sequence : 35431160
  Distance between 3'-terminus of neighbour sequence of sequence listing upward to telomere on chrosomal short arm and 5'-terminus of this base sequence : 121860
tcaccagctaaagaccataaatagaacaacagctaatacgcccttactttcaagcactatactaagctctttatatgcattatctaattcactacacacacacacacacacacacaatggttaaaagggtaggtctcaatcttggaaagccgtccagtcactctgttgctcaggctggagtacagtggcgtgatcaca

SEQ ID NO: 22740 - DNA, 407 bp, Homo sapiens
  AC004132.1_47287
  Located on chromosome 17
  Distance between a terminus base of telomere on chromosomal short arm and 5'-terminus of this base sequence : 35633705
  Distance between 3'-terminus of neighbour sequence of sequence listing upward to telomere on chrosomal short arm and 5'-terminus of this base sequence : 202347
aaggcacagttgagtaattacaactgaatagtttaaagtacttaatagttactatctggctctttacagaaaaagtttgtcaatccctgttctagagaatttatgaatagctaggataataaccatgactgactaattgatctgactttatttgtgggctgcattccttttatatatataacttctatatgtatgcgtgtgtgtgtgtgtgtgtgtgtgtgtgtatatatatataatacatatatatgtatgtatatttctctctctcctcttcatttgtgtttatacttccccctaaaaaataggtagaggcataaagccagatcttgttccattccattaagcaggtagcttcaaaggcccttgcacagatctctgcctctctctgcacctgtaatacctaattc

SEQ ID NO: 22741 - DNA, 435 bp, Homo sapiens
  AC025882.2_152661
  Located on chromosome 17
  Distance between a terminus base of telomere on chromosomal short arm and 5'-terminus of this base sequence : 35731830
  Distance between 3'-terminus of neighbour sequence of sequence listing upward to telomere on chrosomal short arm and 5'-terminus of this base sequence : 97718
tacacttcagctagtttgagctgttttctaccacgggtagaagaaatagttctaatcaatacaagaggattttaagaggattttactacctttttatactttttcatttaaaactttttttaattctttctttttctttctttcttttttctttctctctttctgtctctctttctctctctttctttctttctttctttctttctttctttcagacagtcttactctgttgaccaggcttgagtacagtggcataaccaattatagctcactgtagcctcaaactcagggctcaggtgatcctccaacctcagcctcccaagtagctaggactacaggtgcatgccatcacacccagctaatttttattttattttttctagagaccagggtctcactatgttgtccaggctggtcttgaactcttgacctcaa

SEQ ID NO: 22742 - DNA, 257 bp, Homo sapiens
  HUMUT224
  Located on chromosome 17
  Distance between a terminus base of telomere on chromosomal short arm and 5'-terminus of this base sequence : 35829803
  Distance between 3'-terminus of neighbour sequence of sequence listing upward to telomere on chrosomal short arm and 5'-terminus of this base sequence : 97538
ctccatcataggtgacaaattgagactctgtctcgaaagaaagaaagaaagaaagaaagaaagaaagaaagaaagaaagaaagaaagaagaaagaaaagaaaagaaaggaagaaagaaaaagagaaagaaaaaagaaaagagaaagagaaaaaagaaagaaaaggaaggaaggaaggcaggaaaggaaggaaggaaggagaaagagagagagaaagaaagaagaggaaagtgaggctggcaagtggcaaagctcaaa

SEQ ID NO: 22743 - DNA, 419 bp, Homo sapiens
  AC003103.1_1688
  Located on chromosome 17
  Distance between a terminus base of telomere on chromosomal short arm and 5'-terminus of this base sequence : 35957192
  Distance between 3'-terminus of neighbour sequence of sequence listing upward to telomere on chrosomal short arm and 5'-terminus of this base sequence : 127132
gaagtacatctttctgtgaaagagtacacagaaagtaaattgttgagtccttacgtgtatgaaaaatgcatttatgtaactctcattatacttggttaataatttggctgaggaggcagaggctgcaatgcgctgagattgcaccactgcactccagcctgggtgacagagcaagactgtcttagtaataataataataataataataataataataataaggctgtatatggaatttgagtctggaagtcattttccatagaattttgaaggtaccttgctgtcctctgctatctgctcttgctattgagacgtcttttcccattcagatttccattctttaatatgtagggcgactgtataatttattatcaaaactgggacaggtaaagtgctagtctgacagcatattaggacaa

SEQ ID NO: 22744 - DNA, 96 bp, Homo sapiens
  D17S1867
  Located on chromosome 17
  Distance between a terminus base of telomere on chromosomal short arm and 5'-terminus of this base sequence : 35965204
  Distance between 3'-terminus of neighbour sequence of sequence listing upward to telomere on chrosomal short arm and 5'-terminus of this base sequence : 7593
tttagacttggtaactgccgtgtgtgtgtgtgtgtgtgtgtgtgtgtgtgtgtgtgagaaacacagtgtcatcacacaaagcctcagtgtcaaact

SEQ ID NO: 22745 - DNA, 436 bp, Homo sapiens
  AC003103.1_91213
  Located on chromosome 17
  Distance between a terminus base of telomere on chromosomal short arm and 5'-terminus of this base sequence : 36046740
  Distance between 3'-terminus of neighbour sequence of sequence listing upward to telomere on chrosomal short arm and 5'-terminus of this base sequence : 81440
tctacattaggaaatggctgagtgggagtaaaaaggtaggtgctcccatcctttcctatccaaaataaaaagtccctatgcaagttgggaggactgcctgaagccaggatttcaagatcagcctggacaacaaagcaagaccctgtctctacaaacacacaaacacacacacacacacacacacacacacaaaatgccaagtgtggtagctcacacctgtaatctcagaactttgggaagccaaggtgggaggatggcttgagcccaggggttcaataccagcctgggcaacagagcgagaccctgtctttcctcctgcatgccccccaaaattagccaggcatggtgaagcgtgcctgtagtcccagagatactctggtggctgaggcaggaggatcgctggagcccaggagttcaagctgcggtgaactatgat

SEQ ID NO: 22746 - DNA, 370 bp, Homo sapiens
  chr17.fa.O7frz.38695753
  Located on chromosome 17
  Distance between a terminus base of telomere on chromosomal short arm and 5'-terminus of this base sequence : 36265521
  Distance between 3'-terminus of neighbour sequence of sequence listing upward to telomere on chrosomal short arm and 5'-terminus of this base sequence : 218345
attgatattgcatgacaggtagatgggaagggattcattatactcttcaacttttacatagttaacacacacacacacacacacacacacacacacacacacaccccaaaaaacacattcatttaaaatgcaaatccttagatgtccaacacacacacatactctccttaaaagacaaagtctgtgcttttgaggatggaaaacaaggtcccccttggcaaatactatatcacatcttgtagccatccgtaatttctagaaaaccacttgtgtcatacctttatgcatttgcaatgctgttctttctgtctggtacacctttctctccccccaattgcttcactaactcttactcattcttggttagaca

SEQ ID NO: 22747 - DNA, 157 bp, Homo sapiens
  Z23601.1_169
  Located on chromosome 17
  Distance between a terminus base of telomere on chromosomal short arm and 5'-terminus of this base sequence : 36474960
  Distance between 3'-terminus of neighbour sequence of sequence listing upward to telomere on chrosomal short arm and 5'-terminus of this base sequence : 209069
caaggaaagaactgaagttagaagagggagaagaacctgaagtcgggtacctggttttgacctacctctccccaaactagaaaacccgtgagacacacacacacacacacacacacacacacacgcacacaaccaagtttcaaaccagacaatagaa

SEQ ID NO: 22748 - DNA, 472 bp, Homo sapiens
  AC067923.3_173272
  Located on chromosome 17
  Distance between a terminus base of telomere on chromosomal short arm and 5'-terminus of this base sequence : 36806321
  Distance between 3'-terminus of neighbour sequence of sequence listing upward to telomere on chrosomal short arm and 5'-terminus of this base sequence : 331204
atctttgtaacaaacctgcacacatacccccaaatctaaaattgaaatacttgtccgggcacggtggctcacgcctataatcccagcactttgggaggccgaggcgggtggatcacgagatcaggagatcgagaccatcctggctaacatggtgaaaaccccgtctctactaaaaatacaaaaaattagccgggcgtggtggcgggcgcctgtagtcccagctactagagaggctgaggcgggagaatggtgtgaacccgggaggcggagcttgcagtgacccaagattgtgccactgtactccagtctgggggacagagcgagactccgtctcaaaaataaataaataaataaataaataaataaataataaaataaaattgaaatactttctttcctacgttttgactaaatgctgtttgatcactccctacaatgacaaagattttgtaatattgtccatagccagaag

SEQ ID NO: 22749 - DNA, 247 bp, Homo sapiens
  chr17.fa.O7frz.39631063
  Located on chromosome 17
  Distance between a terminus base of telomere on chromosomal short arm and 5'-terminus of this base sequence : 36980708
  Distance between 3'-terminus of neighbour sequence of sequence listing upward to telomere on chrosomal short arm and 5'-terminus of this base sequence : 173915
tttggagaaatacctacagaaactaagattggtgggaggcccagcagcgtctcacctcccatctcagactcagtccaggacacaggctcagggggcagaaggagggctgattcgcctgcatcttttgaaattctttctttctgtctctgcctctgcctctctctgtcttcctcccttcctctctctctctctctctctctctctttctctctctctctctttatttatttcacctgagtttcagagt

SEQ ID NO: 22750 - DNA, 274 bp, Homo sapiens
  AF088219.1_2830
  Located on chromosome 17
  Distance between a terminus base of telomere on chromosomal short arm and 5'-terminus of this base sequence : 37191028
  Distance between 3'-terminus of neighbour sequence of sequence listing upward to telomere on chrosomal short arm and 5'-terminus of this base sequence : 210073
atgactgtccatctgtcaaaactcatcaagttgtatacataaaaatgattaactatatctgtatttaaattatatgtcaataaacctgactccctgccactcccccaacacacacacacacacacacacacacacacacacacaaaatcagaggactgcagatatgggccggggggtgggtaaagcaaattgaactaaactccaaaaagtgatgcactgaactttaactttcaatagctatgtctgagttaacatgacagattagaattccaag

SEQ ID NO: 22751 - DNA, 385 bp, Homo sapiens
  AF088219.1_117603
  Located on chromosome 17
  Distance between a terminus base of telomere on chromosomal short arm and 5'-terminus of this base sequence : 37305827
  Distance between 3'-terminus of neighbour sequence of sequence listing upward to telomere on chrosomal short arm and 5'-terminus of this base sequence : 114525
cgtagctgattatgacacctacccttctcagacaccatcagctccaatgttggtgccttatttggacttattctttgtgggtttgtttgtttgtttgtttgtttttcttttttcaaaattaatctctccttctcactcgtacctccaacctctcacatcatctgacccccacaagtacacatacacgattcaccagaatgacgtaggacaatcagggaattctttttaaggatttcatgcgagactgttaatggtttagtgagttatacttttatttgcaattttaaactcttaaaaaaacctcttaagtcaaaagattgcatctttcgtggttatttcccacaagtgctaatacttagtaccctaatctccttcaggagtgaag

SEQ ID NO: 22752 - DNA, 265 bp, Homo sapiens
  chr17.fa.O7frz.17917848
  Located on chromosome 17
  Distance between a terminus base of telomere on chromosomal short arm and 5'-terminus of this base sequence : 37985979
  Distance between 3'-terminus of neighbour sequence of sequence listing upward to telomere on chrosomal short arm and 5'-terminus of this base sequence : 679767
ctccagagaaacagaagtgatagaagatgtgtgtgtgtgtgtgtgtgtgtgtgtgtgtatacatatatatatatatagagagagagagagagagacagagagcgagagaagaagtgaagagaagacatttattaggagaattggcttatctgatttcagaggctaagaagtctcataataggccatgtgcaagctggagaaccaagaaagttgttagcatggctcagtccaaatccagaggcctttccagactttaccactaatc

SEQ ID NO: 22753 - DNA, 245 bp, Homo sapiens
  Z67688
  Located on chromosome 17
  Distance between a terminus base of telomere on chromosomal short arm and 5'-terminus of this base sequence : 38057606
  Distance between 3'-terminus of neighbour sequence of sequence listing upward to telomere on chrosomal short arm and 5'-terminus of this base sequence : 71362
catcctgaattaagattgagtcatggatatgaatatatgcatatatatatatatattgcatgcatgtggaggcaggttgtatataatataatatgtatatatattacatatgtatagtgtgtgtgtgtgtatatatatatatatgtgtgtgtgtgtgtgtgtgtgtgtgtgtattatatacaccctgcctccacatgcatggcctccctcattatcagtatcctcccctagagtggtacaactgt

SEQ ID NO: 22754 - DNA, 341 bp, Homo sapiens
  chr17.fa.O7frz.18192309
  Located on chromosome 17
  Distance between a terminus base of telomere on chromosomal short arm and 5'-terminus of this base sequence : 38151914
  Distance between 3'-terminus of neighbour sequence of sequence listing upward to telomere on chrosomal short arm and 5'-terminus of this base sequence : 94063
tactcacaagaattgattccatggacctcatcactatcccaaagaccacccatcagtaatctacagaccctcatctctcaacccagggaccccacagattccccatccctgattccaggatctatagaacctcatctcttacccccacagacctattaataaaaggatacattcataggagactgtgttgaccattttacacacctattgcgtgtgtgtgtgtgtgtgtgtgtgtgtgtgtgctgattaatggacttaggtaaactttagcgttttggtaggcaatgcaatttttcaatgccttttctttctttttcttgtacatctttaaaggcctcact

SEQ ID NO: 22755 - DNA, 463 bp, Homo sapiens
  chr17.fa.O7frz.18071857
  Located on chromosome 17
  Distance between a terminus base of telomere on chromosomal short arm and 5'-terminus of this base sequence : 38218575
  Distance between 3'-terminus of neighbour sequence of sequence listing upward to telomere on chrosomal short arm and 5'-terminus of this base sequence : 66320
taagatgctgacatctggtaagggaaggctttcttgctgcatcatcccgtggtggaaggtcaaagagagggggagggagagaagagagagagagagagagagcgagagagagagaggtactcactaccatgataactaacccactcccgagataagggcattgatccattcacgagggtagagttttaatggcctaatcacgtcttcttaaagattccacctacttcagctcttcctcatggaacctttttattttaaaaaataaaaggtcccacctcttaatgctgttgcactggggaccaagtttccaacacatgcttttgggggccacactcagaccgcagcaggtgtctagccctactgtgtcttgcagtcaagcaagcaaagccaggaaggagtcaggagtcctgagccacgtggcctgtcaaggaatcacacggaagttatgtctgtttctcattgc

SEQ ID NO: 22756 - DNA, 209 bp, Homo sapiens
  DISO7_10004205
  Located on chromosome 17
  Distance between a terminus base of telomere on chromosomal short arm and 5'-terminus of this base sequence : 38323115
  Distance between 3'-terminus of neighbour sequence of sequence listing upward to telomere on chrosomal short arm and 5'-terminus of this base sequence : 104077
ttgtgttaacttgagcgaggtcttttgtgtgcgtgggttaagggcacattcctaaaaaagtctataaaaagtatcaaaaagtaccaaatccagttgtataagagtgtgtgtgtgtgtatgtgtgtgtgtgtgtgtttggatccaaatatgaaatgcaaattttgtgataactctttttgtaccatctctccctgacccactgtacttcc

SEQ ID NO: 22757 - DNA, 171 bp, Homo sapiens
  D17S1836
  Located on chromosome 17
  Distance between a terminus base of telomere on chromosomal short arm and 5'-terminus of this base sequence : 38636445
  Distance between 3'-terminus of neighbour sequence of sequence listing upward to telomere on chrosomal short arm and 5'-terminus of this base sequence : 313121
aaactgtgtgtgtcaaaggatactattaggaaagtgaaaagacaaccaatcattggatggaagaaaaaaagtgtgtgtgtgtgtgtgtgtgtgttttttcctgagacagggactcactctgtggctccagttggaatgcagcagtatgatcatggctcaccataacctcga

SEQ ID NO: 22758 - DNA, 276 bp, Homo sapiens
  AC006449.19_97078
  Located on chromosome 17
  Distance between a terminus base of telomere on chromosomal short arm and 5'-terminus of this base sequence : 38766039
  Distance between 3'-terminus of neighbour sequence of sequence listing upward to telomere on chrosomal short arm and 5'-terminus of this base sequence : 129423
attagtcagatattggagccaccacactccagtctgggagacagagtgagactctgtctcaaaataataataataataataataataataataataataataataagcacatcagttaccactccttgagcgcctaccaaattaccaaaaacctgccattttaatagattttcttattgaatcatcacaggaattccatgaagtaaatattattatccctctttcacagatgaggggactgagggacaaagagattaactcactagctcaagatca

SEQ ID NO: 22759 - DNA, 403 bp, Homo sapiens
  AC006449.19_112244
  Located on chromosome 17
  Distance between a terminus base of telomere on chromosomal short arm and 5'-terminus of this base sequence : 38780959
  Distance between 3'-terminus of neighbour sequence of sequence listing upward to telomere on chrosomal short arm and 5'-terminus of this base sequence : 14644
caaaatggagctaatagtaccacggttgggcgcggtggctcacacccgtaatcccagcacattgggaggccaaggtgggcagatcatttgaggtcaggagttcgagaccagcctggccaacatagtgaaaccccgtctctactaaaaaatacaaaaattagccaggcatggtggcccacgcctgtagtcccagctactagggaggttgaggcatgagaatcacttgaacccagaaggtggaggttgcagtgagccaagattgcgccacggcattccagcttgggcaacagagtgagactctgtctcaaaaataaataaataaataaataaataaataaataaataaataaataaataatagtacctacctcatgttgtgtcctgaggattacatgagcaacta

SEQ ID NO: 22760 - DNA, 268 bp, Homo sapiens
  chr17.fa.O7frz.40510126
  Located on chromosome 17
  Distance between a terminus base of telomere on chromosomal short arm and 5'-terminus of this base sequence : 38810580
  Distance between 3'-terminus of neighbour sequence of sequence listing upward to telomere on chrosomal short arm and 5'-terminus of this base sequence : 29218
aactcctgacctcgtgatccacctgccttggcctcccaaagtgctgggattacatgtgtgagccaccgcaccccgcctaaaaaattgtttttaaagataaaataacagtctatcaagcagaaaaatcctacacacacacacacacacacacacacacacacacacacgctcatctcacacatacacacactcccatctgtccacatgctttgcttcctcccttctctctggcacggcagagcgcctcctcttgtccatgcaagctatc

SEQ ID NO: 22761 - DNA, 321 bp, Homo sapiens
  AC006449.19_233181
  Located on chromosome 17
  Distance between a terminus base of telomere on chromosomal short arm and 5'-terminus of this base sequence : 38902118
  Distance between 3'-terminus of neighbour sequence of sequence listing upward to telomere on chrosomal short arm and 5'-terminus of this base sequence : 91270
tcactcaagaaattagctcaaggaagaaaaaaagctggatgggtttgtgtggacttgtaactcatatccccaaggtaatagattaaatttatttatttatttatttatttatttatttatttatttatagacagagtctcactgtgtcgcccagactggagtacagtggtgcgatctcagctcactgcaagctccgcctcctgggttcacaccattctcctgcctcagcctccagagtagctgggactacaggtgcccgacaccacacctggctaattttttgtatttttagtagagacagggtttcaccatgttagcctg

SEQ ID NO: 22762 - DNA, 476 bp, Homo sapiens
  AC024189.3_38583
  Located on chromosome 17
  Distance between a terminus base of telomere on chromosomal short arm and 5'-terminus of this base sequence : 39068495
  Distance between 3'-terminus of neighbour sequence of sequence listing upward to telomere on chrosomal short arm and 5'-terminus of this base sequence : 166056
gtggataaagaattgagcctaggccgagtgtggtggctcacgcctgtaatcccagcactttggaaggccaaggtgggcagatcacctgagatcgggagttcaaggccagcctgtccaacatggagaaaccccgtctctactaaaaatacaaaattagccagacgtggtggtgcatgcctgtaatcccagctactcgggaggctgaggcaggagaattgcttgaacctggggggcacaggttgcggtgagccgagatcgcactattgcaatcccgactgatcaaggagagcgaaattctgtctctgggcaacatagggagacggcctccttcacccaccacctgcccccatctccacaaaatggaaaacaaacaaacaaacaaacaaaaattgaaccaagcagggtgcggtggctcatgcctgtaatcccagcacttcgggaggccaaggcgggcagatcatgaagtcagaagttcg

SEQ ID NO: 22763 - DNA, 139 bp, Homo sapiens
  D17S1818
  Located on chromosome 17
  Distance between a terminus base of telomere on chromosomal short arm and 5'-terminus of this base sequence : 39208932
  Distance between 3'-terminus of neighbour sequence of sequence listing upward to telomere on chrosomal short arm and 5'-terminus of this base sequence : 139961
cataggtatgttcagaaatgtgaatcttatcacacacacacacacacacacacacacacacacacacacacacacaccagggaaccatgtaacaggttctgagacagcacagccggttacatctggtttccagtaggca

SEQ ID NO: 22764 - DNA, 456 bp, Homo sapiens
  chr17.fa.O7frz.40909664
  Located on chromosome 17
  Distance between a terminus base of telomere on chromosomal short arm and 5'-terminus of this base sequence : 39241092
  Distance between 3'-terminus of neighbour sequence of sequence listing upward to telomere on chrosomal short arm and 5'-terminus of this base sequence : 32021
gcactttatgcacattgtagttctcaaatatttttaatgggagaaaaaagtcaaatggcttcacttgcagccctgacatagttccatgtggggcttttataacaaggtttgggaaaagagaggaggaaatggaagttctgctgatcttggtgccacccagagttggattctaacagggactttgtgatctagagaggaggcattaaatatacaatttggtgggaagagtgggtaggggtgtgcttgtgtgtgtgtgtgtgtgtgtgtgtgtgtgtgtgtgtgtgtgtatgtggtggtggtggtggtggtggtggagacagatggacacaaaaaggaaaatgtaagaaaagcttttaatgaaagcagagcagataccaccatcttgaaattatcatgacccagatttcctccacatgtaggagttagtcctgtgtagcaaatagttgtagtttgcat

SEQ ID NO: 22765 - DNA, 367 bp, Homo sapiens
  AC021102.3_51751
  Located on chromosome 17
  Distance between a terminus base of telomere on chromosomal short arm and 5'-terminus of this base sequence : 39358110
  Distance between 3'-terminus of neighbour sequence of sequence listing upward to telomere on chrosomal short arm and 5'-terminus of this base sequence : 116562
aactttaatatgcagttgaatgacctgagagttttgtcaaaatgcagattctgacccagtgagtctgggcaggggtccaggcttttgcctttctttctttctttctttctttctttctttctttctttctttctttctctctttctttccttctctctctctctttctttctttcacagagtctcactctgtcgcccagtctggagtgtaggtacgatcatgtctcccaggttcaagcaattctcccgcctcggcctcctgagtagctgggattacaggagcacacccccacgccaggcttatttttgtatttttgtagaaacggggtttcgccatgttggctgggcgagtctcgaactcctgacct

SEQ ID NO: 22766 - DNA, 147 bp, Homo sapiens
  HUMUT6131
  Located on chromosome 17
  Distance between a terminus base of telomere on chromosomal short arm and 5'-terminus of this base sequence : 39358169
  Distance between 3'-terminus of neighbour sequence of sequence listing upward to telomere on chrosomal short arm and 5'-terminus of this base sequence : -308
tgagtctgggcaggggtccaggcttttgcctttctttctttctttctttctttctttctttctttctttctttctttctctctttctttccttctctctctctctttctttctttcacagagtctcactctgtcgcccagtctggag

SEQ ID NO: 22767 - DNA, 376 bp, Homo sapiens
  AC004408.1_63075
  Located on chromosome 17
  Distance between a terminus base of telomere on chromosomal short arm and 5'-terminus of this base sequence : 39358841
  Distance between 3'-terminus of neighbour sequence of sequence listing upward to telomere on chrosomal short arm and 5'-terminus of this base sequence : 525
actcctgtcctcaggtagatccacccacttcagcctctcaaagtgctgggattacaggcgtgagccaccttgctcagccctttgttgttgttgttgttgttgttgttgtatttttagtagagacgaggtttcaccatgttggccaggctgctcttgaactcctgatctcaggtgatccgcccgcctcggcctcccaaagtgctgcgattacaggcactttgagagcaacagcgcccggccatggttttgcattcctaataagctttcaggtgatgcctgtgtgactggtctgtagaccacactttgaggagcaagagtttagaaaaatgagacagacacagtgagggacatcagagaggtgctttgtttaaagtga

SEQ ID NO: 22768 - DNA, 310 bp, Homo sapiens
  chr17.fa.O7frz.41353467
  Located on chromosome 17
  Distance between a terminus base of telomere on chromosomal short arm and 5'-terminus of this base sequence : 39675194
  Distance between 3'-terminus of neighbour sequence of sequence listing upward to telomere on chrosomal short arm and 5'-terminus of this base sequence : 315977
ttaacaagtggaaacaccataggaacccttttccctttccttccttccttccttcctttctttcttttctttcttttttctttctttctttcttgcttgcttgcttgctttctttttcttttctttcttttctttctttctctttctctctttctttctttctttccttccttccttccttccttccttccttccttctttctttctttctttctttccttctttccttctttttctttttttttttccctgggacagagtctcgttctgtcgcctggagtgcagtggcatgatcttggctcactgtaat

SEQ ID NO: 22769 - DNA, 303 bp, Homo sapiens
  AB025285.1_13865
  Located on chromosome 17
  Distance between a terminus base of telomere on chromosomal short arm and 5'-terminus of this base sequence : 39910465
  Distance between 3'-terminus of neighbour sequence of sequence listing upward to telomere on chrosomal short arm and 5'-terminus of this base sequence : 234961
tctttccaatgaactaattcctacagtcacttccccagcaacctgtgcctcagcctcaaggcactgtggggtaggcctcagtttgtggcctggacatcggactgtggaccagacgactcctcccgatttctgtttgttttcagtcctctgaccccaagctggctggtgaagtaggtagagggaggagactttggtgcatgcatacacacacacacacacacacacacacacacacacacacacacacacacacgtctcctgtgccccccagtctccatggctggtcaatgattgactggcatt

SEQ ID NO: 22770 - DNA, 386 bp, Homo sapiens
  AC007776.1_75537
  Located on chromosome 17
  Distance between a terminus base of telomere on chromosomal short arm and 5'-terminus of this base sequence : 40168066
  Distance between 3'-terminus of neighbour sequence of sequence listing upward to telomere on chrosomal short arm and 5'-terminus of this base sequence : 257298
  misc_feature (1)...(386): n = A,T,G or C
aggagtaagcagcttaggaagtaccaagnatcggcccctggccctgtgtgctcgccacatgttagtttttctctctcattccattgggatctctgtatctgaggtccctctgtgccctttttttgttttgttttttgtttgtttgtttgtttgtttgtttgtttgagttggagtctccctctgttgcccaggctggagtgcagtcgcacgantnctcagcttactgcaacctccgcctcctgggtttaagcaattttcctgtctcagcctcctgagtctctgggactacaggcgcctgccacaacgcctggctaatttttgtatttttagtagagacggggtttcaccatattggtcaggctggtctcgaactcctgaactcagat

SEQ ID NO: 22771 - DNA, 321 bp, Homo sapiens
  AC007776.1_62510
  Located on chromosome 17
  Distance between a terminus base of telomere on chromosomal short arm and 5'-terminus of this base sequence : 40181019
  Distance between 3'-terminus of neighbour sequence of sequence listing upward to telomere on chrosomal short arm and 5'-terminus of this base sequence : 12567
tgtgagtccaggagtttaagataagcctgggcgacataaggaggccccatctctacaaaaaaaatcaaaaaatttgccgggcatggttgtgcaagcctgtagttctagctacctgggaggctgaggtgggaggatcgcttgggccagggaggttgaggctgcagtgagctgtaatcaccccactgcagtccagcctggatgacagagtgagaccctgtcctcgaaaaataaataaataaataaataaataaaattgatatggtttggctctgtctgcccacccaaatctcatgttgaattgtgattctgagtgttggaggt

SEQ ID NO: 22772 - DNA, 79 bp, Homo sapiens
  HUMUT188
  Located on chromosome 17
  Distance between a terminus base of telomere on chromosomal short arm and 5'-terminus of this base sequence : 40226809
  Distance between 3'-terminus of neighbour sequence of sequence listing upward to telomere on chrosomal short arm and 5'-terminus of this base sequence : 45469
tgcagagggaggcagtgggagtgtgtgtgtgtgtgtgtgtgtgtgtgtgaccagggatggcatctctgttctgtcatca

SEQ ID NO: 22773 - DNA, 234 bp, Homo sapiens
  DISD22_0010850
  Located on chromosome 17
  Distance between a terminus base of telomere on chromosomal short arm and 5'-terminus of this base sequence : 40300831
  Distance between 3'-terminus of neighbour sequence of sequence listing upward to telomere on chrosomal short arm and 5'-terminus of this base sequence : 73943
tagacgtaatccgggtcggccgcaaacgtgccgcaggcctaggccccgcccagtgccccgcccctcccccaacacacacacacacacacacacacacacacaccccaacacacacacacacaccccaacacacacacacacacacacacacacacacacacacacacacacacacacacacacagcgggatggccgagcgccgcacgcgtagcacgccgggactagctatccag

SEQ ID NO: 22774 - DNA, 273 bp, Homo sapiens
  DISD22_0010855
  Located on chromosome 17
  Distance between a terminus base of telomere on chromosomal short arm and 5'-terminus of this base sequence : 40384220
  Distance between 3'-terminus of neighbour sequence of sequence listing upward to telomere on chrosomal short arm and 5'-terminus of this base sequence : 83155
ctacactccggcttcgtcctgtcctgctcgccccccggcaagctctttctcgccgtcgccgccgccgccgccgccgccgccgccgccaccgccccttttgccaacccggaaatggatctgctcccaccgtccccagcgtccgcgaacaaaatggaggcgggggaaaaaggaggagagagcagggagcggagagatgcgagacgcatgcgcccctgggaagcccgccccctgccggcccacgtaaaggcggaagcggttgagtggacgccatct

SEQ ID NO: 22775 - DNA, 401 bp, Homo sapiens
  chr17.fa.O7frz.42408666
  Located on chromosome 17
  Distance between a terminus base of telomere on chromosomal short arm and 5'-terminus of this base sequence : 40643508
  Distance between 3'-terminus of neighbour sequence of sequence listing upward to telomere on chrosomal short arm and 5'-terminus of this base sequence : 259015
gctttatttcctttgtattgactactacataactatacacacacacacacacacacacacacacacacacacacacacacatagagagagacggagcctcactctgtcacccaagctggagtgcaatggcacgatctcagttcactgcaacctccgcctcccaggttcaagcagttctgcctcagcctcccgagtagctgggattacaggcacccaccacaacgcccggctaatttttgtatttttagtagtgacgaggtttcaccatgttggccaggctggtctggaactcctgacctgaaataatccacccgcctaggcctcacaaagtgctgggattataggggtgagccaccgcacctggccaattttatctttttcttatgtatcctgcttagcgt

SEQ ID NO: 22776 - DNA, 218 bp, Homo sapiens
  chr17.fa.O7frz.42594879
  Located on chromosome 17
  Distance between a terminus base of telomere on chromosomal short arm and 5'-terminus of this base sequence : 40756753
  Distance between 3'-terminus of neighbour sequence of sequence listing upward to telomere on chrosomal short arm and 5'-terminus of this base sequence : 112844
tcggatagaattccaccttgtggccgggcgcggtggctcacgcctgtaatcccagcactttgggaggccgaggtgggcagatcacttgaggtcaggagttcgagatcagcctgacccacatggtaaaaccctatctctactaaagacacacacacacacacacacacacacacacacagtcacacacacaaagccgggcgtggttcacatgcctgtag

SEQ ID NO: 22777 - DNA, 146 bp, Homo sapiens
  HUMUT186
  Located on chromosome 17
  Distance between a terminus base of telomere on chromosomal short arm and 5'-terminus of this base sequence : 40833610
  Distance between 3'-terminus of neighbour sequence of sequence listing upward to telomere on chrosomal short arm and 5'-terminus of this base sequence : 76639
ctttcactctttcagctgaagaggaaaactggctgtgtgtgtgtgtgtgtgtgtgtgtgtgtgtgtgtgtgtgtgtgtgtctcggggtggggaagaaggtgggggaggcctccatgtttgcagacaaaacaggaaatagcacgtca

SEQ ID NO: 22778 - DNA, 294 bp, Homo sapiens
  chr17.fa.O7frz.42791565
  Located on chromosome 17
  Distance between a terminus base of telomere on chromosomal short arm and 5'-terminus of this base sequence : 40949514
  Distance between 3'-terminus of neighbour sequence of sequence listing upward to telomere on chrosomal short arm and 5'-terminus of this base sequence : 115758
attactaggtcaggagatcgagaccatcctggctaacacggtgaaaccccgtccctactaaaaatacaaaaacaaaattagccgggcgtggcggcgggcgcctgtggtcccagctattggggaggctgaggcaggagaatggcgtgaacccgggaggcggagcttgcagtgaacggagatggcgccactgcactccagcctgggcgagagagcgagactctgtctcaaaaaaaaaaaaattatatatatatatatgtatatatccatcagagacatgtaaaggattaaagtacg

SEQ ID NO: 22779 - DNA, 195 bp, Homo sapiens
  D17S1299
  Located on chromosome 17
  Distance between a terminus base of telomere on chromosomal short arm and 5'-terminus of this base sequence : 41138215
  Distance between 3'-terminus of neighbour sequence of sequence listing upward to telomere on chrosomal short arm and 5'-terminus of this base sequence : 188407
gtgcattatggggaccattatggagcctactatctatctatctatctatctatctatctatctatctatctatctatcatctgtgtaaagttacatcatctttaatgaatttttttaaagtataggttttttttttggttaacaatctcttcaccttattttagtgattgatgagccatgtgtgctcaagtgcta

SEQ ID NO: 22780 - DNA, 331 bp, Homo sapiens
  AC004231.1_125730
  Located on chromosome 17
  Distance between a terminus base of telomere on chromosomal short arm and 5'-terminus of this base sequence : 41138226
  Distance between 3'-terminus of neighbour sequence of sequence listing upward to telomere on chrosomal short arm and 5'-terminus of this base sequence : -184
ggaccattatggagcctactatctatctatctatctatctatctatctatctatctatctatctatcatctgtgtaaagttacatcatctttaatgaatttttttaaagtataggttttttttttggttaacaatctcttcaccttattttagtgattgatgagccatgtgtgctcaagtgctatctcatcagggtgttgggtacatgcaagaaaaccgtgtgtgagcaggaaaaacagagaagaccatcatttcatgacttcatcttttgaaccatgataagtgattactttttgaaacactgcaggcattcctctaacagacatccttt

SEQ ID NO: 22781 - DNA, 320 bp, Homo sapiens
  AC004231.1_82681
  Located on chromosome 17
  Distance between a terminus base of telomere on chromosomal short arm and 5'-terminus of this base sequence : 41181247
  Distance between 3'-terminus of neighbour sequence of sequence listing upward to telomere on chrosomal short arm and 5'-terminus of this base sequence : 42690
catccaaagtgaattatctcaaacagctctacatcctcctctacaatcttacatacacactgtgtgtgtgtgtgtgtgtgtgtgtgtgtgtgtgtatttgagacagggtcccactctgtcactcaggctggagtacaatggtgtgatcatggctcactgcagcctcaacctttggggctcaagcaatcctctcacctcagcctcccaagtagctgggacagcagatgtatgccaccatgcccagctaattttttttgtatttttgtatagagatgtggttttgccacgttgcccaagctgttctcaaactccaggactca

SEQ ID NO: 22782 - DNA, 172 bp, Homo sapiens
  D17S800
  Located on chromosome 17
  Distance between a terminus base of telomere on chromosomal short arm and 5'-terminus of this base sequence : 41200250
  Distance between 3'-terminus of neighbour sequence of sequence listing upward to telomere on chrosomal short arm and 5'-terminus of this base sequence : 18683
atagactgtgtactgggcattgaggacagaaagatggataagacaaggtcctgtcttccagtctttcccactcctctgtgtgtgtgtgtgtgtgtgtgtgtgtgtgtgtttgtgtgtgtgtgtctgtattggggtggtgagagccagagaagaaaacctgatggatgagacc

SEQ ID NO: 22783 - DNA, 406 bp, Homo sapiens
  chr17.fa.O7frz.43156724
  Located on chromosome 17
  Distance between a terminus base of telomere on chromosomal short arm and 5'-terminus of this base sequence : 41296153
  Distance between 3'-terminus of neighbour sequence of sequence listing upward to telomere on chrosomal short arm and 5'-terminus of this base sequence : 95731
aacaaattacagatgaaattcaaggcaaggtaaagataaaagaaacatagtcaaaagaagaaaagaaaatgagatgaaggtaagtaagagagcaaccttacaggaaagagcaaacatttatattagtttatacaaataaataaataaataaataatcacatctacgattagagaaagtggttggcatataaattaacaaacctaaaaatttgaaaagctccctatggctctgattgaaagggagaattcatgatatcttctggttcctggactttccccagatttatctttgtatgaatgcctgccgaagtgtgcacccttttacttagaactgattagtatttcacttattatttaaaaagtaattcaacagacatttactgagcagttactatgtgctagtcac

SEQ ID NO: 22784 - DNA, 249 bp, Homo sapiens
  AC037482.4_122777
  Located on chromosome 17
  Distance between a terminus base of telomere on chromosomal short arm and 5'-terminus of this base sequence : 41410359
  Distance between 3'-terminus of neighbour sequence of sequence listing upward to telomere on chrosomal short arm and 5'-terminus of this base sequence : 113800
tacctatgtaacaaacctgcacgttctcctgcatgtgtatttcattttttttagaagagaaagaaaagaaggaaagaaagcaagcaagcaagaaagcaagcaagcaagaaagaaagaaagcaagcaagaaagaaagaaagaaaagaaagaaagaaagaaagaaagaaagaaagaaagaaagaaagaaagaaagaaaagaaaaagaaagaaaagaagagccttaaggtcaacctacaaactacagagttc

SEQ ID NO: 22785 - DNA, 304 bp, Homo sapiens
  AC006070.1_83381
  Located on chromosome 17
  Distance between a terminus base of telomere on chromosomal short arm and 5'-terminus of this base sequence : 41523928
  Distance between 3'-terminus of neighbour sequence of sequence listing upward to telomere on chrosomal short arm and 5'-terminus of this base sequence : 113320
aaattacctagtggttcatttctcagaacctatccccattgttaaatgacaataacaggattcatgttttggtaaaaattaaaaacaaaatttaacaaaaaaaagagagcaaaaaggaaagataaaacacagcatgtgacaaaatatttataccatatccactcaataaatgataaactcctgatacatatatatcttatataagtttatagaaaataatctccacattatctatctatctatctatctatctatctatctatctatctatctatctatacactagtcagaacatacgtccaaa

SEQ ID NO: 22786 - DNA, 177 bp, Homo sapiens
  AC003958.1_127246
  Located on chromosome 17
  Distance between a terminus base of telomere on chromosomal short arm and 5'-terminus of this base sequence : 41606076
  Distance between 3'-terminus of neighbour sequence of sequence listing upward to telomere on chrosomal short arm and 5'-terminus of this base sequence : 81844
ccatatgaaatgcttagtccagtgcttggcacagaggttcaaaaccctagccaactcctgtgtgtgtgtgtgtgtgtgtgtgtgtgtgtgtgtttagacagaatctctctctgtcgcccaggctggagtgcagtgaagtgatcttggctcactgcaacctccttccagattcaagca

SEQ ID NO: 22787 - DNA, 430 bp, Homo sapiens
  AC003958.1_46915
  Located on chromosome 17
  Distance between a terminus base of telomere on chromosomal short arm and 5'-terminus of this base sequence : 41686230
  Distance between 3'-terminus of neighbour sequence of sequence listing upward to telomere on chrosomal short arm and 5'-terminus of this base sequence : 79977
aggtcaggagttcgagaacatcctggccaacatggagaaactctgtctgtactaaaaatataaatattagctgggcgtggtggcaggcacctataatcccagctactcaggaggctgagacaggagaatcgcttgaacccgggaggcggaggttgcagtgagccaagatcacaccactgcataccagcctgggtgacaagagtgaaactctgtctcaaaaataaataaataaataaataaataaataaataaataaataaataaataaattttatagtagaattaaaagagtgatttacctaccaccattatagtattacagtagtctatatttatcagtatatttacatttaccagcaagttttatactttcacatgcatttatattactgtttaacatccttttgttccaacttaaagaacttccttt

SEQ ID NO: 22788 - DNA, 226 bp, Homo sapiens
  chr17.fa.O7frz.44129730
  Located on chromosome 17
  Distance between a terminus base of telomere on chromosomal short arm and 5'-terminus of this base sequence : 42031780
  Distance between 3'-terminus of neighbour sequence of sequence listing upward to telomere on chrosomal short arm and 5'-terminus of this base sequence : 345120
gagacaggtagaaatttagacgtacacaagccacacacacacacacacacacaaccttctatgctcacacctcagggatatacacttgcgggtgcagattcagatacacaaacaccagctttctctaatacacgcgcgcgcacacacacacacacacacacacacacacacacacacccttcttcctgcctcttcagcctcaggtagcctaagacataaccacttc

SEQ ID NO: 22789 - DNA, 198 bp, Homo sapiens
  Z66963
  Located on chromosome 17
  Distance between a terminus base of telomere on chromosomal short arm and 5'-terminus of this base sequence : 42227219
  Distance between 3'-terminus of neighbour sequence of sequence listing upward to telomere on chrosomal short arm and 5'-terminus of this base sequence : 195213
ggcaatttctgtgtatgcgggggggtgtgtgtgtgtgtgtgtgtgtgtgtgtgtgtgtgtgtgtgtgtgtgtgtgtgtatgtgtgtttggggtttgtttgttttttgagacagagtctcgctgtgtcacccaggttggagtgcggtggcacaatcttggctcactgcagcctccgcctccggggttcaagtgactctc

SEQ ID NO: 22790 - DNA, 254 bp, Homo sapiens
  chr17.fa.O7frz.44247977
  Located on chromosome 17
  Distance between a terminus base of telomere on chromosomal short arm and 5'-terminus of this base sequence : 42299475
  Distance between 3'-terminus of neighbour sequence of sequence listing upward to telomere on chrosomal short arm and 5'-terminus of this base sequence : 72058
ctcaacatctgtatcagaggttagtgcgaggggacagcaaacctctgtctctttgcagttgtcagagaatcacttaaagttatttaggggtgtgcgtgtgtgtgtgtgtgtgtgtgtgtgtgtgtgtgtgtgtgtgtgtgtgatggtccatagggtcatggagttcagccttcttctggggaaggtccctgtgccacacccccattgggaggagaggcaagggggtgaaagaaggctcaagatgcattcctgaa

SEQ ID NO: 22791 - DNA, 241 bp, Homo sapiens
  AC019085.3_137641
  Located on chromosome 17
  Distance between a terminus base of telomere on chromosomal short arm and 5'-terminus of this base sequence : 42485383
  Distance between 3'-terminus of neighbour sequence of sequence listing upward to telomere on chrosomal short arm and 5'-terminus of this base sequence : 185654
tgtttactgaattatcttcctgagttggcattctgtcctgtagttgaagaactcacagagatgaaaaaaagaaagaaagaaagaaagaaagaaagaaaggttcaacgtctatcagactgatgccataagtcctgagtcatccttctaacattaatctacattctgggtatagaacctcatcatcttgttttggcacaatcataaatctttctggattgtagttagtggcatacatggtaac

SEQ ID NO: 22792 - DNA, 199 bp, Homo sapiens
  D17S1793
  Located on chromosome 17
  Distance between a terminus base of telomere on chromosomal short arm and 5'-terminus of this base sequence : 42573386
  Distance between 3'-terminus of neighbour sequence of sequence listing upward to telomere on chrosomal short arm and 5'-terminus of this base sequence : 87762
caccagttccctgcgagtctgctactggtaacaatgttcgcattctgatttgattttgttgtgtgtgtgtgtgtgtgtgtgtgtgtgtgtgtgtgtgcatacctgcgtgtgttatctctcttgtgtgaaaacccacacaattaccattcagtgagagcagtttgagcattttccagggcagatgtaaaccttgggctgg

SEQ ID NO: 22793 - DNA, 228 bp, Homo sapiens
  D17S1802
  Located on chromosome 17
  Distance between a terminus base of telomere on chromosomal short arm and 5'-terminus of this base sequence : 42579274
  Distance between 3'-terminus of neighbour sequence of sequence listing upward to telomere on chrosomal short arm and 5'-terminus of this base sequence : 5689
ggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagca

SEQ ID NO: 22794 - DNA, 401 bp, Homo sapiens
  chr17.fa.O7frz.44682835
  Located on chromosome 17
  Distance between a terminus base of telomere on chromosomal short arm and 5'-terminus of this base sequence : 42720535
  Distance between 3'-terminus of neighbour sequence of sequence listing upward to telomere on chrosomal short arm and 5'-terminus of this base sequence : 141033
cggtcttacattcttactccttctaggactctgacgacataattttctctctctctctctctctctctttctctctctctttctctctctctccctccctctctccctctctccctctctccctctccctctctcccctttctttctttcttttcttttcttttttgaggcagagtctcgctctgctgcccaggctggagtgcagtggcacaatctcggctcactgcaacctccgccttctgcctcccggggtcaagcgattctcctgcctcagcctcccgagtacctgagattacagacgcccgccatcatggccggctaatttttgtattttagtagagacagggttcggccatgttgcctaggctggtctcaaactcctaagctcaaagcaatctgac

SEQ ID NO: 22795 - DNA, 282 bp, Homo sapiens
  U34879.1_7175
  Located on chromosome 17
  Distance between a terminus base of telomere on chromosomal short arm and 5'-terminus of this base sequence : 42835330
  Distance between 3'-terminus of neighbour sequence of sequence listing upward to telomere on chrosomal short arm and 5'-terminus of this base sequence : 114394
ttggctaacatggtgaaaccccgtctctactaaaaatacaaaaaattagccgggcgtagtggcgggcgcctgtggtcccagctgctcaggaggctgaggcaggagaatggcgtgaacccaggaagcggaggttgcagtgagctgagatcgcgccactgcactccagcctgggcgacagagcgagacgccgtctcaaaataaataaataaataaataaataaatagccaactatttctgaggccagtctcggtgtccagaagtcttcaaggcaatgttaatta

SEQ ID NO: 22796 - DNA, 228 bp, Homo sapiens
  G10143
  Located on chromosome 17
  Distance between a terminus base of telomere on chromosomal short arm and 5'-terminus of this base sequence : 43217928
  Distance between 3'-terminus of neighbour sequence of sequence listing upward to telomere on chrosomal short arm and 5'-terminus of this base sequence : 382316
caacagagcaaaagcctgtctccaaataatgaatgaatgaatgaatgaatgaatgataaataaatatttgttaatcagttgatggataactggcttgtttctgctttttggctattatgaataacagtgctatgaacatttgtgtgcaagtcattgtgtggttgcatagtttcatttctcttgggtacattcttaggagtggaattgctgggagatgtgggaactcta

SEQ ID NO: 22797 - DNA, 403 bp, Homo sapiens
  chr17.fa.O7frz.45391652
  Located on chromosome 17
  Distance between a terminus base of telomere on chromosomal short arm and 5'-terminus of this base sequence : 43466544
  Distance between 3'-terminus of neighbour sequence of sequence listing upward to telomere on chrosomal short arm and 5'-terminus of this base sequence : 248388
attagaattggtatagatggcttttttttcttaactttgtatctctctctctttctctctttctttctctctttgactttgtctctctctttgactttccttttgcctctgcctcttcctctctctctgtgtgtgtgtgtgtgtgtgtctctctctctctctctctctctatccttgactctctgtctgtctcttcctgtctcttcctctctctcttttcctcttttcctctctgtctctttcctttctctctctctgctggtctttccttgcctctgccagccacttatgctgctgttctctcaaccactatgtgttgggggtggggggtctaaaaccagctctaatcaagtgtctctgtaagggaactggtctgggttccttggcttataggttaccttgt

SEQ ID NO: 22798 - DNA, 104 bp, Homo sapiens
  DISD22_0010873
  Located on chromosome 17
  Distance between a terminus base of telomere on chromosomal short arm and 5'-terminus of this base sequence : 43726980
  Distance between 3'-terminus of neighbour sequence of sequence listing upward to telomere on chrosomal short arm and 5'-terminus of this base sequence : 260033
accatagttaatggtttgatggtgtgtatcctagagtttttgtgtattgatacacacacacacacacacacacacacacacacacccgctcaacttgtagcatc

SEQ ID NO: 22799 - DNA, 235 bp, Homo sapiens
  chr17.fa.O7frz.46568688
  Located on chromosome 17
  Distance between a terminus base of telomere on chromosomal short arm and 5'-terminus of this base sequence : 43869508
  Distance between 3'-terminus of neighbour sequence of sequence listing upward to telomere on chrosomal short arm and 5'-terminus of this base sequence : 142424
cctctaaagtaaatggaaaggtggcaattcacagttgtgtgtgtgtgtgtgtgtgtgtgtgtgtgtgtgtgtgtgcgagagagagagagagagagagagagagagagagagacagacagacagacagagagagagagagacagagagagagagagagagagagagatgcaaaaggcatcagtgacctggcctagaggggcccctttctgggagtaccactgagttttatcactgt

SEQ ID NO: 22800 - DNA, 281 bp, Homo sapiens
  U41203.1_482
  Located on chromosome 17
  Distance between a terminus base of telomere on chromosomal short arm and 5'-terminus of this base sequence : 44131452
  Distance between 3'-terminus of neighbour sequence of sequence listing upward to telomere on chrosomal short arm and 5'-terminus of this base sequence : 261709
acctaaccagcttctggactgagcttctcctacactgtccacatgtccagcaatgggcagttttgaaccgagaagtcagtgatgtcaatagtttaacggttcctccatccatccatccatccatccatccatccatccatccatccatgtgtccactcatccaatactatctattgaacatgtattatgtgccaggcatcatgtggtagctgagaataaaatggtcagagaaacacatccctttctctttcttccagcttataaagcagaccataaatgaa

SEQ ID NO: 22801 - DNA, 174 bp, Homo sapiens
  D17S951
  Located on chromosome 17
  Distance between a terminus base of telomere on chromosomal short arm and 5'-terminus of this base sequence : 44238923
  Distance between 3'-terminus of neighbour sequence of sequence listing upward to telomere on chrosomal short arm and 5'-terminus of this base sequence : 107190
ggcctcccaaactgcttggattacaggcatgagccaccatgcctggcaggagtccctttttaagagcaggaaaaatattttccataagcaactcctccaacacacacacacacacacacacacacacacacacacacacacactcagagtccctccatggctcatcggggtaga

SEQ ID NO: 22802 - DNA, 255 bp, Homo sapiens
  AC015937.4_75237
  Located on chromosome 17
  Distance between a terminus base of telomere on chromosomal short arm and 5'-terminus of this base sequence : 44331551
  Distance between 3'-terminus of neighbour sequence of sequence listing upward to telomere on chrosomal short arm and 5'-terminus of this base sequence : 92454
attctggctaacatggttaaaccccgtctctactaaaaataccaaaaattagccgggtgtggtggcggaggttgcagggagtggagatcgcgccactgcactccagcctgggccacagggtgaggctccgtctcaaaacaaaacaaaacaaaacaaaacaaaacaaaacaaaacaaaacactattaagaaaataggaccagggaccaggtgcagtggcccacacctgtaatcccttcaagcactttaagagttca

SEQ ID NO: 22803 - DNA, 362 bp, Homo sapiens
  AC007993.15_133879
  Located on chromosome 17
  Distance between a terminus base of telomere on chromosomal short arm and 5'-terminus of this base sequence : 44363711
  Distance between 3'-terminus of neighbour sequence of sequence listing upward to telomere on chrosomal short arm and 5'-terminus of this base sequence : 31905
aggctttacatttagacttatgaatgaacttgagttaattttcatatacgtgtgagtaaaacaacttcttcttcttcttcttcttcttcttcttcttcttcttcttcttcttcttcttcttcttcttctccttctccttcttcttctctcctcctcctcctttcttccttcatcttcttcctttttttgggtatggatatatccaactattccagcaccatttgttgaaaagtctaccttgtccttcctctactgaattgacattgcactactttgaaatcagttaaacatatttgtgtgagtctgtttctggccttttctgttctattgacctatttatctatctttatgccaataccaca

SEQ ID NO: 22804 - DNA, 411 bp, Homo sapiens
  AC007993.15_29291
  Located on chromosome 17
  Distance between a terminus base of telomere on chromosomal short arm and 5'-terminus of this base sequence : 44468116
  Distance between 3'-terminus of neighbour sequence of sequence listing upward to telomere on chrosomal short arm and 5'-terminus of this base sequence : 104043
taagaactatttgcctaaactgaggtcatgaagattttcccctacttttctctaaagttttattattttacattgctttcccttttgagctaatttttgtataaggtatgaggtttcggttgaaattctcttttttgtgtatgaatgtttattgttcagacaccattattgggtctaggaatctatacatgtgttaaagctcataaagctgtacaccaacaaaatggtcaattttattttatgttactttagttatttatttattttattttattttatttatttatttatttatttatttatttatttattgagagagggagtctcattttgtcacccaggctggagtgcagtggcgtgatcttggcctgctgcaacctccacctcccaggttcaagtaatctcctgtct

SEQ ID NO: 22805 - DNA, 244 bp, Homo sapiens
  AC023855.3_61618
  Located on chromosome 17
  Distance between a terminus base of telomere on chromosomal short arm and 5'-terminus of this base sequence : 44468314
  Distance between 3'-terminus of neighbour sequence of sequence listing upward to telomere on chrosomal short arm and 5'-terminus of this base sequence : -213
gctcataaagctgtacaccaacaaaatggtcaattttattttatgttactttagttatttatttattttattttattttatttatttatttatttatttatttatttatttattgagagagggagtctcattttgtcacccaggctggagtgcagtggcgtgatcttggcctgctgcaacctccacctcccaggttcaagtaatctcctgtcttagcctcctgaatagctaggactacagctgt

SEQ ID NO: 22806 - DNA, 436 bp, Homo sapiens
  chr17.fa.O7frz.45852689
  Located on chromosome 17
  Distance between a terminus base of telomere on chromosomal short arm and 5'-terminus of this base sequence : 44544208
  Distance between 3'-terminus of neighbour sequence of sequence listing upward to telomere on chrosomal short arm and 5'-terminus of this base sequence : 75650
acatagacagtgtccgtattaaacacacacacacacacacacacacacacacacacacacacacgcaaataaaaagagttctttatacattctggacacaagtgctctgtaagatgtatgttttgcaaattatttctcccagtctatggcttgtcttttcattttctttatgcagcaaaacatagaaaaattttttccaggccaagagcagtggctcatgcttgtaatcccagcactttgggaggccaaggcaggcagatcacttgagcccaggagttcgaaaccagcctggtcaacatagcgaaaccccatctctacaaaaattacaaaaattagccgggcacagtaacatgcacctgtagtcccatctacttgggaggctgaggcagaggaattgcttgaacccgggaggcggaggtttcagttagccgagctt

SEQ ID NO: 22807 - DNA, 432 bp, Homo sapiens
  AC068675.2_139854
  Located on chromosome 17
  Distance between a terminus base of telomere on chromosomal short arm and 5'-terminus of this base sequence : 44668855
  Distance between 3'-terminus of neighbour sequence of sequence listing upward to telomere on chrosomal short arm and 5'-terminus of this base sequence : 124211
agtgcatgtaccactaattgacaaaggggagatgggagacgtggcagtggaaaccctggaggtgtctagttcaaccccccacaacttacaggtgagaaaaagtgagtcccagaaatgtaaaatagtttgctcaaggtcaaacagcattcattcattcattcattcattcattcaatgtgccagatacttgtatttggtctcactagagcctaagagggttcagcagaggagtggctggttgcctgcaggaacactcatctatatagagatagcatctgtaggcagcctttgatccttctctactctgagtcactgatctcttttcaccacaggccctcctgccccagtccattaccacattcagagtagcccatttccgaccaggaccccaaagctcaaagccccccaacttggtcttggttcaacattgga

SEQ ID NO: 22808 - DNA, 136 bp, Homo sapiens
  HUMUT573
  Located on chromosome 17
  Distance between a terminus base of telomere on chromosomal short arm and 5'-terminus of this base sequence : 44671789
  Distance between 3'-terminus of neighbour sequence of sequence listing upward to telomere on chrosomal short arm and 5'-terminus of this base sequence : 2502
gaggttgcagtgagttgagattgcaccatttcattccagcctgggtgacagtgtgagactctgtctcagaaaaaaaaaaaaagagaaagaaagaaagaaagaaagaaagaaagaaaagagtgaaggaggatgttcc

SEQ ID NO: 22809 - DNA, 275 bp, Homo sapiens
  AC003043.1_30829
  Located on chromosome 17
  Distance between a terminus base of telomere on chromosomal short arm and 5'-terminus of this base sequence : 44776848
  Distance between 3'-terminus of neighbour sequence of sequence listing upward to telomere on chrosomal short arm and 5'-terminus of this base sequence : 104923
acctcgtgcaagttactgaacccctgtgcctccatttctgcacctctaaaatgaggttgataatagatacctagctcaggggctattttcctaattgcaggggttaatataggtaacctgcttagaacagtgcccagcatagcttaaagattaataaatgttagctgtgaccatattgtattggaattgtttgtatgtctgtcccctccaccccaacacacacacacacacacacacacacacgacctaaactgtctaatgcagtagccactagc

SEQ ID NO: 22810 - DNA, 209 bp, Homo sapiens
  D17S1860
  Located on chromosome 17
  Distance between a terminus base of telomere on chromosomal short arm and 5'-terminus of this base sequence : 44841611
  Distance between 3'-terminus of neighbour sequence of sequence listing upward to telomere on chrosomal short arm and 5'-terminus of this base sequence : 64488
accaccgtgtctggctaattgtgtgtgtgtgtgtgtgtgtgtgtgtgtgtgtgtgtgtgtgcagagacagggttttgctatgttgcccaggctggtctcgaactcctgggctcaagcgagcttcctgccttggcctcccaaagtgctgggattataggtatgagccaccgcacccgggagacagagcttgcagtgacctgagattgcgc

SEQ ID NO: 22811 - DNA, 314 bp, Homo sapiens
  AC023855.3_15170
  Located on chromosome 17
  Distance between a terminus base of telomere on chromosomal short arm and 5'-terminus of this base sequence : 45001038
  Distance between 3'-terminus of neighbour sequence of sequence listing upward to telomere on chrosomal short arm and 5'-terminus of this base sequence : 159218
aaacaaattcacagcttgttctaggagccatgtttctgctggctttcctcagggttggccattgctgagtgtagagacagtggcctgctcctgatctctaggccaggaaggcaggaggtgggaggcctgaaaagggacagaaggtgtcaagggttaggtagggctctcaggtgaggaatgactgaggctctcgcctctagccaggtcctcctttgtttgtttgtttgtttgtttgtttgtttgtttgttttgagatccaattctagagttagctgccagagctggaaaaatcctcagatgtcatctatccaacc

SEQ ID NO: 22812 - DNA, 104 bp, Homo sapiens
  D17S930
  Located on chromosome 17
  Distance between a terminus base of telomere on chromosomal short arm and 5'-terminus of this base sequence : 45148703
  Distance between 3'-terminus of neighbour sequence of sequence listing upward to telomere on chrosomal short arm and 5'-terminus of this base sequence : 147351
ttatcgatttttaggcgagaaaaagacagacacacacacacacacacacacacacactgctttgaagtctgaaaggcatatgagtggaccgtaaggtatatggc

SEQ ID NO: 22813 - DNA, 94 bp, Homo sapiens
  D17S1861
  Located on chromosome 17
  Distance between a terminus base of telomere on chromosomal short arm and 5'-terminus of this base sequence : 45256864
  Distance between 3'-terminus of neighbour sequence of sequence listing upward to telomere on chrosomal short arm and 5'-terminus of this base sequence : 108057
aggggcagcagtcctgtagacaaaacctgtaatacacatacacacacacacacacacacacacacacacaccccattagatttcaggatgatgt

SEQ ID NO: 22814 - DNA, 274 bp, Homo sapiens
  Z67311
  Located on chromosome 17
  Distance between a terminus base of telomere on chromosomal short arm and 5'-terminus of this base sequence : 45551943
  Distance between 3'-terminus of neighbour sequence of sequence listing upward to telomere on chrosomal short arm and 5'-terminus of this base sequence : 294985
taggatacactccaaagacgggatggcctggcacagaggcccagccctgattcggagagtccgtgtgtgtgtgtgtgtgtgtgtgtgtgtgtgtgtgtgtgtgtgtgtgtgtgtggggagggggctgaaaggaaacaggatgtgttacctggcttcagcctccaaggagatagatggaggcctggggctccctgccttgagtgccccactaggcgtaaggcagaaggtagtgggtgagcaggtagaggaggctggcaatggcagcgagccctgt

SEQ ID NO: 22815 - DNA, 252 bp, Homo sapiens
  AC002117.1_26462
  Located on chromosome 17
  Distance between a terminus base of telomere on chromosomal short arm and 5'-terminus of this base sequence : 45631892
  Distance between 3'-terminus of neighbour sequence of sequence listing upward to telomere on chrosomal short arm and 5'-terminus of this base sequence : 79675
ttgtcgttagatatttcctctgagaggtctttcctgacacacacacacacacacacacacacacacacacacacacacacacacacgtcccatagcaccctgtacttcattcttactggccctcaccatgccgggtggcatgtgcatccttgctcatctctttggtgtccatgatggtgaggacctgtgtctgtttcattcgccagcccctgccacagaactggcacattctaggattcagtgaacacttgg

SEQ ID NO: 22816 - DNA, 414 bp, Homo sapiens
  AC003665.1_70639
  Located on chromosome 17
  Distance between a terminus base of telomere on chromosomal short arm and 5'-terminus of this base sequence : 45782274
  Distance between 3'-terminus of neighbour sequence of sequence listing upward to telomere on chrosomal short arm and 5'-terminus of this base sequence : 150130
ggaattctaggaaagctgctagcataatacagggatgtctaaacccttgtattcctaaagtgatcaaaactaaaaataaaaacaaaatatgtctcagtactgaaatgatggagggtgacacccacaaatcatacacaaccagagaggagctcctcatgggtcgaattcacatcagactgtggtgtgtggcaaaatcaacctccctgctttatacaagacacacacacacacacacacacacacacactcacacacacctttaccaagaaaatgtcagaatatataggaattagaaagaggaaattctggtttatcttcactatcagctacttgctggtaaggctgatgctgatgaaatgggcttttgaagatttacgagcactctggaacccctttctaatgccatagctcatc

SEQ ID NO: 22817 - DNA, 181 bp, Homo sapiens
  D17S1859
  Located on chromosome 17
  Distance between a terminus base of telomere on chromosomal short arm and 5'-terminus of this base sequence : 45820347
  Distance between 3'-terminus of neighbour sequence of sequence listing upward to telomere on chrosomal short arm and 5'-terminus of this base sequence : 37659
ccttcatttcacttgagagtttgagaggttttgcttgtcttgatgtgtgtgtgtgtgtgtgtgtgtgtgtgtgtgactaaattctataagctaaaatttaaccattttcattaagaaaaagccttttcagtatggttccaatttataaaactatttctgtctaacccacctaatgttaatg

SEQ ID NO: 22818 - DNA, 171 bp, Homo sapiens
  D17S806
  Located on chromosome 17
  Distance between a terminus base of telomere on chromosomal short arm and 5'-terminus of this base sequence : 45833003
  Distance between 3'-terminus of neighbour sequence of sequence listing upward to telomere on chrosomal short arm and 5'-terminus of this base sequence : 12475
agctttactgcactagcccccatacacacacacccacacacacatacacacacacacacacacacacacacacacacacacacacacacacacaccagacatatgatctcaaagtaagaccggaaaggaaacttggcgactgcttctccatgtcaccaaatcccaatctcc

SEQ ID NO: 22819 - DNA, 433 bp, Homo sapiens
  chr17.fa.O7frz.50999465
  Located on chromosome 17
  Distance between a terminus base of telomere on chromosomal short arm and 5'-terminus of this base sequence : 45994494
  Distance between 3'-terminus of neighbour sequence of sequence listing upward to telomere on chrosomal short arm and 5'-terminus of this base sequence : 161320
ttaatctaggctatttctgacactgttgattttccttttccccttaggtgaggcaggcgactaatcagattgtgatgaattgtgctgatattgatattattacagcttcatatgcaccagaaggagatgaaggtaagagctgttttccattttaatttgctgtctgcatgtgcatatgtggggtgtgtgtgtgtgtgtgtgtgtgtgtgtgtgagagagagagagagagagacattttcaggttaagacttcaatgtttgttactttagaaatgggtaaattcagctgggtgaagtggctcacgcctgtaatcgcagcactttgggaggctgaggcgagcagatccctgagcccatgagtttgagaccagcctgggccacgtggcgaaacaaaaacaaacaaacaaacagaaatattagctaggcatagtggt

SEQ ID NO: 22820 - DNA, 344 bp, Homo sapiens
  chr17.fa.O7frz.47915850
  Located on chromosome 17
  Distance between a terminus base of telomere on chromosomal short arm and 5'-terminus of this base sequence : 46085927
  Distance between 3'-terminus of neighbour sequence of sequence listing upward to telomere on chrosomal short arm and 5'-terminus of this base sequence : 91000
caagtcctaggcttaattcaacccctgacttgctgtgtgacctgggattcttctcactgtatatctgggcctcttgttcttttatcctttctaagtctcctctccagtgggttcttgggcacctcttttcctgtcccagtcttcccttcaaacttgtccctctcttcccttccattctgccccagtgtgcacacacacatgcacactcacaaatgttctctgtctcttctgtctccttccttccttccttccttccttccttccttccttccttccttccttccttcctttcccttcttccttccttccttccttctcataagatgccttaaattagatgcatc

SEQ ID NO: 22821 - DNA, 436 bp, Homo sapiens
  AC004703.1_71122
  Located on chromosome 17
  Distance between a terminus base of telomere on chromosomal short arm and 5'-terminus of this base sequence : 46216177
  Distance between 3'-terminus of neighbour sequence of sequence listing upward to telomere on chrosomal short arm and 5'-terminus of this base sequence : 129906
ttgaggcgtacaatctaaatatttctcagaggccgggtgcggtggctcacacctgtaatcccaacactttgggaggccgaggcaggcggatcatgaggtcaggagttcaagaccaacctggccaacgtggtgaaaccctgtctctactaaagatacaaaaattcgccgggcgtggtggagggcgcctgtaatcccagctactcaggagcttgaggcaggagaatcgcttgaacccaggaggcagagatcacaccattgcactccagcctgggcaacaagagcaagactctgtttcaaaaaaataacataacataacataacataacataacataacataacataacataacataacataaataacataaataacataaataaaataaaataaaataaaataaaataaaacaaatatttctcagaaattactccatg

SEQ ID NO: 22822 - DNA, 113 bp, Homo sapiens
  DISO7_10004226
  Located on chromosome 17
  Distance between a terminus base of telomere on chromosomal short arm and 5'-terminus of this base sequence : 46703069
  Distance between 3'-terminus of neighbour sequence of sequence listing upward to telomere on chrosomal short arm and 5'-terminus of this base sequence : 486456
gagtcttgcaaatagtaggtgctaaaatcctgtcttgaaaaaaaaaaaaaaatatatatatatatatatatatatatatatatatgaagagatgagatcttcaattgtacaga

SEQ ID NO: 22823 - DNA, 274 bp, Homo sapiens
  D17S1834
  Located on chromosome 17
  Distance between a terminus base of telomere on chromosomal short arm and 5'-terminus of this base sequence : 46876852
  Distance between 3'-terminus of neighbour sequence of sequence listing upward to telomere on chrosomal short arm and 5'-terminus of this base sequence : 173670
tcagatggtatggacgtgcagcctggaacagccccctggaagacaaacagccaagtcattaatcagttgctttacccctgtactctgtgtgtttgtgtgtgtgtgtgtgtgtgtgtgtgtgtgtgtgcgtttgttgggggatggggtaagggtattgtgtgcctgtgagtatgtgcccagccctccagaccagggtcctcaaagggacctgccccagtgtgaaggaaagaccccgcccagcaatgagggagtggccaggacatctttccacagc

SEQ ID NO: 22824 - DNA, 240 bp, Homo sapiens
  D17S931
  Located on chromosome 17
  Distance between a terminus base of telomere on chromosomal short arm and 5'-terminus of this base sequence : 46889590
  Distance between 3'-terminus of neighbour sequence of sequence listing upward to telomere on chrosomal short arm and 5'-terminus of this base sequence : 12464
aacatttgcttggggctccacaaaacctagatacagtcctgtcaacgtgatagataaataggtaggtatgtaggtattaggttggtgcaaaagtaattatggtttgccattaaaagtaattgcaaaaccacaattatttttgcaccaacctgatagagatatagcaggcagacacacacacacacacacacacacacacacacacacacacacatacaatttcccagagcactactcacc

SEQ ID NO: 22825 - DNA, 432 bp, Homo sapiens
  AC002558.1_23805
  Located on chromosome 17
  Distance between a terminus base of telomere on chromosomal short arm and 5'-terminus of this base sequence : 47146116
  Distance between 3'-terminus of neighbour sequence of sequence listing upward to telomere on chrosomal short arm and 5'-terminus of this base sequence : 256286
gaaacaggactatcgaaacaggacaggacaggacaggacaggaaaggaaaggagagagagaaagaaagaaagagagaaagagagagagaggaaggaaggaaggaaggaaggaaggaaggaaggaaggaaggaaggaaggaaggaagtaagttgtagcagcactactgaagttcctcttcttacaaacaggtttggcttcaaaattggaaaggtcttttgagtgtaagtccaaaataattaagaggggtttaaccttgcatcctccagatacatttacatcaaacagaaaggtaaattagtctttcaaagcttttaaaccagatagacgcctcttcttcacgctgatttataatctaaataagcagcctttctaaaatggaccaattttgacaaatttaaaatttgttgaggtgactgttctttacctagcct

SEQ ID NO: 22826 - DNA, 192 bp, Homo sapiens
  X58851.1_1230
  Located on chromosome 17
  Distance between a terminus base of telomere on chromosomal short arm and 5'-terminus of this base sequence : 47179665
  Distance between 3'-terminus of neighbour sequence of sequence listing upward to telomere on chrosomal short arm and 5'-terminus of this base sequence : 33117
atagcacttaacagttcctggtactgatagtagtaagcactacacacacacacacacacacacacacacacacacacacagagcacagaatgagttagaggtaaagtgaaaactaaaccccaagttttctgaccctcagtctcctcgactttctaccacatctctctgcttctctcctaggtgcctaggcat

SEQ ID NO: 22827 - DNA, 472 bp, Homo sapiens
  AC064817.4_80427
  Located on chromosome 17
  Distance between a terminus base of telomere on chromosomal short arm and 5'-terminus of this base sequence : 47205298
  Distance between 3'-terminus of neighbour sequence of sequence listing upward to telomere on chrosomal short arm and 5'-terminus of this base sequence : 25441
cactcttcagtaatcagctcagtctatctgtgctctgtagtctaatgaaaaaagctagaagttggctgggtgtagtggctcacgcctgtaatcctagcacttttggaagcccaggtggtggatcacttgaggtcaggagttcgagaccagcctggctaacatggtgaaaccccatctctactaaaaacacaaaaattaactgggcatggtggcgcatgtctgtaatcccagctacctgggaggctgaggcaggagaatcgcttagacctgggaggtggaggttgcagtaagccgagatcatgccactgcactacagcctgggcaatagagtgagactgtgtctcaaaacaaacaaacaaacaaacaaacaaacaaaagctagaagtcaaagatccagcattaaaagcttggttaccagttggaacgtggagagaactctgtatagttagtttcataatcatgtccttaatgc

SEQ ID NO: 22828 - DNA, 393 bp, Homo sapiens
  chr17.fa.O7frz.50763366
  Located on chromosome 17
  Distance between a terminus base of telomere on chromosomal short arm and 5'-terminus of this base sequence : 47361273
  Distance between 3'-terminus of neighbour sequence of sequence listing upward to telomere on chrosomal short arm and 5'-terminus of this base sequence : 155503
gcttcctactttacctatcctaatcaattagagaaaacctatttaatttgttctagagtttgtgtgtgtatatgtgtgtatgtgtatatattgtgtgtgtttgtatattataaaacttattgagagaggggtagaatatacaaacacaatatacacaaacaatattcacacacaatatacacgcatacacaacctctgtttttttcatacacacacacacacacacactttctctctctctctctgtgttttttcatctttttcttcaagtgatttaaggtgccacctctactttgaagttttctgattaaaccagatgaattccagttagccaaccttcttaagagttcagtatatttgtaagtaatttcctttaagaatgctttaattgca

SEQ ID NO: 22829 - DNA, 101 bp, Homo sapiens
  D17S920
  Located on chromosome 17
  Distance between a terminus base of telomere on chromosomal short arm and 5'-terminus of this base sequence : 47756083
  Distance between 3'-terminus of neighbour sequence of sequence listing upward to telomere on chrosomal short arm and 5'-terminus of this base sequence : 394417
actcacccagatgattgcttttttctaatttgttcacctagggtgtgtgtgcgtgtgtgtgtgtgtgtgtgtgtgtgtgtgttttctgatccatgcagaag

SEQ ID NO: 22830 - DNA, 177 bp, Homo sapiens
  D17S791
  Located on chromosome 17
  Distance between a terminus base of telomere on chromosomal short arm and 5'-terminus of this base sequence : 47797561
  Distance between 3'-terminus of neighbour sequence of sequence listing upward to telomere on chrosomal short arm and 5'-terminus of this base sequence : 41377
gttttctccagttattccccggtccctaccccatcacacacacacacacacacacacacacacacacacacacacacacacacaccccagcccactcggtcttccaaagggccgggcacatgctaggtattcatgattctggaggaaaggaatgaagaactcttccaaaggacgagc

SEQ ID NO: 22831 - DNA, 470 bp, Homo sapiens
  chr17.fa.O7frz.51191636
  Located on chromosome 17
  Distance between a terminus base of telomere on chromosomal short arm and 5'-terminus of this base sequence : 47866311
  Distance between 3'-terminus of neighbour sequence of sequence listing upward to telomere on chrosomal short arm and 5'-terminus of this base sequence : 68573
ctagatttgatgtggccatagcaaagctttcagcctcatcatgtttgtgatttccaaagtgtgtgtgtgtgtgtgtgtgtgtgtgtgcacgtgcatgtgtgcacaagaggaggagagggctccagccctgagcgctggctgccttgggctggttaatggagacaggtagctgcatgtggatatccaagaatgcttctcttgcatacctgtgtgaacgtgtggacccaggaccagctgtggggctgcccaggaatgtagacacccatgggggaacagtgggggtctgtgtgtcaccaaatgcctggacttgggctgtagtgtgtgtgccccatggagcccgtgtccgagcccaggaaggagtgcttccgtcaccacacatgtgtttgtatgatactttacatgtttactgccataaaaaggccacaaaccagggttataagctgaaaacaacacttgtttcctgagtacct

SEQ ID NO: 22832 - DNA, 326 bp, Homo sapiens
  AC021211.4_51227
  Located on chromosome 17
  Distance between a terminus base of telomere on chromosomal short arm and 5'-terminus of this base sequence : 48359765
  Distance between 3'-terminus of neighbour sequence of sequence listing upward to telomere on chrosomal short arm and 5'-terminus of this base sequence : 492984
tagtttgagttggattggtattagttctttaaaagtttggtagaattcagaggtgaagccctcaggtcccaggcttttctttactgaaagactttattattatgatgatgatgattatgattattattattattagggctttaatcttgttacttgttattggtagttaatgttttgcatttcttcatggttcaatcttggtaggtcgtatgtatctagaaatttgtccatcgctgcgagattttccaatttatcggcatatagttgttcatagtctccacttgtgaccctttgaatttctgcagtatcagtttgtaatgtctcgc

SEQ ID NO: 22833 - DNA, 87 bp, Homo sapiens
  D17S1785
  Located on chromosome 17
  Distance between a terminus base of telomere on chromosomal short arm and 5'-terminus of this base sequence : 48550194
  Distance between 3'-terminus of neighbour sequence of sequence listing upward to telomere on chrosomal short arm and 5'-terminus of this base sequence : 190103
gtcctcacactgcctttcgtgtgtgtgtgtgtgtgtgtgtgtgtgtgtgtgtgttgtggagggcaagggaggtggttctgaagtgtc

SEQ ID NO: 22834 - DNA, 452 bp, Homo sapiens
  chr17.fa.O7frz.51770249
  Located on chromosome 17
  Distance between a terminus base of telomere on chromosomal short arm and 5'-terminus of this base sequence : 48608026
  Distance between 3'-terminus of neighbour sequence of sequence listing upward to telomere on chrosomal short arm and 5'-terminus of this base sequence : 57745
tgtcaggatgtcaggctagggcagatgttgggatggtaagatggggtggggcaaagcctcctgaagaaatgaagggtcgggtatggtggctcatgcctgtaatcccagcattttgggaggccgaggcaggcggatcccttgagcccagggatttgagaccaacctaggcaacatagcaaaaccccatctctacaataaaataaaataaaataaaataaatagctgggtgtggtggcgtgtgcctgtaatcccagctactcaggaggctgaggcaagagaattgctttagcctgggaggtggagggtgcagtgagtggtgtttgtaccactgctttccagcatgtagcaagagagtgagactcaactggaaggaaggaaggaaggaagggagggaggggaaagaaggaaaggagtgctaatttgcggacttaggataagtagcagttagtcca

SEQ ID NO: 22835 - DNA, 115 bp, Homo sapiens
  DISD22_0010919
  Located on chromosome 17
  Distance between a terminus base of telomere on chromosomal short arm and 5'-terminus of this base sequence : 49040239
  Distance between 3'-terminus of neighbour sequence of sequence listing upward to telomere on chrosomal short arm and 5'-terminus of this base sequence : 431761
ctactcggcctatggctgcatacacacacacacacacacacacacacacacatatatatacacacatatatgtagacacatacatatatatatatttcccagccaccttacagtt

SEQ ID NO: 22836 - DNA, 359 bp, Homo sapiens
  AC009789.20_11012
  Located on chromosome 17
  Distance between a terminus base of telomere on chromosomal short arm and 5'-terminus of this base sequence : 49238119
  Distance between 3'-terminus of neighbour sequence of sequence listing upward to telomere on chrosomal short arm and 5'-terminus of this base sequence : 197765
tgtggtctcagttactcaggaggctgaggcaggagaattgcttgaacctgggaggtggaggctacagtgagccgagatcacgccattgaactccagcctgggtgacacagtgagattctgtctcaaaaaacaaaaaacgaaaaacgaacaaaaacttatctatctatctatctatctatctatctatctatctatctatctatctgtgtgtgtgtgtgtgtgataggaggagaatagcatttaggctatattttcatgtaacatagcaccatatattatacaatataatatgtactttatcatatgcaaatttcattgagaattgagaagattggctctgtttaggcaaaggattttct

SEQ ID NO: 22837 - DNA, 146 bp, Homo sapiens
  D17S1827
  Located on chromosome 17
  Distance between a terminus base of telomere on chromosomal short arm and 5'-terminus of this base sequence : 49263220
  Distance between 3'-terminus of neighbour sequence of sequence listing upward to telomere on chrosomal short arm and 5'-terminus of this base sequence : 24742
gtgagtggagattgcaccattgcactccagcctgggcaacaagagcgaaactccgtctcaaaacacacacacacacacacacacacacacacacacacacacacacacacacacacacactgaacaatgacagccttagcccagtg

SEQ ID NO: 22838 - DNA, 473 bp, Homo sapiens
  chr17.fa.O7frz.52495934
  Located on chromosome 17
  Distance between a terminus base of telomere on chromosomal short arm and 5'-terminus of this base sequence : 49386069
  Distance between 3'-terminus of neighbour sequence of sequence listing upward to telomere on chrosomal short arm and 5'-terminus of this base sequence : 122703
catggctacacttagttgaaagaaaggctagaaatgtgtcatcaattgaacagcaatgactatattacaactctattatagttccataactccttatctccaagttctgaaatctcaaaagctgtgaaaattggaaaggtgtgtgtgtgtgtgtgtgtgtgtgtgtgtgtgtgtgtgtgtgtgttgttgttgttgttgttgttgttgagacagggtctttctctgtcacccaggctggagtgcagtggcatgatcacggctcactgcagcctcaacctcccaagctcaagggattctcccacctcggactcccaagcagctagggctacaggtgtgtgccattgtgcccagctaattttcttacttttatagagactggggtcttgctatatggtccaggctggacttgaactcccaggctcaagcgattgtcctgctttggcctcccaaaatgttagaattacaggcatgag

SEQ ID NO: 22839 - DNA, 467 bp, Homo sapiens
  AC002344.1_19888
  Located on chromosome 17
  Distance between a terminus base of telomere on chromosomal short arm and 5'-terminus of this base sequence : 49460331
  Distance between 3'-terminus of neighbour sequence of sequence listing upward to telomere on chrosomal short arm and 5'-terminus of this base sequence : 73789
tagtctcaaactccttgagcatcctcccacctcagtctcccaaagtgctggaattacaggtgtgagccacacacccggcctgaagtcacccttttaaggctagtaagagttacccatgctgtctgaggcggcctaatccagtgtggggtaagccaggcaagtggttcccaaacctgactaagcatcagaactccctggcacagctttttatttttattttatttaagttatttatttatttatttatttatttatttatttatttatttatttattttgagatggagtttcactcttgttgcccaggctggagggcaatggcgcgatcttggctcaccgcaacctctgcctcaagcgattctcctgcctcagcctcccgagtagctgggattacaggtgcctgccatcacacccggctaagtttgtatttttagtagagatggggtgtctccatattggtcaggctg

SEQ ID NO: 22840 - DNA, 165 bp, Homo sapiens
  chr17.fa.O7frz.52754289
  Located on chromosome 17
  Distance between a terminus base of telomere on chromosomal short arm and 5'-terminus of this base sequence : 49746513
  Distance between 3'-terminus of neighbour sequence of sequence listing upward to telomere on chrosomal short arm and 5'-terminus of this base sequence : 285715
aattatcatggatgctaccatacctaggaatgcagaatcaggtgttctaagcactctgttaacattcccaacacacacacacacacacacacacacacacacacacacacacactttgtttgtcccaccactttctcattcctttattcagtaagcaggttacca

SEQ ID NO: 22841 - DNA, 367 bp, Homo sapiens
  AC025556.4_49658
  Located on chromosome 17
  Distance between a terminus base of telomere on chromosomal short arm and 5'-terminus of this base sequence : 49790266
  Distance between 3'-terminus of neighbour sequence of sequence listing upward to telomere on chrosomal short arm and 5'-terminus of this base sequence : 43588
gttagcaaagacattccagacagatatgatgccaaaagcacaatcactaaaaggctgagttgagccaggtgtggtggctcatgcctgtataccaagcgctttgggaggctgaggcaggaagggaggattgcttgaggtgaggagttccacaccagcctgggcagcatagtgtaccccatctccataaaaaaaatacaaaaaaaaaattacaaaaagatactgttaagagaatgggaagataagatacagtgagaccctgtctctataaaaaaaaaaagaacaaaagaaagaaaggaaggaaggaaggaaggaaggaaggaaggaaggaaggaaggaaggaaaaataaaccaaactgataaattgaac

SEQ ID NO: 22842 - DNA, 291 bp, Homo sapiens
  chr17.fa.O7frz.1300837
  Located on chromosome 17
  Distance between a terminus base of telomere on chromosomal short arm and 5'-terminus of this base sequence : 50018974
  Distance between 3'-terminus of neighbour sequence of sequence listing upward to telomere on chrosomal short arm and 5'-terminus of this base sequence : 228341
aagccataaagcagaagttctcaaccctggctgcagattggaagagcttaaacacacacacacacacacacacacacacacacacacacacacacagtgtctgggctccaccttagtctaattggatcaaaattggatcaacagcactggagaagtagattctggcattgctactgctgtttttaaaaccccgcttttgctggtgatgctaacatgtaaaaaggattgagcatgcctgcagtaatgaatggacaaacaggaggtggagtgttccaaagaataggtagcact

SEQ ID NO: 22843 - DNA, 192 bp, Homo sapiens
  D17S1868
  Located on chromosome 17
  Distance between a terminus base of telomere on chromosomal short arm and 5'-terminus of this base sequence : 50136260
  Distance between 3'-terminus of neighbour sequence of sequence listing upward to telomere on chrosomal short arm and 5'-terminus of this base sequence : 116995
agtcaaattcagcctgggcaacatagtgagaccttgtgtctaaaaacaaaaatgtgtgtgtgtgtgtgtgtgtgtgtgtgtgtgtgtgtgtgtataaaaatacatttctgcctcgacatcctcaattcagttgacaagatcaaccctcacaaagattgcatctaatttcttcattgcttggatggattttgc

SEQ ID NO: 22844 - DNA, 329 bp, Homo sapiens
  AC004797.1_65968
  Located on chromosome 17
  Distance between a terminus base of telomere on chromosomal short arm and 5'-terminus of this base sequence : 50371639
  Distance between 3'-terminus of neighbour sequence of sequence listing upward to telomere on chrosomal short arm and 5'-terminus of this base sequence : 235187
ttcatgccaggtctagaactagttttcaacactttctgccacactagtgttttgcagaacctgtgagtacgtgtgcgtgagtgtgcatgtgtgtgtgcgtgtgtgtgtccttaggagcaaatcctttctccaaataaaataatacctagaaacacacacacacacacacacacacagaggcaaaataaaagcagaactcctcgtgttgaagtgggggtggggtgaacacggacctcactgagccttccttgccttattgtaggccctgtggcacctccttgggacccaagagtggaaagaccacagtctcatcttaggtgacatcctag

SEQ ID NO: 22845 - DNA, 432 bp, Homo sapiens
  AC015656.4_100631
  Located on chromosome 17
  Distance between a terminus base of telomere on chromosomal short arm and 5'-terminus of this base sequence : 50437723
  Distance between 3'-terminus of neighbour sequence of sequence listing upward to telomere on chrosomal short arm and 5'-terminus of this base sequence : 65755
aaggctgtttgaagtatttaagtaatttacccaaggtttcccaagctattcagtggcagagtcagaatacaaacccagattattattattattattattattattatttttgacacaggctttctctctgtcacccaggctggagtgcagtggtgcaatcacagctcactgcagcctcgacctcccaggcttaagcaatcctgccacctcagcctgagtagctgggaccccaggcatgtgccaccatgcctagctattttttaaattttttgtagagtcagggtctcgctatgtggcccaggctggtcttgaacttgtgggctcaagtgatccacctgcctcaccttcccaaactgctgatattacaggcatgagccaacaagcccggctttttgtttgtttgtttgttttgacaggatttaatactattgc

SEQ ID NO: 22846 - DNA, 196 bp, Homo sapiens
  D17S797
  Located on chromosome 17
  Distance between a terminus base of telomere on chromosomal short arm and 5'-terminus of this base sequence : 50518790
  Distance between 3'-terminus of neighbour sequence of sequence listing upward to telomere on chrosomal short arm and 5'-terminus of this base sequence : 80635
accttacaggttgcaaagtgctgtataaatgtgaagggttagtatatatgagttcttctcaacactgcctttcctccaccacacacacacacacacacacacacacacacacaccctctgctgaagtccaggggttactttaatgctccccaaagcaccccaagtctttgttcatgccacctccactgctcagaag

SEQ ID NO: 22847 - DNA, 338 bp, Homo sapiens
  chr17.fa.O7frz.53790288
  Located on chromosome 17
  Distance between a terminus base of telomere on chromosomal short arm and 5'-terminus of this base sequence : 50708001
  Distance between 3'-terminus of neighbour sequence of sequence listing upward to telomere on chrosomal short arm and 5'-terminus of this base sequence : 189015
gaacagatggactattcaataaaggatgcttggtcactagattatccttatggaaagaaaattggatccatatttcagggttatctttatgaaaaaaaaaagtgatctctacttcacaggaaacatcgaaataaactccaggtggattagagacctaaaggtgaaaagcaaacttttacaacttttagaagaaaatataagatgaaaccattacctccatataggggaggattccttcatgaagacagacacacacacacacacacacacacacacacacacacacacacacacccatataggaacaatataataaatctgattgcatgaaaatctaa

SEQ ID NO: 22848 - DNA, 456 bp, Homo sapiens
  AC009720.2_43489
  Located on chromosome 17
  Distance between a terminus base of telomere on chromosomal short arm and 5'-terminus of this base sequence : 50720098
  Distance between 3'-terminus of neighbour sequence of sequence listing upward to telomere on chrosomal short arm and 5'-terminus of this base sequence : 11759
  misc_feature (1)...(456): n = A,T,G or C
gtcaccattaagaaagtgaaaaggggccgggcatggtggctcacgcctgtaatcccagcactttgggagcaaggcaggtggatcacctgaggtcaggagttcgagaccagcctgaccaacatggtgaaaccccatctctactaaaaatacaaaattagctgggcgtggtggtgcatngcctgtaatcccagctagttgggagactgaggcaggacctccttgaacctgggaggcagaggttgcagttagccgagatcgcgccattgcacttcagcctgcgcaacaaaagcgaaactgtctcaataaataaataaataaataaataaataaaaagaaagtgaaaaggaaagctgcagagttgcaggagaaatttgcaccacaaaaggcttgtatccagagcatataaagaacactaatagatcaacaggaaagagacagataactcagtagaaatgg

SEQ ID NO: 22849 - DNA, 265 bp, Homo sapiens
  AC015795.4_168322
  Located on chromosome 17
  Distance between a terminus base of telomere on chromosomal short arm and 5'-terminus of this base sequence : 50879764
  Distance between 3'-terminus of neighbour sequence of sequence listing upward to telomere on chrosomal short arm and 5'-terminus of this base sequence : 159210
aggagaactgcttgaacctgggaggcggaggttgcagtgagccgagatcgtgccattgcgctccatcctgggtgacaaagcgagactgtctcaaaaaaaaaaaaaaataaaataaataaataaataaataaataaataaataaataaataaaataaaagggctccaaactgtctgtggagtaacggtaagcccaggcaggtctagtcagaacacttgagctagagtcaaacgtgatagtgtcagtaagaactccataaccagacc

SEQ ID NO: 22850 - DNA, 172 bp, Homo sapiens
  D17S1795
  Located on chromosome 17
  Distance between a terminus base of telomere on chromosomal short arm and 5'-terminus of this base sequence : 50968866
  Distance between 3'-terminus of neighbour sequence of sequence listing upward to telomere on chrosomal short arm and 5'-terminus of this base sequence : 88837
agtgccagagatataccgtgtgttaaataagtatttcttacacacacacacacacacacagacacacacacacacacacacacacacacacacacttcggaggtctgccaggccagggctcatagccttgaatctacccatggtagagagtcagacaacttgccttgcagac

SEQ ID NO: 22851 - DNA, 328 bp, Homo sapiens
  DISO7_00003724
  Located on chromosome 17
  Distance between a terminus base of telomere on chromosomal short arm and 5'-terminus of this base sequence : 51004130
  Distance between 3'-terminus of neighbour sequence of sequence listing upward to telomere on chrosomal short arm and 5'-terminus of this base sequence : 35092
caaatggaatctgagctgttcccttcccaaatcccctgggcagggtcctcttctttggggtggcactcagctggctgggtggtctgggaaaagctgctctcttaaaatcgtgtgtgtgtgtgtgtgtgtgtgtgtgtgtgtgtatgtgtgtgtgtgtgtgtgtgttggagggaagggagcattcttctcctctccttgtgggaagcttcctgcagaaaagagaaaattctggaaaggaccaaggaagctctggaaaattagcaccagtgtttcctgagagttgggggtggtggtctcaggacacttcctgcctcccaggtcttcatgt

SEQ ID NO: 22852 - DNA, 302 bp, Homo sapiens
  AC073970.1_73302
  Located on chromosome 17
  Distance between a terminus base of telomere on chromosomal short arm and 5'-terminus of this base sequence : 51323266
  Distance between 3'-terminus of neighbour sequence of sequence listing upward to telomere on chrosomal short arm and 5'-terminus of this base sequence : 318808
ctcagacctatgcaggacttatgaggtgtataatgaatgacagaaacagtgagctggctagttgggtgaatgagcagtttcacagtgacggagaatttcatccctcgtggctggtttagttgctcaaacccaatgagtgaataatgaaagatggaatgaatgaatgaagattaaatgggtgcatgaatgaatgaatgaatgaatgaatgaagagatctgccaccagatatttgtaaagaaacacagtctagttaacatcaaggagatgttcctcgtggctgtgcagttgaatttctatctgc

SEQ ID NO: 22853 - DNA, 272 bp, Homo sapiens
  AC004707.1_93204
  Located on chromosome 17
  Distance between a terminus base of telomere on chromosomal short arm and 5'-terminus of this base sequence : 51389309
  Distance between 3'-terminus of neighbour sequence of sequence listing upward to telomere on chrosomal short arm and 5'-terminus of this base sequence : 65741
atgctcagctgtcagtaaataaataactcttattatcccagcactgtgcattgggaatacgattcattcattcattcattcattccacaaataggtgtgaagtcctactttgtactagacactgtgctaatactggggatacaaaaataaaatagatgaggtctctgccctcatggacaggtaatctacagagagaaacagacagcgaaaaggaatttaatagaattacaaaggggttggcttagatcagggggtcaggaaaggcttctcac

SEQ ID NO: 22854 - DNA, 458 bp, Homo sapiens
  chr17.fa.O7frz.54587903
  Located on chromosome 17
  Distance between a terminus base of telomere on chromosomal short arm and 5'-terminus of this base sequence : 51550146
  Distance between 3'-terminus of neighbour sequence of sequence listing upward to telomere on chrosomal short arm and 5'-terminus of this base sequence : 160565
ggaaagaatcgctagatatgactgcttcctaccctctacagctttcttctggttgcacctgggagagccacagggcgtctgatagcggactgacttccatggacatgttctcacttgcaacccacccccttttgatcttttttggctgtttccatttatttatttttaaatttaatttttagctttttttttctgtgtgtgtgtgtgtgtgtgtgtgtgtgtgtgtgtgtgtttgtaaacagggctctcgctgtgttgccccagctagtgtcaaattcttggcctcaagcgatcctcctgcctcggcctcacagactgctaggattccaggcatggaccactgcgcccagcctatttttgtttactgagagctgattttgtgtggtactgtggctcaccagaagggtatcggtattaactgtgtgaccctggtcctcaagaaactcagtctaatgaac

SEQ ID NO: 22855 - DNA, 119 bp, Homo sapiens
  HUMUT63
  Located on chromosome 17
  Distance between a terminus base of telomere on chromosomal short arm and 5'-terminus of this base sequence : 51630658
  Distance between 3'-terminus of neighbour sequence of sequence listing upward to telomere on chrosomal short arm and 5'-terminus of this base sequence : 80054
gcctatcaccatgtgtgtgactgggaatgcgtgcatttttctctctctctctctctctgtgtgtgtgtgtgtgtgtgtgtgtgtgtgtgtgtgtctggaaggaagcaagagtagccaac

SEQ ID NO: 22856 - DNA, 430 bp, Homo sapiens
  chr17.fa.O7frz.54884009
  Located on chromosome 17
  Distance between a terminus base of telomere on chromosomal short arm and 5'-terminus of this base sequence : 51801631
  Distance between 3'-terminus of neighbour sequence of sequence listing upward to telomere on chrosomal short arm and 5'-terminus of this base sequence : 170854
ggtgtaagtatcataccttgtgatgttttttatagctatttgtcaaaaccctaaacttaactcttctcccagcccagagaaattggagatgacgaaacataataatttctcacagttcaaacatgaagttagccaaactggtatatgcatccagacttcattatttgtgaaataatgatttcagttttttaattcctgggattgattatttatttatttatttattttgagagacagagtcttgctctgtcgccaggctggagtgcagtggcgcaatctcagctcactgcaacctctgcctcctgggttcaggtgattctcctgcctcagcttcccatgtagctgggactactacaggtgtgcgccaccacacctagctaatttttgtattttttttagtagagactgggtttcactatatgttggccag

SEQ ID NO: 22857 - DNA, 234 bp, Homo sapiens
  AC005920.1_101032
  Located on chromosome 17
  Distance between a terminus base of telomere on chromosomal short arm and 5'-terminus of this base sequence : 52041528
  Distance between 3'-terminus of neighbour sequence of sequence listing upward to telomere on chrosomal short arm and 5'-terminus of this base sequence : 239467
atcacaagactccatctcaataaatgaatgaataaataaataaataaataaataaataaataaataaggtccactttcagttttttgaatatttacttattatttattcgatatccactaaatactgcagttaagaacatacactttctagtgggttagtttccttgtctaataaatatagattagaatactgatcttccttatgggcagttataagcaattactatcacagca

SEQ ID NO: 22858 - DNA, 420 bp, Homo sapiens
  AC006141.2_10913
  Located on chromosome 17
  Distance between a terminus base of telomere on chromosomal short arm and 5'-terminus of this base sequence : 52251251
  Distance between 3'-terminus of neighbour sequence of sequence listing upward to telomere on chrosomal short arm and 5'-terminus of this base sequence : 209489
agcactggttactaatttgaaaggcggccaggtgtggtggctcacgcctgtaatcccagcactttgggaggctgaggcaggtggatcacctgaggtcaggagttcaagagcagcctggccaatatggagaaatcctgtctctattaaaaatacaaaaattagctgggtatggtggcacatgcctgtagttctagctacttgggaggctgaggcaggagaatcacttgaacccaggaggcagaggctgcagtgagccaagattgtgctactgcactccagcctgggcaacagagcaagactctgtctcaaaacaacaacaacaacaacaacaacaacaacaacaacaacaacatgcataaaacagtccataattttttttaaaaaaccatattaaaccaatatcactaaagaattggcatg

SEQ ID NO: 22859 - DNA, 355 bp, Homo sapiens
  AC006141.2_73895
  Located on chromosome 17
  Distance between a terminus base of telomere on chromosomal short arm and 5'-terminus of this base sequence : 52314322
  Distance between 3'-terminus of neighbour sequence of sequence listing upward to telomere on chrosomal short arm and 5'-terminus of this base sequence : 62651
gcagatgtatggattcctattatctgtggggttaaatatgtttgctgtcattttgccctggtaaatacttatgttattgttttttttttttccttttgcaaaaaatgttctagaggtattatgttcctattgcttgagctcaggagtttgaagctacggtgagctgtgatggaaccactgtactttagcccgggtgaaagcgagaccctgtctctaaaataataaataaataaataaataaataaataaataaattttccagtaattctaggaatcccgtttggtttatcttcattttcattggcatcagcctagttcatactgctgtcatctcttatctggcatattgcagtag

SEQ ID NO: 22860 - DNA, 97 bp, Homo sapiens
  D17S1877
  Located on chromosome 17
  Distance between a terminus base of telomere on chromosomal short arm and 5'-terminus of this base sequence : 52444407
  Distance between 3'-terminus of neighbour sequence of sequence listing upward to telomere on chrosomal short arm and 5'-terminus of this base sequence : 129730
tcttggcagactctgacgtgtgtgtgtgtgtgtgtgtgtgtgtgtgtgtgtgtgtgtttgcatgagtgattgtagtcagtacaggagcaccgtgagc

SEQ ID NO: 22861 - DNA, 446 bp, Homo sapiens
  chr17.fa.O7frz.55764591
  Located on chromosome 17
  Distance between a terminus base of telomere on chromosomal short arm and 5'-terminus of this base sequence : 52550804
  Distance between 3'-terminus of neighbour sequence of sequence listing upward to telomere on chrosomal short arm and 5'-terminus of this base sequence : 106300
aggagtttgaggttacaagaagttatgattgtgccattgcactccagcctgggcaacatagcaagatcctgtctcaagaaagaaagaaagaaagaaagaaagaaagaaagaaagaaagaaagaaagaaaagaaagaaagaaagaaagaaagaaagaaagaaagaaagaaagaaagaaagagaaaagaaagaaagaaaaatgggagcagtggagagggtgactcagggtatgatgtgaaagctctgattggacctgggcccaacttcttggtcctataggggagggtcccttaacaccttgtcctgcctccatcccctgctgtgcaccatgagtccaggtttgcctgtcaggcattgccaatgaaagtctctgagtcctgtgatgtttatacaccaacccacgtaccccacctcacagtggaagtgaaactggataaactcttaggt

SEQ ID NO: 22862 - DNA, 293 bp, Homo sapiens
  AC005883.12_77532
  Located on chromosome 17
  Distance between a terminus base of telomere on chromosomal short arm and 5'-terminus of this base sequence : 52621555
  Distance between 3'-terminus of neighbour sequence of sequence listing upward to telomere on chrosomal short arm and 5'-terminus of this base sequence : 70305
gtaagaaacctacacattctgcacatgtatcctaaaacttaaagtataataataataataataataataataataaatgccaatgcatgggcctctgatttaactcatctagggattggcattttaataaaactgccttggtgattcaactgagcatccggggtatagggccattgaggttgaaatttgattggtgagggcttagaaaggaggcagttccagtgtagctttggcttctgagaagactggaaaccaagatgattaggaagaggatttgaggaagtgttaagtag

SEQ ID NO: 22863 - DNA, 274 bp, Homo sapiens
  D17S941
  Located on chromosome 17
  Distance between a terminus base of telomere on chromosomal short arm and 5'-terminus of this base sequence : 52800115
  Distance between 3'-terminus of neighbour sequence of sequence listing upward to telomere on chrosomal short arm and 5'-terminus of this base sequence : 178267
tatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttgg

SEQ ID NO: 22864 - DNA, 320 bp, Homo sapiens
  AC026609.3_110998
  Located on chromosome 17
  Distance between a terminus base of telomere on chromosomal short arm and 5'-terminus of this base sequence : 52872327
  Distance between 3'-terminus of neighbour sequence of sequence listing upward to telomere on chrosomal short arm and 5'-terminus of this base sequence : 71938
tctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagac

SEQ ID NO: 22865 - DNA, 164 bp, Homo sapiens
  D17S956
  Located on chromosome 17
  Distance between a terminus base of telomere on chromosomal short arm and 5'-terminus of this base sequence : 52877775
  Distance between 3'-terminus of neighbour sequence of sequence listing upward to telomere on chrosomal short arm and 5'-terminus of this base sequence : 5128
agggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttggg

SEQ ID NO: 22866 - DNA, 245 bp, Homo sapiens
  D17S809
  Located on chromosome 17
  Distance between a terminus base of telomere on chromosomal short arm and 5'-terminus of this base sequence : 52881171
  Distance between 3'-terminus of neighbour sequence of sequence listing upward to telomere on chrosomal short arm and 5'-terminus of this base sequence : 3232
caaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctgga

SEQ ID NO: 22867 - DNA, 273 bp, Homo sapiens
  AC004108.1_59831
  Located on chromosome 17
  Distance between a terminus base of telomere on chromosomal short arm and 5'-terminus of this base sequence : 52897097
  Distance between 3'-terminus of neighbour sequence of sequence listing upward to telomere on chrosomal short arm and 5'-terminus of this base sequence : 15681
cgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacac

SEQ ID NO: 22868 - DNA, 196 bp, Homo sapiens
  chr17.fa.O7frz.56216178
  Located on chromosome 17
  Distance between a terminus base of telomere on chromosomal short arm and 5'-terminus of this base sequence : 53001903
  Distance between 3'-terminus of neighbour sequence of sequence listing upward to telomere on chrosomal short arm and 5'-terminus of this base sequence : 104533
cctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttaga

SEQ ID NO: 22869 - DNA, 372 bp, Homo sapiens
  chr17.fa.O7frz.56395191
  Located on chromosome 17
  Distance between a terminus base of telomere on chromosomal short arm and 5'-terminus of this base sequence : 53154089
  Distance between 3'-terminus of neighbour sequence of sequence listing upward to telomere on chrosomal short arm and 5'-terminus of this base sequence : 151990
acttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttatatatatatatatatatatatatatatatataatatgtatatgatggaatactacccagccataaaaggaatgaattaacagcacttgcaataacctggatgagactggagactattactctaagtgaagtaactcaggaatca

SEQ ID NO: 22870 - DNA, 196 bp, Homo sapiens
  D17S788
  Located on chromosome 17
  Distance between a terminus base of telomere on chromosomal short arm and 5'-terminus of this base sequence : 53258591
  Distance between 3'-terminus of neighbour sequence of sequence listing upward to telomere on chrosomal short arm and 5'-terminus of this base sequence : 104130
ctaggcagccactaccaaattgtctgctatacacctcatattccattatgaattctcacagttaaaaaattcccaagtacaggctgcatgaaaaataaaaatgaactacacacacacacacacacacacacacacacacacaccttgagtatgaaaaaggaaataaagcaatttgatgcttatagcaaagatgctg

SEQ ID NO: 22871 - DNA, 170 bp, Homo sapiens
  Z16564.1_110
  Located on chromosome 17
  Distance between a terminus base of telomere on chromosomal short arm and 5'-terminus of this base sequence : 53258599
  Distance between 3'-terminus of neighbour sequence of sequence listing upward to telomere on chrosomal short arm and 5'-terminus of this base sequence : -188
ccactaccaaattgtctgctatacacctcatattccattatgaattctcacagttaaaaaattcccaagtacaggctgcatgaaaaataaaaatgaactacacacacacacacacacacacacacacacacacaccttgagtatgaaaaaggaaataaagcaatttgatg

SEQ ID NO: 22872 - DNA, 448 bp, Homo sapiens
  chr17.fa.O7frz.56621490
  Located on chromosome 17
  Distance between a terminus base of telomere on chromosomal short arm and 5'-terminus of this base sequence : 53329958
  Distance between 3'-terminus of neighbour sequence of sequence listing upward to telomere on chrosomal short arm and 5'-terminus of this base sequence : 71189
acctgtcctgataaaccttagtgtcccctactcttgagaaaaactggcaggtcatgaataaactactctcattcagaaaacaaaaaatcccagcttgggattgtacttggatgagagaaaacaaacacaccatcaaaagctaaataacgtcataaagatgagaactaaaacttaaaagagaaataaaaaaatacatttaaaaataattatttaattaataaaatgatattttattttattttttaagagttggggcctcactcagcccaggcttaagtgtagtggcattatcatagctcactgcaacttcaaatttataggctccagcagtcctcctgcctgtctcccaagtagctaagactagaggtgcatgctaccacacccagctaattttacttatttatttatttatttattttgtagagaagatgtcttactatgttgacca

SEQ ID NO: 22873 - DNA, 146 bp, Homo sapiens
  D17S1865
  Located on chromosome 17
  Distance between a terminus base of telomere on chromosomal short arm and 5'-terminus of this base sequence : 53611237
  Distance between 3'-terminus of neighbour sequence of sequence listing upward to telomere on chrosomal short arm and 5'-terminus of this base sequence : 280831
ggccaacttttgactgataaaccaaatgttcttctccccctctacacacacacacacacacacacacacacacacacacacacactgttttccagcttaattgtttattcatgatactcttgactctatggctatggacaggctta

SEQ ID NO: 22874 - DNA, 490 bp, Homo sapiens
  chr17.fa.O7frz.56900243
  Located on chromosome 17
  Distance between a terminus base of telomere on chromosomal short arm and 5'-terminus of this base sequence : 53616519
  Distance between 3'-terminus of neighbour sequence of sequence listing upward to telomere on chrosomal short arm and 5'-terminus of this base sequence : 5136
gtcctattagcagtaatgtttcagcagcagctgtaggacagcaggttacaaagttgtatgaagaaaggtcacaggtaggtgagagaagaagaagaagagagagagagagagagagagagagagagagagagagagagagagagagagagagagagaaagtatcaagttcaacacagatgttacatctccattgccaggtcaggcaactcgttgtctattatattaaaattatctgtattttcaccaaactttctatcttcccagaagcatccttttttggggggatttggttcctagtttcataattttttttctaatgtaaccattattcacatgttaaattgagttcttttgaagtttaacatacagttgtagctttctgggtttacctatataagaaagcattaccaagacagtttctaattctcccattgtttttatttcttgttaagacctcagtggaccagttctgatactaacaaaccatcac

SEQ ID NO: 22875 - DNA, 445 bp, Homo sapiens
  chr17.fa.O7frz.56973609
  Located on chromosome 17
  Distance between a terminus base of telomere on chromosomal short arm and 5'-terminus of this base sequence : 53690236
  Distance between 3'-terminus of neighbour sequence of sequence listing upward to telomere on chrosomal short arm and 5'-terminus of this base sequence : 73227
cactcatggagagtacagtcagcagataacctccaggggtcagccacttcagggtctacctcaactgcagacctccataccacccaaggttatgatcttcccaaagcagctcagatccaaggactgaatgaaatgtggatataaaattctagtcattttggccagatgcaagacattatcatgtcccattgctctttgccaaactggatgaggatttcttgggcctgagtcacaattttcctttgctcaatcctgctacacattctttcccttcacagatattgattcttaacaaacacagagaatcccaagacaccaaacttcatcattatttgcttctggagaacttaatctgtgtgtgtgtgtgtgtgtgtgtgtgtgtgtgtgtgtgtgtgattgactctgtatctgtaagtctgtgtatattctagagcaagcctatctg

SEQ ID NO: 22876 - DNA, 449 bp, Homo sapiens
  chr17.fa.O7frz.57179735
  Located on chromosome 17
  Distance between a terminus base of telomere on chromosomal short arm and 5'-terminus of this base sequence : 53803842
  Distance between 3'-terminus of neighbour sequence of sequence listing upward to telomere on chrosomal short arm and 5'-terminus of this base sequence : 113161
ctaactgatccattgaatcaatgacttattgatttatttatgccttttgctcttcctccaatattatgttttatagtctttctgtcccaggaactctgataagtttacagatatacagatataaataaatcattatagggatctatttattcatgacaaatatcaattacgtacatatatatatatacacacatacacacacacatatatatatatatatatatatatatataccagtgttaaacaaaaaatcatactggacaaaatgaacagacagaagttgattttattttgatgctattgccagcaatagaagagcaaacacaggtcaaatccggatacccagctctgtaggagaatcagaggcaacctgtgtgtgctaattggtgctacccaaagaaatgtaaactctgtgtcttcatggcaggaggtagtttacaagttggagc

SEQ ID NO: 22877 - DNA, 278 bp, Homo sapiens
  chr17.fa.O7frz.57085865
  Located on chromosome 17
  Distance between a terminus base of telomere on chromosomal short arm and 5'-terminus of this base sequence : 53841603
  Distance between 3'-terminus of neighbour sequence of sequence listing upward to telomere on chrosomal short arm and 5'-terminus of this base sequence : 37312
gatgcattagtccttgtactctaacttacatggtagaaataaatcaggtttctcatataactgatttttttaagctttgtcagtataattagaaattacatgaaaacttttggaacaaattttcttacaaagtataacacagcatgggaatagaatatttaatatttagttacagtaattctctcagtctttttaaaacttttccccttgtcacacacacacacacacacacacacacacacacacacacacacacgtgcagttcaatgatttatcac

SEQ ID NO: 22878 - DNA, 481 bp, Homo sapiens
  chr17.fa.O7frz.70103195
  Located on chromosome 17
  Distance between a terminus base of telomere on chromosomal short arm and 5'-terminus of this base sequence : 53960051
  Distance between 3'-terminus of neighbour sequence of sequence listing upward to telomere on chrosomal short arm and 5'-terminus of this base sequence : 118170
gctgtttgatttcatgtgatagtagatgattttcaggggcttgattaaaagaaataagatatatatatatatatatatatatatatatatatattctttttagagacaggatcttgccctgtcacccaggctatagtagagtggcacagtcatagctcactgcagcctcaaactcctgggctcaagggatcctcctatctcaccctcctgagtgggtggactgcagacacacttcaccacgtccagctaatttatttatttatttatttactattctttgtagaggcaggatcttgctatgttgcccaggctggtctcaaactcctggtctcaagtgatcctcctacctcagcctcccaaagtgctgggattacaggtgtgagccactgtgcccggccaatataatttaaaattatacttaattcattccacttgaaattttattattttgagtttttgtagagcagaacctgaattaaag

SEQ ID NO: 22879 - DNA, 415 bp, Homo sapiens
  AC008105.17_51298
  Located on chromosome 17
  Distance between a terminus base of telomere on chromosomal short arm and 5'-terminus of this base sequence : 54030182
  Distance between 3'-terminus of neighbour sequence of sequence listing upward to telomere on chrosomal short arm and 5'-terminus of this base sequence : 69650
aactgttaagagtggttgcctctggggagggaatgggaaacagggcaacagggaggctgattggcaagagatctttcctttctttccccttccttccttccttccttccttccttccttccttccttccttccttccttccttccttcgagatggagtcttgctctgttgcccaggctagagtgcactggcgtgatcttggctcgcggcaccctccgcctcccaagttcaagtgattctcctgcctcagcctcccgagtacctgggattacaggcacccgccactacgccaagctaatttttatatttttagtagagacggggtttcaccatgttggccaggctggtctcaaactccagacctcaaatgatctacccacttcagcctcccagggtgttgagattacaggcttgag

SEQ ID NO: 22880 - DNA, 342 bp, Homo sapiens
  AC003070.1_92095
  Located on chromosome 17
  Distance between a terminus base of telomere on chromosomal short arm and 5'-terminus of this base sequence : 54212122
  Distance between 3'-terminus of neighbour sequence of sequence listing upward to telomere on chrosomal short arm and 5'-terminus of this base sequence : 181525
atgaggtcaggagatggagaccattctggctaacacagtgaaaccctgccactactaaaaatgcaaaaaattagctgggcctggtggcacgcacctgtagtcccagctactcgggaggctgaggcaggagaatcgcttgaacccgggaggcagagattgcagtgagccgagatcgcaccactgcactccagccagggcaacagagcaacactctgtctcaaagaaaagaaaagaaaagaaaagaaaagaaaatggcatatctcatcccctagccctcccctgcaaaggacagagaaccttcaagaggcagataacacagcctcactctaatcaaagcagaca

SEQ ID NO: 22881 - DNA, 145 bp, Homo sapiens
  D17S1809
  Located on chromosome 17
  Distance between a terminus base of telomere on chromosomal short arm and 5'-terminus of this base sequence : 54304097
  Distance between 3'-terminus of neighbour sequence of sequence listing upward to telomere on chrosomal short arm and 5'-terminus of this base sequence : 91633
ttgccaagatacaggaatgtggtaaaaatttagttatctccaataaatggatggtgttggcagatgcatctgctcaggagggacacacacacacacacacacacacacacacacacacacacacactccatgacctggtgggctt

SEQ ID NO: 22882 - DNA, 207 bp, Homo sapiens
  chr17.fa.O7frz.70216737
  Located on chromosome 17
  Distance between a terminus base of telomere on chromosomal short arm and 5'-terminus of this base sequence : 54581021
  Distance between 3'-terminus of neighbour sequence of sequence listing upward to telomere on chrosomal short arm and 5'-terminus of this base sequence : 276779
tgtaatgaaggttaaccatgttacccactgcattgatttgtacttcatataccaaatgcttactatatatatatatatatatatatatatatacacacaataagatatatgcaacagaacaagagcctagtaacaggataaaggaggtaatcacgcaggagaagtgttactttacattcctatgttaacattcgtagcaaactagac

SEQ ID NO: 22883 - DNA, 190 bp, Homo sapiens
  D17S950
  Located on chromosome 17
  Distance between a terminus base of telomere on chromosomal short arm and 5'-terminus of this base sequence : 54634553
  Distance between 3'-terminus of neighbour sequence of sequence listing upward to telomere on chrosomal short arm and 5'-terminus of this base sequence : 53325
ttttgccacaacagcacaacgccctgcaccggggtgtgtgtgcatgtgtgtgtgtgtgtgtgtgtgtgtgtgtgtgtgtgtgtgtgtgcacgcgcgtgatgacttctgtcctatccaggcgagggggcctccgcactggggtttactccaggcctcctgctggtggcacacatgggggcaagtgctgtgt

SEQ ID NO: 22884 - DNA, 398 bp, Homo sapiens
  chr17.fa.O7frz.57288955
  Located on chromosome 17
  Distance between a terminus base of telomere on chromosomal short arm and 5'-terminus of this base sequence : 54800574
  Distance between 3'-terminus of neighbour sequence of sequence listing upward to telomere on chrosomal short arm and 5'-terminus of this base sequence : 165831
tggagctagaagtcctgtattaaaaagaagcaaagatattagagatttttaaaagcaggatacttagatgaagtcatcagtctccttcctcctcctcctcctcctcctcttccccttcctcctccttcccccttcctccttctccccctcctccttctcctcccctttctcctccttcccctcctcctccccctccccctcctcctcttccttcttcttccttccttcttccttcttccctcttcctcttcctcctcctcttcttcttctgcttcttcttcctcttcttctctttttagtggagccccttatgagctgtcaaccctacaaagtagagctagttattggtctgattattagactaaaaatttgtggttggaaaggattctatttctaaa

SEQ ID NO: 22885 - DNA, 100 bp, Homo sapiens
  G09363
  Located on chromosome 17
  Distance between a terminus base of telomere on chromosomal short arm and 5'-terminus of this base sequence : 54888549
  Distance between 3'-terminus of neighbour sequence of sequence listing upward to telomere on chrosomal short arm and 5'-terminus of this base sequence : 87577
gcattaattataatcaggaaaaagcctctatctatctatctatctatctatctatctatctatctatctatctatccacccatccacccataggaatgtc

SEQ ID NO: 22886 - DNA, 371 bp, Homo sapiens
  AC004606.1_73019
  Located on chromosome 17
  Distance between a terminus base of telomere on chromosomal short arm and 5'-terminus of this base sequence : 54977191
  Distance between 3'-terminus of neighbour sequence of sequence listing upward to telomere on chrosomal short arm and 5'-terminus of this base sequence : 88542
actgctgtaagcagtattctgtagtggccagggttaaatcaggcatatgtaccttcctcccaaatatgttaagctttattgttagactgcacgctgggcagatgatctcagtttagtagtgttttatttttgcacatttactcagccattttatgttatgttatgttatgttatgttatgttatgttatgttatgttatgttatttttttgagaccaagtctcgtttgtcatccaggctggagtgcagtggcgcgatctcggctcactgcagcctccagctcccgggttcaagcaattctcctgcctgagctaccctgagacaaattcctggtgacataaatcagatgataatttaaatgactccacttcc

SEQ ID NO: 22887 - DNA, 235 bp, Homo sapiens
  chr17.fa.O7frz.57642310
  Located on chromosome 17
  Distance between a terminus base of telomere on chromosomal short arm and 5'-terminus of this base sequence : 55152080
  Distance between 3'-terminus of neighbour sequence of sequence listing upward to telomere on chrosomal short arm and 5'-terminus of this base sequence : 174518
atttagcttcatcttgtaagtcagagcatgtggtatttgactttctgtttctgagatgtttcacttaatatattagcctccagattcatccatgttattgcaaaggacattatttcatttttttattgctgagtagtattcccatgtctacacacacacacacacacacacacacacacacacaccacattttctttatccagtcacccactgatggatacttaggtcgatttct

SEQ ID NO: 22888 - DNA, 392 bp, Homo sapiens
  chr17.fa.O7frz.57784962
  Located on chromosome 17
  Distance between a terminus base of telomere on chromosomal short arm and 5'-terminus of this base sequence : 55262344
  Distance between 3'-terminus of neighbour sequence of sequence listing upward to telomere on chrosomal short arm and 5'-terminus of this base sequence : 110029
gtcaaatttcaattacagagctacatggatatgttcactttatgaaaattttatctgtacactttagctttgctcaatttcctgtatatgcatgacaaacggaaaactttcaattagaattaaacagttgaataaagtttgacaattatgtgaaaaattcagaaaagtaataatctagctcatatgttatatatataatatagcatagtatattatctatatatcatagtatcaatagtatcaatcattttcccccaattatgtaaaaaattcagaaaaataaagtaatatagcacacacacacacacacacacacacacacacacatatataatgtccacagatttgcagtttatctggggcatctctgcctcaggcttatcaggtagttg

SEQ ID NO: 22889 - DNA, 209 bp, Homo sapiens
  chr17.fa.O7frz.58000678
  Located on chromosome 17
  Distance between a terminus base of telomere on chromosomal short arm and 5'-terminus of this base sequence : 55563746
  Distance between 3'-terminus of neighbour sequence of sequence listing upward to telomere on chrosomal short arm and 5'-terminus of this base sequence : 301010
aagtgatcataatctaccttcctctcatcattgtccacaagaagtaaaaataattatgtggctgtttggcaataaaagaggggtggttccttagagctcttttgggaattttcctgaagattatcacttcactctgtgtgtgtgtgtgtgtgtgtgtgtgtgtgtgtgtgtgtgtgttgaaggaaatatttagtagttacctttgagca

SEQ ID NO: 22890 - DNA, 403 bp, Homo sapiens
  chr17.fa.O7frz.58185626
  Located on chromosome 17
  Distance between a terminus base of telomere on chromosomal short arm and 5'-terminus of this base sequence : 55630780
  Distance between 3'-terminus of neighbour sequence of sequence listing upward to telomere on chrosomal short arm and 5'-terminus of this base sequence : 66825
ttaagctgataagcaacttcagcaaagtctcaggatatatacatatagatttctatgtgtatatatatattttgtatatatttatatatgtgtgtgtgtatgtgtgtgtatatatatatatatatatatatacagcaaaaaactgcaattacttttgcagcaacctagtagatgtctctctctttctctctctctctctctcttactcttcctctctctgtggttctggttcttttcgcctttccaaagctactataatgtaaatcctggtcctagtttcaccactcaacattttaccaaatacagatgtaaattaaaatggtcatcattctcccagcctaagaaaagttcttatcataggaatctttcaaactaatcactaaagtaacagatctggtcattg

SEQ ID NO: 22891 - DNA, 474 bp, Homo sapiens
  chr17.fa.O7frz.58757906
  Located on chromosome 17
  Distance between a terminus base of telomere on chromosomal short arm and 5'-terminus of this base sequence : 55803542
  Distance between 3'-terminus of neighbour sequence of sequence listing upward to telomere on chrosomal short arm and 5'-terminus of this base sequence : 172359
gacatcttcatttgtcttgaagtttttgctaacaaatacatgatgtatctaaagttttaatgtggagtgaagaaggaggaaatccaagaaaactttgctgaaatataatttccattaaggtagaaatttgtgtctcttttgttcactgatatattccaaatgtccagaacagtaccacagtgcctaccacagagtagtaggtaatctataataatttgttgataaataaatgatttaactcaaaaatgagataattaatacaaagaatttagcatggtgaccatcaaattatggcataacaattaaatctttttaattcttctattaattgattatatatatatatatatatatataatatatatgcttatattggcaaattgcccaaactctcccttttgtcacttttcagtgtagtgctgcatccaaatcctaggcagagagaaataaataattgtataaactgccattgat

SEQ ID NO: 22892 - DNA, 275 bp, Homo sapiens
  AC000389.1_73869
  Located on chromosome 17
  Distance between a terminus base of telomere on chromosomal short arm and 5'-terminus of this base sequence : 55956314
  Distance between 3'-terminus of neighbour sequence of sequence listing upward to telomere on chrosomal short arm and 5'-terminus of this base sequence : 152298
tcatgctgatgctattacagttacagtaagaatcccggagtaccaggtcagataataaagtcctggcctatgactcattggcagaatcttcacatttgtttcttaacttgtaggtttttgtgtagttctggacttgtgcatagttttaaaaagtgtgtgtgtctgtgtgtgtgtgtgtgtgtgtgtgtaattttttttcagagataggctgctgctctgttgctctggcaggagtgcagtgatgcagtcatagctcactgaagcagtgaagttct

SEQ ID NO: 22893 - DNA, 351 bp, Homo sapiens
  chr17.fa.O7frz.58942923
  Located on chromosome 17
  Distance between a terminus base of telomere on chromosomal short arm and 5'-terminus of this base sequence : 56042861
  Distance between 3'-terminus of neighbour sequence of sequence listing upward to telomere on chrosomal short arm and 5'-terminus of this base sequence : 86272
atagtacgtcataggatttgacacataaattcttgtatatcagttaacaagctctaattttatgattattcaattaaggaaatatatgcccccagcagtgaaggactcaccaaaaattacgcattcagttaattaactgagattcaaaacttgttatcctaactcctagatcagacattacacaattatgactattcatattgtgctgcctcaatgctggagaagtatcactttatcttagtccccggcataaccaatagccaacacatgtacacatgcaaaacacacacacacacacacacacacacacaactttaggtatctgtatcatctagatgttaaccattatcc

SEQ ID NO: 22894 - DNA, 209 bp, Homo sapiens
  Z66905
  Located on chromosome 17
  Distance between a terminus base of telomere on chromosomal short arm and 5'-terminus of this base sequence : 56261706
  Distance between 3'-terminus of neighbour sequence of sequence listing upward to telomere on chrosomal short arm and 5'-terminus of this base sequence : 218494
cagccgcagttgcctaccttcactatgcctggttaattttaccttctgtagtcttctaaagtgaactatgtgttctaacttaagatccttgaattgtgactacacacacacacacacacacacacacgtactttccattacataattacatgggcagtccctattcatttttctcctgttacatcctttatttgaaacgacttcccatc

SEQ ID NO: 22895 - DNA, 367 bp, Homo sapiens
  AC010767.3_138899
  Located on chromosome 17
  Distance between a terminus base of telomere on chromosomal short arm and 5'-terminus of this base sequence : 56403981
  Distance between 3'-terminus of neighbour sequence of sequence listing upward to telomere on chrosomal short arm and 5'-terminus of this base sequence : 142066
tgctattcctattaaactaccaacaacattcttcgcagagctagaaaaaagctttaaaaaattcatatagaacaacaacaacaacaaaaaactgcctgaatagccaaggcaatcctaaggaaaaagaacaaagttggaggcataatattagctgacttcaatctacactacacgactacagtgactaaatctcatggtactggtacaaaaacagacacatagatctatggaacagaataaggagccaagaaataaggccacacacctacaactttctgatctttgacacagctgagaaaacaagcaatagggaaaaactatctatttaataaatggtgctgggataactggctaaccatatgtagaa

SEQ ID NO: 22896 - DNA, 187 bp, Homo sapiens
  D17S790
  Located on chromosome 17
  Distance between a terminus base of telomere on chromosomal short arm and 5'-terminus of this base sequence : 56540807
  Distance between 3'-terminus of neighbour sequence of sequence listing upward to telomere on chrosomal short arm and 5'-terminus of this base sequence : 136459
aaaatgagtggaccatacgaagaaatgtctaaaactacagagtaaagagtaaactactcttataaaggtatttctctctttctctctctccatctttctttctctcatttactctttcccacgtgcacgtgtgtatgcacacacacacacacacacacacacattcacacaggaaaaacaataaccc

SEQ ID NO: 22897 - DNA, 232 bp, Homo sapiens
  AC005951.1_146513
  Located on chromosome 17
  Distance between a terminus base of telomere on chromosomal short arm and 5'-terminus of this base sequence : 56645972
  Distance between 3'-terminus of neighbour sequence of sequence listing upward to telomere on chrosomal short arm and 5'-terminus of this base sequence : 104978
gatagcattaggagaaatacctaacgtaaatgatgagttgatgggtgcagcaaaccaacatggcacatgtatacctatgtagcaaacctgcacgttgtgcacatgtaccctagaatttaatgcataagagagaagaaagaaagaaagaaagaaagaaagaaagaaagaaagaaagaaagaaagaaagaaagaaagaaagaaagaaaaagctgtgcagctactttggaaaata

SEQ ID NO: 22898 - DNA, 447 bp, Homo sapiens
  chr17.fa.O7frz.59713937
  Located on chromosome 17
  Distance between a terminus base of telomere on chromosomal short arm and 5'-terminus of this base sequence : 56762494
  Distance between 3'-terminus of neighbour sequence of sequence listing upward to telomere on chrosomal short arm and 5'-terminus of this base sequence : 116290
aggagtttcttagaaatagcctatagttggttcatgcatttttatatattctcataatctcttttaattgatatgttaggcaatttacatttaatttaattgtatgtagagtttaggtctactgttatatagttattctatgtgttcctttttttctgtttcctttttcctgctttcttttggattattagaatatttttagtgctccattttagtttattgtgattttgactgtatctttgtataatggtgtgtgtgtgtgtgtgtgtgtgtgtgtgtgtgtgtgtgaaataaagttgcttggtaaataatgtggtttaaagtagctgattcttttcctgttattttgctaattttgttagcaaaatatatatatgtatatatgtttatatatacatgtacacacacacatatatataaagagagtttgctttagtgattgcagta

SEQ ID NO: 22899 - DNA, 347 bp, Homo sapiens
  AC005177.1_11463
  Located on chromosome 17
  Distance between a terminus base of telomere on chromosomal short arm and 5'-terminus of this base sequence : 56931024
  Distance between 3'-terminus of neighbour sequence of sequence listing upward to telomere on chrosomal short arm and 5'-terminus of this base sequence : 168083
catgtttgtatagcctacagaatcatgagccaattaaacttttttctttattataaatttcccagcctcaggtattcctttatagcaacacaagaatagcctaatacactgttccacctgcctggaatggtattccttcagaccttcacaagactcacgctttcattttattcagggtttgtttgtttgtttgtttgtttgtttgtttgtttcttagagatgatctaactctgtcacccaggctgcagtgcaatagcacagtcatagctcactgcagtttcgaactcctgggctcaggctattgtcccactatagcctcccagataactaggactataggtgcacaa

SEQ ID NO: 22900 - DNA, 394 bp, Homo sapiens
  AC023399.2_86317
  Located on chromosome 17
  Distance between a terminus base of telomere on chromosomal short arm and 5'-terminus of this base sequence : 56932198
  Distance between 3'-terminus of neighbour sequence of sequence listing upward to telomere on chrosomal short arm and 5'-terminus of this base sequence : 827
gaaggagtgataaatgctgataacaaggggacaacatgtgaaaaaaggattggctgaaatcgtaaacatttgtgacttttagaagagaaatttcagtagattggtgagggcacaaatacaatttactcgaacaccattttgaatgtcaatttaatctttcttttatgattcatatggcatttcagtacctcttaggacctcttggtcatttcataaatattggttatgtaacactgcagtttaaaagatacaggattaagaaaaatggtataggatattgtatattgaaaatttgctaggagagtagattttaggtgctcttaccacacacacacacacacacacacacacacacacacacacacacacgaggtagctatagaaggtgatggct

SEQ ID NO: 22901 - DNA, 342 bp, Homo sapiens
  AC005177.1_84757
  Located on chromosome 17
  Distance between a terminus base of telomere on chromosomal short arm and 5'-terminus of this base sequence : 57004367
  Distance between 3'-terminus of neighbour sequence of sequence listing upward to telomere on chrosomal short arm and 5'-terminus of this base sequence : 71775
gtcttgcttcattgctgaggctggtctagaactcctgggctcaaataatctgcccatctcggcctcccaaggtgctggaattacaggcatgaaccaccacctggccactattttcttcttcttctttttcttcttcttcttcttcttcttcttcttcttcttcttcttcttcttcttcttcttcttctccttctccttctccttctccttctccttctccttctccttctccttctccttctccttctccttctccttctccttctcctcctcctcctcctcctccttctcctcctccttctccttcttcttcttcttctcatactgaagtattacaaagcc

SEQ ID NO: 22902 - DNA, 152 bp, Homo sapiens
  D17S787
  Located on chromosome 17
  Distance between a terminus base of telomere on chromosomal short arm and 5'-terminus of this base sequence : 57024027
  Distance between 3'-terminus of neighbour sequence of sequence listing upward to telomere on chrosomal short arm and 5'-terminus of this base sequence : 19318
tgggctcaactatatgaacctacttttctctgggtttctgcttgctcaagtactggctgcattggtatctcttcaatgccttcaagattaaacacacacacacacacacacacacacacacaaacacacataccccttcaaaaaggtatcaa

SEQ ID NO: 22903 - DNA, 156 bp, Homo sapiens
  AC005177.1_104381
  Located on chromosome 17
  Distance between a terminus base of telomere on chromosomal short arm and 5'-terminus of this base sequence : 57024098
  Distance between 3'-terminus of neighbour sequence of sequence listing upward to telomere on chrosomal short arm and 5'-terminus of this base sequence : -81
ttcaatgccttcaagattaaacacacacacacacacacacacacacacacaaacacacataccccttcaaaaaggtatcaatctagagctacatacacatatacatctatatttcttactgtcttggcagttctccaataccttcaagaactattg

SEQ ID NO: 22904 - DNA, 160 bp, Homo sapiens
  D17S1306
  Located on chromosome 17
  Distance between a terminus base of telomere on chromosomal short arm and 5'-terminus of this base sequence : 57027798
  Distance between 3'-terminus of neighbour sequence of sequence listing upward to telomere on chrosomal short arm and 5'-terminus of this base sequence : 3544
ttatgcacaaaggagttgcacaaaggtcaccctgttggtggaaggaaggaaggaaggaagcaaggaaggaagggagggagggaagaaggaaggaaggaaggaaggaaggaaggaaagagagagggagggagggaaaggagaggagtaagaatacaaccat

SEQ ID NO: 22905 - DNA, 301 bp, Homo sapiens
  AC005177.1_127883
  Located on chromosome 17
  Distance between a terminus base of telomere on chromosomal short arm and 5'-terminus of this base sequence : 57047581
  Distance between 3'-terminus of neighbour sequence of sequence listing upward to telomere on chrosomal short arm and 5'-terminus of this base sequence : 19623
tcttcctttgaaacaataacatagcatagcatagcataacatagcatagcatagcatagcatagcatagcatagcatagcatagcatagcatagacatgttgcatccagtcctgggcttgtcccttccatcctaggactgcttgtctagaaataagaattctagctggtggcatcaggttctctggggctctggctcctcagcagcctctggaagtatataaagggtctccatggtgtttcaagatctgggtctgttcaagtcaccctacgagattttggtttcatttgctcatgatctag

SEQ ID NO: 22906 - DNA, 408 bp, Homo sapiens
  AC005177.1_131341
  Located on chromosome 17
  Distance between a terminus base of telomere on chromosomal short arm and 5'-terminus of this base sequence : 57050779
  Distance between 3'-terminus of neighbour sequence of sequence listing upward to telomere on chrosomal short arm and 5'-terminus of this base sequence : 2897
ataacgcacgtattaacaaggtgcttggttatgaagtctcaaatgttagctaatattactcactatttttgtgtgcaattcagaaaacatttttccaaatcagcaccaattgctcagaaatatttggtaggtgattccccctaggctgtgaaatagctatgaaagaaggactcaataagctgctaatgaatagtcgggcaaggtatacagatgtaaaaagaaaaacacacttagggatacacagacatgcgtgttctctcctccatccccggactccctttcatgtctctctctctctgacacacacacacacacacacacacacacacacacaccccttttccagatatccctcagctagagctttgcaaacaatatgtcatggtaagcacactcctaacgtagttc

SEQ ID NO: 22907 - DNA, 92 bp, Homo sapiens
  D17S1799
  Located on chromosome 17
  Distance between a terminus base of telomere on chromosomal short arm and 5'-terminus of this base sequence : 57182575
  Distance between 3'-terminus of neighbour sequence of sequence listing upward to telomere on chrosomal short arm and 5'-terminus of this base sequence : 131388
agaaggccagagagtagatttgtgtacatgcacatatgcatacacacacacacacacacacacacacacgactatcaacacaggctctaaga

SEQ ID NO: 22908 - DNA, 399 bp, Homo sapiens
  AC019354.2_143682
  Located on chromosome 17
  Distance between a terminus base of telomere on chromosomal short arm and 5'-terminus of this base sequence : 57271632
  Distance between 3'-terminus of neighbour sequence of sequence listing upward to telomere on chrosomal short arm and 5'-terminus of this base sequence : 88965
agtaggtgctcagttaatgctatgtttttttctccctggcataagttatttatttatttatttatttatttatttattttatttatttttgagatggagtcttgctctattgcccaggctggagtgcagtggggcaatctcggctcactgcaagctccgcctcccgggttcacgccattctcctgcctcagcctcccaagtagctgggactacaggtgcccgccaccacgcctgcctaatttttttgtatttttagtagagacagggtttcaccgtgttagccaggatggtctcgatctcctgacctcgtgatccacccgcctcgggctcccaaagtgctgggattacaggcttgagccaccacgcctggccaaaagttcttatatttcctttaaggcc

SEQ ID NO: 22909 - DNA, 416 bp, Homo sapiens
  AC019354.2_64995
  Located on chromosome 17
  Distance between a terminus base of telomere on chromosomal short arm and 5'-terminus of this base sequence : 57312059
  Distance between 3'-terminus of neighbour sequence of sequence listing upward to telomere on chrosomal short arm and 5'-terminus of this base sequence : 40028
ctattccattgtaaagatgcaccatatgttattaaactattttcatttttgaacatttagcttgtcaccaatgtttttttctttattcatctttgtatacacttcttatagacttactcaactttttccatagaggacatttttgcaagtggacctgctgggtcaaatgtcttcaaattttaaaggctttacacatatatatctgatcaaacggccctataacttgtatgaatgcgtacacctggtagcagtataagagtactcattttccatcatcatcatcatcatcatcatcatcatcattgctaatatttaatgagcacttagtatgggtctggcaaatatccaagcattttattcagaacaattcatttaattgtcacaactctgcggtagataccatggttattcaacat

SEQ ID NO: 22910 - DNA, 250 bp, Homo sapiens
  DISO7_00000811
  Located on chromosome 17
  Distance between a terminus base of telomere on chromosomal short arm and 5'-terminus of this base sequence : 57493515
  Distance between 3'-terminus of neighbour sequence of sequence listing upward to telomere on chrosomal short arm and 5'-terminus of this base sequence : 181040
tgcagattccaccttgtcttcttcccagctgctgcagtctctggctcccaccccagtggcccctttcttactgacacaacccactggccccagaaaatgctgacctcctcctctctccagtgtgtctctgtgtgtgtgtgtctgtgtgtgtgtgtgtctgtgtgtgtgtgtgtgtgtgtgtgtgtgtgtgtgtgtgtgtgtgtgtgttttgggggaatcttccttttagaaactcagaagcaggtctgga

SEQ ID NO: 22911 - DNA, 113 bp, Homo sapiens
  D17S1607
  Located on chromosome 17
  Distance between a terminus base of telomere on chromosomal short arm and 5'-terminus of this base sequence : 57560213
  Distance between 3'-terminus of neighbour sequence of sequence listing upward to telomere on chrosomal short arm and 5'-terminus of this base sequence : 66448
gctccaccccagacctactacattactgcatcaggatagtgtgtgtgtgtgtgtgtgtgtgtgtgtgtgtgtgtgtgtgtgttgaaaggtcagaaacttgtgttttttatctg

SEQ ID NO: 22912 - DNA, 212 bp, Homo sapiens
  Z67593
  Located on chromosome 17
  Distance between a terminus base of telomere on chromosomal short arm and 5'-terminus of this base sequence : 57633572
  Distance between 3'-terminus of neighbour sequence of sequence listing upward to telomere on chrosomal short arm and 5'-terminus of this base sequence : 73246
ggccctgcttttgaagtagggtatgagaactccagttatggtctctctctctcaatctgtatgtgtgtgtgtgtgtgtgtgtgtgtgtgtgtttgactttagagaaatctctttggcctcatttttggtgagagtgatacatcctaaagaatgaaaacatttttattcttctccaagtgatgggaaacaggctaatacagggtgggttctcc

SEQ ID NO: 22913 - DNA, 252 bp, Homo sapiens
  chr17.fa.O7frz.60700955
  Located on chromosome 17
  Distance between a terminus base of telomere on chromosomal short arm and 5'-terminus of this base sequence : 57728421
  Distance between 3'-terminus of neighbour sequence of sequence listing upward to telomere on chrosomal short arm and 5'-terminus of this base sequence : 94637
gatcaacagcttaggatgaatttcaaacttaagttggatggtttgagagggttggggtgtgtgtgtgtgtgtgtgtgtgtgtgtgtgtgtgtgtgtatgtgtgtgtgttcccaaatattactgagaaagtgctcttgaaatgcgccctgtgtatccatggattcatgcatattcatagcctgttcctctctgtaggttcaggtttttcttttctgtcaaacgaggcattaagtaaattctaaggtctcctgc

SEQ ID NO: 22914 - DNA, 243 bp, Homo sapiens
  chr17.fa.O7frz.60829747
  Located on chromosome 17
  Distance between a terminus base of telomere on chromosomal short arm and 5'-terminus of this base sequence : 57849506
  Distance between 3'-terminus of neighbour sequence of sequence listing upward to telomere on chrosomal short arm and 5'-terminus of this base sequence : 120833
aaccaggatacttcctacagtaagaggaattgctgttaataactgtgccagagcaatttgtgcacatggagacttccaggcaaacagagatgatggccacactacaaatgaaatgggggcaggcatgcaacagtatctaaggattattcaagttcttacaatttatggcatttagtttatttatttatttatttatttatttatttatttatttatttattgagacagagtcttgctctatcg

SEQ ID NO: 22915 - DNA, 422 bp, Homo sapiens
  chr17.fa.O7frz.60947930
  Located on chromosome 17
  Distance between a terminus base of telomere on chromosomal short arm and 5'-terminus of this base sequence : 57967480
  Distance between 3'-terminus of neighbour sequence of sequence listing upward to telomere on chrosomal short arm and 5'-terminus of this base sequence : 117731
tacttgtaatgcaacagcaataaggtgatggcctactgtgaagtcgggagcctcagacccagggcagacaatctgggctcagttcaagatttaatataatctagatgtgtgattttggtagatcacgtctcctggtttcagtttcccaattggtaaaattaaagtgctgagttgttcatttatccaacaaatatttgttgagctcttaatatgtgccaggttgttcaggagttggactaatgttaaatatttcatagttatttctctggttaaatgttgccctccaaagcatatatatatatatatatatatatatatctccacatcctaatcctgggaacctgtgaatgtgaccttatttgaaaaaaggctctttgcagatataactaagagatgaggtgatcgtagattaccaggtgagt

SEQ ID NO: 22916 - DNA, 475 bp, Homo sapiens
  chr17.fa.O7frz.61300639
  Located on chromosome 17
  Distance between a terminus base of telomere on chromosomal short arm and 5'-terminus of this base sequence : 58320406
  Distance between 3'-terminus of neighbour sequence of sequence listing upward to telomere on chrosomal short arm and 5'-terminus of this base sequence : 352504
ggtatagaccgatttgagttaatatataatcttaatcatttgattctaactagatggtataacatgcctgagagtttcaaggggcaagaaactagaaaaggagaagattcacatgaaagaaaaatatttttgtgttggaaaaactaatctactgtaggtgtgtgtgtgtgtgtgtgtgtgtgtgtgtgtgtatacatatatatgcatttgatttgtaagtatttaataagcaccttcaatgcaccaagcacagacccacactagaaaggaaaaaaatgaatgacactttcctgttctcaagtttctcatgctcaagagaaagagatacatagcgtaaaacataatacattataataaatctcgtttttacagaaataagggacttagggagcagaaaaactggtgtatttgattaattattcctgatgaatttagagatgactttgctaggtcctaaatgattggtgagtttcac

SEQ ID NO: 22917 - DNA, 426 bp, Homo sapiens
  chr17.fa.O7frz.61420796
  Located on chromosome 17
  Distance between a terminus base of telomere on chromosomal short arm and 5'-terminus of this base sequence : 58442506
  Distance between 3'-terminus of neighbour sequence of sequence listing upward to telomere on chrosomal short arm and 5'-terminus of this base sequence : 121625
tcagacttttagactcagatcaagactaacaccatcatcccgactccacccccaacccccaattctcaggccttctgcctcctgaatcagactcaccactgggtttcctggttgttcagtttgcagatggcagatcatgggacttctcagtctccataactgcatgatccaattcctataataaatctttataggattataaatatatatatatatatatatatatatacacacacacacacacacatgaacacacacatacatatgtgaagaataggatttatctgaaggacaggagatatatatattatatatatatgtatccaacatatgtatattatccaatatataatatttgttctatttctctggagaaccctgacgaatacagattttgttcggtactgagaatggttctagaggaac

SEQ ID NO: 22918 - DNA, 351 bp, Homo sapiens
  AC015724.4_137939
  Located on chromosome 17
  Distance between a terminus base of telomere on chromosomal short arm and 5'-terminus of this base sequence : 58518062
  Distance between 3'-terminus of neighbour sequence of sequence listing upward to telomere on chrosomal short arm and 5'-terminus of this base sequence : 75130
  misc_feature (1)...(351): n = A,T,G or C
agtactggaattacaggtgtgagccaccgcgcccagccagtagaaggatctcttgagcccanaaagttgaggctgcagtgagccttgatggggccactgcactctagcctgggccacagaacaagaacctatcttgatagacagatgatagatagatagatagatagatagatagatagatagatagatagatacatagatagatcaatagatagatatctggaaaataagccaacaacaaaacaatgagagtcccaggtgcaggtctctagtggagacggggaagaccccccttatctcccatcaccatcagaaactgtgagcagcatcttagtcaagccaaaagaactt

SEQ ID NO: 22919 - DNA, 235 bp, Homo sapiens
  AC005553.1_104760
  Located on chromosome 17
  Distance between a terminus base of telomere on chromosomal short arm and 5'-terminus of this base sequence : 58518178
  Distance between 3'-terminus of neighbour sequence of sequence listing upward to telomere on chrosomal short arm and 5'-terminus of this base sequence : -235
cagaacaagaacctatcttgatagacagatgatagatagatagatagatagatagatagatagatagatagatagatacatagatagatcaatagatagatatctggaaaataagccaacaacaaaacaatgagagtcccaggtgcaggtctctagtggagacggggaagaccccccttatctcccatcaccatcagaaactgtgagcagcatcttagtcaagccaaaagaactt

SEQ ID NO: 22920 - DNA, 272 bp, Homo sapiens
  AC005553.1_99578
  Located on chromosome 17
  Distance between a terminus base of telomere on chromosomal short arm and 5'-terminus of this base sequence : 58523361
  Distance between 3'-terminus of neighbour sequence of sequence listing upward to telomere on chrosomal short arm and 5'-terminus of this base sequence : 4948
ggatgcataggtgtacatgtagatggatggacatgtggatggatgagtagatggatggatggatggatggatggatgaattgatggagagtcagtaggtgaacggatgaaaggatgatgaacagtcgtgtacatcaatgggttaatggatggatgggtcgatagatgggtcaggggatggatgaaatgctaggcccttttttttgttcatttatgtctttttatgcttcaaacactgccttgaattccctttgaacaaagtagtggtttaaa

SEQ ID NO: 22921 - DNA, 393 bp, Homo sapiens
  AC005553.1_90474
  Located on chromosome 17
  Distance between a terminus base of telomere on chromosomal short arm and 5'-terminus of this base sequence : 58532259
  Distance between 3'-terminus of neighbour sequence of sequence listing upward to telomere on chrosomal short arm and 5'-terminus of this base sequence : 8626
aatccaagcctcttaccacctggaagaacctactggaccaccacttacacattgcctaatatctctgctccaaagcgctaccccatctttgctcactgcatcccagccttctgcccagctgggctgttggctgaatgtggtcagggccagaatgaaaagtaggcaaagtggacagcttaaggacctcctgtatctttgtctccagcctcagatggagagtccagggccagagctcacctatacagtaccttattattattattattattattattattattatactttaagttctagggtacatgtgcacaacgtgcaggtttgttatataagtatacgtgtgccatgttggtttgctgcacccatcaactcgtcatttacattaggtaattc

SEQ ID NO: 22922 - DNA, 449 bp, Homo sapiens
  AC005553.1_88894
  Located on chromosome 17
  Distance between a terminus base of telomere on chromosomal short arm and 5'-terminus of this base sequence : 58533965
  Distance between 3'-terminus of neighbour sequence of sequence listing upward to telomere on chrosomal short arm and 5'-terminus of this base sequence : 1313
tcctttagaccttgaatgtttccagtgtccccattttttaatattaaatgatacctaattattctgatgcatcttagtgggtactagctgccaaccaataacaagaatagagtttgttgttgttattgttgttgttgttgttgttgttgttgttgttaagatggaatctcactctgtcacccaggctggactgcagtgtagtgatctcagctcactacaacctccatctcctgggttcaagcaattctcatgcctcagcctctcagtagctgggatcacaggtacctgccaccacacccagataacttttgtatttttagtagagacagggtttcaccatgctgaccaggctggtcttgaacttctgacctcaagtgatctgcctgcatcggcctccgaaagtgttgggattacaggtgtgagccaccacacctggccaagaatagagt

SEQ ID NO: 22923 - DNA, 413 bp, Homo sapiens
  AC015883.3_145313
  Located on chromosome 17
  Distance between a terminus base of telomere on chromosomal short arm and 5'-terminus of this base sequence : 58680694
  Distance between 3'-terminus of neighbour sequence of sequence listing upward to telomere on chrosomal short arm and 5'-terminus of this base sequence : 146280
gacattatcaaagtttataggcactagaatttgaccttcagtaaattcaacattggagggtaacagggttttctttcctttcttcaaaatgaaaaatgagagggaggaaaaagatttatttccttctggggctggagtaacaactggaaatggtattccccagcttaaagaaagaaagaaagaaagaaagaaagaaagaaagaaagaaagaaagaaagaaagaaagaaagaaaacctttgttaaattacataaagtaatataagaagtcactttccttagaaaaaaatttaaacctcatagaaaaggcaaaagttgtgcggtggctcatgcctgcccagcactttgggaggccacagcgggctgatcacttgaggccaggagtttgagaccagcctggctaacatggtgaaac

SEQ ID NO: 22924 - DNA, 176 bp, Homo sapiens
  HUMUT214
  Located on chromosome 17
  Distance between a terminus base of telomere on chromosomal short arm and 5'-terminus of this base sequence : 58680834
  Distance between 3'-terminus of neighbour sequence of sequence listing upward to telomere on chrosomal short arm and 5'-terminus of this base sequence : -273
caactggaaatggtattccccagcttaaagaaagaaagaaagaaagaaagaaagaaagaaagaaagaaagaaagaaagaaagaaagaaagaaaacctttgttaaattacataaagtaatataagaagtcactttccttagaaaaaaatttaaacctcatagaaaaggcaaaagttg

SEQ ID NO: 22925 - DNA, 178 bp, Homo sapiens
  HUMUT5155
  Located on chromosome 17
  Distance between a terminus base of telomere on chromosomal short arm and 5'-terminus of this base sequence : 58680839
  Distance between 3'-terminus of neighbour sequence of sequence listing upward to telomere on chrosomal short arm and 5'-terminus of this base sequence : -171
ggaaatggtattccccagcttaaagaaagaaagaaagaaagaaagaaagaaagaaagaaagaaagaaagaaagaaagaaagaaagaaaacctttgttaaattacataaagtaatataagaagtcactttccttagaaaaaaatttaaacctcatagaaaaggcaaaagttgtgcggtg

SEQ ID NO: 22926 - DNA, 250 bp, Homo sapiens
  D17S1605
  Located on chromosome 17
  Distance between a terminus base of telomere on chromosomal short arm and 5'-terminus of this base sequence : 58694432
  Distance between 3'-terminus of neighbour sequence of sequence listing upward to telomere on chrosomal short arm and 5'-terminus of this base sequence : 13415
atattatccaaccagcatcgccctcttctttgtcatttgttcgacactttctggatccttagactggaacacttcagactgaagagtttacctgaattttgtcacccctaaagtgtctccaccttgtctactttcacatgtagtttggttcagtttaatgaacgtgtgtgtgtgtgtgtgtgtgtgtgtgtgtatgtgtgtgtgtgtgtgtgttttcaagaatattttctggactcacagtggttctgtc

SEQ ID NO: 22927 - DNA, 233 bp, Homo sapiens
  AC004584.1_34356
  Located on chromosome 17
  Distance between a terminus base of telomere on chromosomal short arm and 5'-terminus of this base sequence : 58922116
  Distance between 3'-terminus of neighbour sequence of sequence listing upward to telomere on chrosomal short arm and 5'-terminus of this base sequence : 227434
atcctatgagccaattccttacaataaatcccatgtctgtgagtgagtatttgtgtgtgtgtgtgtgtgtgtgtgtcttactggttatgtttctctgaataaccctacttcatccaaaatttcactataggaaagcaattttgttcctccatcaacaggcaacagctaatcctagtatgtgcagtctgatgatgatggaagtcttgagactgtcctcaatgttaagcaaattg

SEQ ID NO: 22928 - DNA, 474 bp, Homo sapiens
  chr17.fa.O7frz.61938283
  Located on chromosome 17
  Distance between a terminus base of telomere on chromosomal short arm and 5'-terminus of this base sequence : 59069636
  Distance between 3'-terminus of neighbour sequence of sequence listing upward to telomere on chrosomal short arm and 5'-terminus of this base sequence : 147287
attgcctagttaataaggaatcacaatctaaatttactgacctggccaggcgcggtggctcacgcctataatcccagcagtttttgaggccaaggtgggtggatcacttgaggtcaggagttcgagcccagcctggccaacatggtgtgaaactccatctctgctaaaacacacacacacacacacgcacacacacacacacaaacattagccaggcatggtgccgtgtgcctgtaatcccagctacttgggaggctgaggtgggagaatcacttgaacctaggaggcagaggttgctgtaagccgagatcgtgcccactgcactccagcttgggcgacagagcaagactctgtcttaaataaataaataagtaaacaaacaaacaaactgaccggatgaaaacctgggtttagactccactcctcttcctgctggcatgtgccctgttaggtaggatttgaatcttttgacag

SEQ ID NO: 22929 - DNA, 298 bp, Homo sapiens
  AC007644.1_87781
  Located on chromosome 17
  Distance between a terminus base of telomere on chromosomal short arm and 5'-terminus of this base sequence : 59191560
  Distance between 3'-terminus of neighbour sequence of sequence listing upward to telomere on chrosomal short arm and 5'-terminus of this base sequence : 121450
aagataagaatgacaggagacttctcttctagaagtatgcgtgccaaaagtacatggagcaacatctttgaattactgatagaaacaaaacaaaacaaaacaaaacaaaacaaaactgttaaccctaaattctatagccagcaaaaatgtatttcaaaaatagagaacaaataaagactttctctggagataacaaagccagcagaattcatcacaagcaaatctgtactacaagaaatattaaaagaggttcttcaggcagaagaaaatgacactagatgaaaattagtatcagcca

SEQ ID NO: 22930 - DNA, 428 bp, Homo sapiens
  AC003950.1_112699
  Located on chromosome 17
  Distance between a terminus base of telomere on chromosomal short arm and 5'-terminus of this base sequence : 59191835
  Distance between 3'-terminus of neighbour sequence of sequence listing upward to telomere on chrosomal short arm and 5'-terminus of this base sequence : -23
tagatgaaaattagtatcagccaggtggagtggttcatacctgtaatcccagcactttggaaggccaaggcaggaggattacttgagcccaggagttcaagaccagcctgggcaacatagtgagaccgtatctttattttaaaaataaataaataaataaataaataaataaataaataaataaataaataaataagaaaattagaatctatacaaaggaatacaaagtgccacaagtggtaaaggtataggaaaatgtaacagattttttcctcacttttaaatctcttgaacagataattaatagcttaaagcaaaaaaaaaaaaagtattgtgggatttatagcacatgtacaggtctgacaaaaatagcacagatgggaaaagagatatgaaagtatactgttgtaaggttcatatgctaaatg

SEQ ID NO: 22931 - DNA, 128 bp, Homo sapiens
  D17S957
  Located on chromosome 17
  Distance between a terminus base of telomere on chromosomal short arm and 5'-terminus of this base sequence : 59372185
  Distance between 3'-terminus of neighbour sequence of sequence listing upward to telomere on chrosomal short arm and 5'-terminus of this base sequence : 179922
ccactctgccttcaacacacacacaaaacacacacagcacacacaccacacacacacacacacacacatcccatttgctttatcctattttataaaaatacaaacagtggtcccattcctagtgaccg

SEQ ID NO: 22932 - DNA, 155 bp, Homo sapiens
  D17S1853
  Located on chromosome 17
  Distance between a terminus base of telomere on chromosomal short arm and 5'-terminus of this base sequence : 59426219
  Distance between 3'-terminus of neighbour sequence of sequence listing upward to telomere on chrosomal short arm and 5'-terminus of this base sequence : 53906
tcaatctatctgtttctctgtgtgtgttggggggggggggtgtaaatctcttcccattggtttttgtctttgtctctctgtgtgtgtgtgtgtgtgtgtgtgtgtgtgtgtgtgtgtgtgtgtgtgtgtgtgtctcccccacccccgacaatgac

SEQ ID NO: 22933 - DNA, 161 bp, Homo sapiens
  D17S1606
  Located on chromosome 17
  Distance between a terminus base of telomere on chromosomal short arm and 5'-terminus of this base sequence : 59445395
  Distance between 3'-terminus of neighbour sequence of sequence listing upward to telomere on chrosomal short arm and 5'-terminus of this base sequence : 19021
tgatgagtcttcatagccccctgatatacctgggtgtgtgtgtgtgtgtgtgtgtgtgtgtgtgtgtgtgtgtgtgtgtgtgtgtgacagagagagagagagagagacaaagacagagaccgagagagttatcagctggctggctccaggattgaatacca

SEQ ID NO: 22934 - DNA, 207 bp, Homo sapiens
  HUMUT5608
  Located on chromosome 17
  Distance between a terminus base of telomere on chromosomal short arm and 5'-terminus of this base sequence : 59482712
  Distance between 3'-terminus of neighbour sequence of sequence listing upward to telomere on chrosomal short arm and 5'-terminus of this base sequence : 37156
tccagcatttaacatacccataatggccccattttagtggctgactgtctgtctgtctgtctgtctgtctctctctctctttccctctcacacacacacaggcgcgcacacacacacacacacacacacacacacacacacacataggcctctgtacagatggaccctgcttccaaaatggagagtttgcattttcctttcatccct

SEQ ID NO: 22935 - DNA, 364 bp, Homo sapiens
  AC005325.1_122074
  Located on chromosome 17
  Distance between a terminus base of telomere on chromosomal short arm and 5'-terminus of this base sequence : 59577918
  Distance between 3'-terminus of neighbour sequence of sequence listing upward to telomere on chrosomal short arm and 5'-terminus of this base sequence : 94999
tgtccttcatagctccataagggcgcgcagagcacaacagagaggggtctagagacccgctccttgcaccctgggctgggtgggggcactgcagggtctaggaggcccctaaagctgatcaacctgcaggttggtgagaaccatccaaggagcatgtgcccgggtgtatcattcatggttgcttgtgttttgcagaggttttttttttatttggttggttggttggttggttggtttgttgttgttgttttgagacagactctcacatgttgcccaggctggaatgaagtgcagtcttgaactcctgagctcaagtgaacctctttcctcagcctcccaagtagttggaaatgtaggttcatac

SEQ ID NO: 22936 - DNA, 375 bp, Homo sapiens
  AC005325.1_89914
  Located on chromosome 17
  Distance between a terminus base of telomere on chromosomal short arm and 5'-terminus of this base sequence : 59609997
  Distance between 3'-terminus of neighbour sequence of sequence listing upward to telomere on chrosomal short arm and 5'-terminus of this base sequence : 31715
ctaagtctgcacagacctaagtctgtggtccattttgagttaacatttatgtatggtgtgagatatggggtctggtttttcttttattccacatattgaaatccagttgttctagcaccatttgttgaaaagaatatcctttctctattaaattgagttttgttgtacctttgtcaaaaatcagttgactatttgtgtgggtctttctgaattctctattctgttctgtaccactaatcaatctctctctctttctctctctctctctctctctcatctatctatctatctatctatctatctatctatctatctatattgccataccacactatcttggttgtatctttatactaagtattgcgatcaggtaga

SEQ ID NO: 22937 - DNA, 236 bp, Homo sapiens
  AC005325.1_16651
  Located on chromosome 17
  Distance between a terminus base of telomere on chromosomal short arm and 5'-terminus of this base sequence : 59683364
  Distance between 3'-terminus of neighbour sequence of sequence listing upward to telomere on chrosomal short arm and 5'-terminus of this base sequence : 72992
ttaagcatgaactttgaagtctgatcaggccatgagtcctggcttcatctctctcttggttatgatttcaggcaaagtcctctgagcttgtgtttcatggcagcatggttcgtaatagacctttgttgtgtgtctctgagctttggtttccccaactgtaggccagaggtagtaattgtttgtttgtttgtttgtttgtttgtttgtttgttttgagacggagtctagctttgtca

SEQ ID NO: 22938 - DNA, 201 bp, Homo sapiens
  DISO7_00000822
  Located on chromosome 17
  Distance between a terminus base of telomere on chromosomal short arm and 5'-terminus of this base sequence : 59812278
  Distance between 3'-terminus of neighbour sequence of sequence listing upward to telomere on chrosomal short arm and 5'-terminus of this base sequence : 128678
ggaaatctgcctgagcttcttggcttcagagctgaagaggccccaaaagggggtgaaaggaagggaagaggagagcaagagacagaggctctcagggtatgtgtgtgtgtgtgtgtgtgtgtgtttcaggcagccctgacagagacgccttgtcctcctgcccctgcaaaggcttgttttcttcccaagctattaatgtcg

SEQ ID NO: 22939 - DNA, 222 bp, Homo sapiens
  AC015813.3_77991
  Located on chromosome 17
  Distance between a terminus base of telomere on chromosomal short arm and 5'-terminus of this base sequence : 60036881
  Distance between 3'-terminus of neighbour sequence of sequence listing upward to telomere on chrosomal short arm and 5'-terminus of this base sequence : 224402
acaggtacgtatgcacttaaatacatgcacaaagagagatttggataaactttaatcctctgggaagggattgactttaggggttggagtttagggcaacctaatctatctatctatctatctatctatctatctatctatctatctagagaatgtaattatgaggaaggaaaaatacatgctatccaaatattaacaatgtctgtcaactgatgtatggat

SEQ ID NO: 22940 - DNA, 188 bp, Homo sapiens
  D17S1290
  Located on chromosome 17
  Distance between a terminus base of telomere on chromosomal short arm and 5'-terminus of this base sequence : 60181432
  Distance between 3'-terminus of neighbour sequence of sequence listing upward to telomere on chrosomal short arm and 5'-terminus of this base sequence : 144329
ggcaacagagcaagactgtccagatagatagatagatgatgatagatatatagatatatagatatatagatagatagatagatagatagatagatagatagatagactctcctaaagattagagggcacagggagaagtcctttatccccttatgagacacctggtctttggccatttaactgttccc

SEQ ID NO: 22941 - DNA, 434 bp, Homo sapiens
  AC005666.1_39381
  Located on chromosome 17
  Distance between a terminus base of telomere on chromosomal short arm and 5'-terminus of this base sequence : 60388261
  Distance between 3'-terminus of neighbour sequence of sequence listing upward to telomere on chrosomal short arm and 5'-terminus of this base sequence : 206641
acaaagacaaattctgtgttctacaaatatatttaaaacataatggggccaggtgcagtggctcacgcctgtaatcccagcactttgggaggccgaggtgggcggatcaccttaggtcaggagttcaacaccagccaacatggtgaaaccctgtctctactaaaaatacaaaaaaatagccagcctggggggacacacctgtaatcctggttactcaggaggctgaggcagaaggattccttgaacccaggaggtggaggttgcagtgagccaagattgcgctactgcactccagcccgagcaacagagcgagattccatctcacaacaacaacaacaacaacaacaacaacaaaccataatgggcctatattttgtctactgaatttacaatattatcttaacacaatatactagatcttgacagtcaggcta

SEQ ID NO: 22942 - DNA, 296 bp, Homo sapiens
  AC005666.1_150403
  Located on chromosome 17
  Distance between a terminus base of telomere on chromosomal short arm and 5'-terminus of this base sequence : 60499410
  Distance between 3'-terminus of neighbour sequence of sequence listing upward to telomere on chrosomal short arm and 5'-terminus of this base sequence : 110715
ctgtcttaacctgaaatgtgatactttcaaggcagtctttatactgactggcagctgaagaaacggaccctgttggagaaaagcggaaggttactgtctgaatcctttatattatttctccttttttcctttttccctttgtttttgttttttctgccccaatatgatgtgcagaaatgaatcttttacattattaaaacaaacaaacaaacaaacaaacaaacaaaacatccaaacccacaaacctatacctatactaaggattttccaaattgttaataactgaaataaggccg

SEQ ID NO: 22943 - DNA, 262 bp, Homo sapiens
  chr17.fa.O7frz.63859818
  Located on chromosome 17
  Distance between a terminus base of telomere on chromosomal short arm and 5'-terminus of this base sequence : 60898250
  Distance between 3'-terminus of neighbour sequence of sequence listing upward to telomere on chrosomal short arm and 5'-terminus of this base sequence : 398544
attctaatccagattattggctcattgaatccagtgagtaggaaaaatctagtttgtatttgctgggggtgtgtgtgtgtgtgtgtgtgtgtgtgtgtgtgtgtgcacgcgtgtgttttaagagacagggtcttgctctgtcacccaggctggagtacggtggcagaatcatggctcactgtaccctcgaactcctaggctcaagtgatcctacggccacagtctcccaagtagccaggactacagccagttgagtcaataa

SEQ ID NO: 22944 - DNA, 286 bp, Homo sapiens
  DISD22_0010921
  Located on chromosome 17
  Distance between a terminus base of telomere on chromosomal short arm and 5'-terminus of this base sequence : 61143382
  Distance between 3'-terminus of neighbour sequence of sequence listing upward to telomere on chrosomal short arm and 5'-terminus of this base sequence : 244870
gtattacatgtattggctgaagggtgtgtgtgtgtgtgtgtgtgtgtgtgtgtgtgtaagtgtaatattttttcataacgatttatagtgaacattgttttatttcagaacttaggtatttattttattattgctaaaaattatgtaacattgtattgtatggatatttatattgttttttcccagttggttatgttgttatatacttccatatatgtacatttaaaaaagtatacaaggaatttttttttaagggtaacacctaatggggaattgctcacatgtg

SEQ ID NO: 22945 - DNA, 473 bp, Homo sapiens
  chr17.fa.O7frz.65834149
  Located on chromosome 17
  Distance between a terminus base of telomere on chromosomal short arm and 5'-terminus of this base sequence : 61286332
  Distance between 3'-terminus of neighbour sequence of sequence listing upward to telomere on chrosomal short arm and 5'-terminus of this base sequence : 142664
atcacttaaggttaggagtttgagaccattctggccaacatggtgaaaccctgtctctactaaaaatacaaaaattagccaggcatggtggtggatgcctgtagtccagctactcaggaggccgaggcagaagagtcacttgaactcgggaggcggaggttgaattgagccgagatcgggccactgcactccagccttcgcaacagagtaagaccctgactctaataataataataataatataataataataataataataataataataattaaagatggctttaaaacatcctaagtctaatgagtcataaacctacaaattcaagctcagcaaatccccaaacagaaaacattaagaaatcctgacataaccaaattgctaaaaactaaagagaaaaacaatcttgaaagccaccagagggaaaatataatgcatactgacatacacaggactaatttaaatgactgca

SEQ ID NO: 22946 - DNA, 459 bp, Homo sapiens
  chr17.fa.O7frz.65663456
  Located on chromosome 17
  Distance between a terminus base of telomere on chromosomal short arm and 5'-terminus of this base sequence : 61380547
  Distance between 3'-terminus of neighbour sequence of sequence listing upward to telomere on chrosomal short arm and 5'-terminus of this base sequence : 93742
atcttaattgagaccagttcaaggctacagtgagctatgatcatgccacttctctccagcctggatgacagagcaggaccttgtctctaaaacataaataaataaataaataaataaataaataaataaataaataataaataaataaaatatttttaaaaattctattgggtgtaaaggggtatctcatgattttggtttgcatttccctaatcattaatgatgttgagcctcttatttcgtgtttattggcatttatatatcttttgtggagaaatatctgttcatatcagccaggcgtggtggctcacacctgtaatcccagcactttgggaggccgaggtgggtagatcacaaggtcaagagattgagagcatcccggctaacatggtgagaccctgtctctactaaaaatacaaaaaagattagttgggcatggtgacacgtacctgtagttcc

SEQ ID NO: 22947 - DNA, 295 bp, Homo sapiens
  Z67437
  Located on chromosome 17
  Distance between a terminus base of telomere on chromosomal short arm and 5'-terminus of this base sequence : 61487656
  Distance between 3'-terminus of neighbour sequence of sequence listing upward to telomere on chrosomal short arm and 5'-terminus of this base sequence : 106650
cgttcggtgaaagatgagttgcattttagatccttttagaactctaagacatcttaaaaatcttcaccagttttttaattcttctgtcttatctgcttctctgtccttcctttcatctttctggaaacaggattataaggcgatgtgtgtgtgtgtgtgtgtgtgtgtgtgtgtgtgtaagaatcggctgaattaaaatgattcttaacttttaaattgtagtaataaaatacagtgggtgaatttcttctaatccctttctttaaaatctggcatttatattgctcttagtagc

SEQ ID NO: 22948 - DNA, 393 bp, Homo sapiens
  chr17.fa.O7frz.65433111
  Located on chromosome 17
  Distance between a terminus base of telomere on chromosomal short arm and 5'-terminus of this base sequence : 61584494
  Distance between 3'-terminus of neighbour sequence of sequence listing upward to telomere on chrosomal short arm and 5'-terminus of this base sequence : 96543
aggttaattcagaccttcaataacaatgctttgtgttgtttttgtgtttatacacacacacacacacacacacacacacacacacatacacacacagagagagaagcactttagctaaaatataaggacctagtgcttagatttaagtgatatgggtctcagctttttctatcttgtgctttattattagccttgacagatgaagttataaaggaatctacctaggtgttgtatgaagtttttttctcactgacttattttaggttgttgactcttaaaatggaaatttatattttatgctattcttctctttttagaagagatccatgactcagaaacataaaaaatcagatttgactgtataatttttggtctaccagttatgtggaatga

SEQ ID NO: 22949 - DNA, 194 bp, Homo sapiens
  D17S792
  Located on chromosome 17
  Distance between a terminus base of telomere on chromosomal short arm and 5'-terminus of this base sequence : 61713418
  Distance between 3'-terminus of neighbour sequence of sequence listing upward to telomere on chrosomal short arm and 5'-terminus of this base sequence : 128531
ctacagtgaaggagtgaaggctggtgtgtgtgtgtgtgtgtgtgtgtgtgtgtgtgtgtgtgtgtaccccatgcagtcacccacggggcctcagaaatgaatgaaaggagggctcaggggccaggctggaccctctttgtgaataagggggttctcctccctcgccctcagagggaactgtctcagaagccagg

SEQ ID NO: 22950 - DNA, 267 bp, Homo sapiens
  HUMUT5239
  Located on chromosome 17
  Distance between a terminus base of telomere on chromosomal short arm and 5'-terminus of this base sequence : 61731650
  Distance between 3'-terminus of neighbour sequence of sequence listing upward to telomere on chrosomal short arm and 5'-terminus of this base sequence : 18038
caacagtgcaacagtgtgagaccctgtctgtaaaaagaaagaaagaaagagagagacagagagagagagaggaaagaaagaaaaaaagagagaggaaagaaagagagagacagagagagagaggaaagaaagaaaaaagagagaggaaagaaagagacagaaagaaggagagaaagaaagaaaagaaagaaagaaagaaagaaagaaagaaagaaagaaagaaagaaagaaagaggaagaaggaaaggactagcaggggtgggggct

SEQ ID NO: 22951 - DNA, 208 bp, Homo sapiens
  DISO7_00029557
  Located on chromosome 17
  Distance between a terminus base of telomere on chromosomal short arm and 5'-terminus of this base sequence : 61754675
  Distance between 3'-terminus of neighbour sequence of sequence listing upward to telomere on chrosomal short arm and 5'-terminus of this base sequence : 22758
gactccacgtcctggtagatggggaaggagagagggagttgtgcccagggtcccctgattacttctatgggtgcatgtttgtgcatcttgttaggggtccttgggggtatggaagattctcccctgggtgcccttgatcacctgtgtgtgcgtgtgtctgtgtgtgtgtgcattagggggtgtactgtgttacagcatcctcaaccaa

SEQ ID NO: 22952 - DNA, 446 bp, Homo sapiens
  chr17.fa.O7frz.64636094
  Located on chromosome 17
  Distance between a terminus base of telomere on chromosomal short arm and 5'-terminus of this base sequence : 61771994
  Distance between 3'-terminus of neighbour sequence of sequence listing upward to telomere on chrosomal short arm and 5'-terminus of this base sequence : 17111
atgtttaagcactattagcagaagagtttcagaagagaatttaaataaaatacagttaacttggctggtttagtccataagataatagtgacagtggtggtgtttgtggaggaaaactgtattgctagaggacaagggtgacagaaagacttgatttttttttttccatgctttttcttttctggggtgtgtgtgtgtgtgtgtgtgtgtgtgtgtgtgtgtattttgtaccatgcgaatttattatattacctttggaggaaagggggataaaactagtctggccaaggctaataaaataaagcctccatgtagcttcttttagtaggacttaatctgttacaacatagttagtcacccagagtattaataacccactatggtagagatttcttcctagtaacaagtgacttttgttcttacatacttaattggtttgcaaagac

SEQ ID NO: 22953 - DNA, 123 bp, Homo sapiens
  D17S1604
  Located on chromosome 17
  Distance between a terminus base of telomere on chromosomal short arm and 5'-terminus of this base sequence : 61995342
  Distance between 3'-terminus of neighbour sequence of sequence listing upward to telomere on chrosomal short arm and 5'-terminus of this base sequence : 222902
ctgggtgacagaaacctaattgctaaacacacacacacacacacacacacacacacacacacacacacacacacacacacacacacccctatgtgtttttgttgtgtatgttggctgtgtact

SEQ ID NO: 22954 - DNA, 397 bp, Homo sapiens
  chr17.fa.O7frz.65077937
  Located on chromosome 17
  Distance between a terminus base of telomere on chromosomal short arm and 5'-terminus of this base sequence : 62019871
  Distance between 3'-terminus of neighbour sequence of sequence listing upward to telomere on chrosomal short arm and 5'-terminus of this base sequence : 24406
tgcaggcataagcagatacatattatatatattctcatttcccctttcttgtacaaaagatagcatagtatccatgctgctgtacttttaagtactcttttgtatcttgtttttatagaaatttttcttatttttattttatttatttatttatttatttatttatttttttgagacggagtctcactttgtcacccaggctggagtgcagtggcgtgatctcggctcactgcaagctccgcctcccaggttcatgccattctcccgcctcagcctcccaagtagcttggactacaggcacctgccaccatgcccgactaatttttttttgtatttttagtagagatggcgtttcaccgtgttagccaggatggtcttgatctcctaacctcattat

SEQ ID NO: 22955 - DNA, 470 bp, Homo sapiens
  chr17.fa.O7frz.65202248
  Located on chromosome 17
  Distance between a terminus base of telomere on chromosomal short arm and 5'-terminus of this base sequence : 62144214
  Distance between 3'-terminus of neighbour sequence of sequence listing upward to telomere on chrosomal short arm and 5'-terminus of this base sequence : 123946
atggtaatgccttagttcatttatatatatggtaatgcctgtagttatatatatatttatgtataacactacatatatatatgtagagagagagagagacagagagtgtgtgtgtgtgtgtgtgtgtgtgtgtgtgtgtctggctctgccacccaggctggagtgcagtggtatgatctctgctcattacaaccttcacatcccaggctcaagtgagcctcccatctcagcctcccaagtagctgggactacaggtgcataccaccatgcctggctaatttttaaaattttttgtagagacagggttttgccaagttgcccaggctggtctcaaactcctgagctcaagcaatccacccgccttggcctcccaaagtgctgggattacaggcatgagccaccatgcctggcccatgaccatattttagtagcaattacagatatcagattacaaagcaatttagtttcct

SEQ ID NO: 22956 - DNA, 242 bp, Homo sapiens
  AC005206.1_36612
  Located on chromosome 17
  Distance between a terminus base of telomere on chromosomal short arm and 5'-terminus of this base sequence : 62371055
  Distance between 3'-terminus of neighbour sequence of sequence listing upward to telomere on chrosomal short arm and 5'-terminus of this base sequence : 226371
cagtgagcctagactgcaccattgcacttcagcctgggtgagaccccatctcaaatcaatcaatcaatcaatcaatcaatcaatcaataagggaaaagctatcacacagcagaatacagtccaagggtaactactgaagggccagatcaaggagcaaagtctatcatgtatcaacctttacagtgtccccaagggtcagctgtgtataggggcccacacagaatttggaatccaaatacatc

SEQ ID NO: 22957 - DNA, 469 bp, Homo sapiens
  AC018718.5_167357
  Located on chromosome 17
  Distance between a terminus base of telomere on chromosomal short arm and 5'-terminus of this base sequence : 62420730
  Distance between 3'-terminus of neighbour sequence of sequence listing upward to telomere on chrosomal short arm and 5'-terminus of this base sequence : 49433
caagtgcttcataaacttcaagactatatactttgttactgttagaatgtttctattatgcagctttaaacaaaactcattaggctgagcgtggtggctgaagcctgtaatcccagcacttttcccagcactttgggagcctgaggcaggtgatcacttgaggtcgggagttcgagaccagcctggccaacatgacgaaacccagtctctactgaaaatacaaaaattagctgggcgtggtgatgcatgcctgtaatcccagctactcgggaggctgaggcaggaaaatcacgtgaacccgggaggtagaggttacagtaagccgaggtcacaccactgcactctagattgggtgacagagtgagaccctgtcaaaacaaaacaaaacaaaacaaaaaccccaaacttattgatgtgctgagttcactcagaaacaaaaaaaacttactggtacaaacgtaaacttgag

SEQ ID NO: 22958 - DNA, 262 bp, Homo sapiens
  chr17.fa.O7frz.64279288
  Located on chromosome 17
  Distance between a terminus base of telomere on chromosomal short arm and 5'-terminus of this base sequence : 62463673
  Distance between 3'-terminus of neighbour sequence of sequence listing upward to telomere on chrosomal short arm and 5'-terminus of this base sequence : 42474
gtatcctaccaatatgtctggacacaataactaagagggaaaaatctaacctgtggctgcatcaggcgtgtgtgtgtgtgtgtgtgtgtgtgtgtgtgtgtgtttgtgcctgaaggcagataacagcatcagaaactggatgcctaacaagattcgcctgcacacagggactgggccatcacaatgggaagtaaccaggactggggtagcccaggaggtatgggaacttgtgcctcttattaagacctgatggtagacaaac

SEQ ID NO: 22959 - DNA, 426 bp, Homo sapiens
  chr17.fa.O7frz.64728045
  Located on chromosome 17
  Distance between a terminus base of telomere on chromosomal short arm and 5'-terminus of this base sequence : 62576761
  Distance between 3'-terminus of neighbour sequence of sequence listing upward to telomere on chrosomal short arm and 5'-terminus of this base sequence : 112826
gctagattagtcactgttgcagtttgaagacacatacagtaaatacatcaggtttttctggataaaaggtagtctagctagacaagatggctcacacctgtatgtaatcccagcactttgggaggctgagacaggaggagcacttggtacccagaagatcactctgggtaacatagtgagactctgtctctacaaacaaaacaaaacaaaacaaaacaaaacaaaacaattctgcaatctggatacccttatttatactaatcaacattgtattgctctgccagggttgtcataacagaataccacagacaaaacatggcaaaaccccatctatgtttaaacaacagaaattgtttttctcccagttttgtaggctgcaagtccaagatcaaggtgccagcagggtttatttctggtgaggactct

SEQ ID NO: 22960 - DNA, 282 bp, Homo sapiens
  chr17.fa.O7frz.64115225
  Located on chromosome 17
  Distance between a terminus base of telomere on chromosomal short arm and 5'-terminus of this base sequence : 62641498
  Distance between 3'-terminus of neighbour sequence of sequence listing upward to telomere on chrosomal short arm and 5'-terminus of this base sequence : 64311
aaacaatgtcctcaaatgaaccccttggcccctcctctaggttattaaaaaaacaaaaacaaaaacaaaaacaaaatcaaaatcctacccactattctaacagcccactagagaacagtaagaaattgtaattaaaagccaaagaggaaagcagctgcgcttaaggccagggctggtaactaagaaagaaattttatatataagacacacacacacacacacacacacacacacacacatttggaataaaatggctttatgatgaggatttatgtccttcat

SEQ ID NO: 22961 - DNA, 138 bp, Homo sapiens
  chr17.fa.O7frz.66030236
  Located on chromosome 17
  Distance between a terminus base of telomere on chromosomal short arm and 5'-terminus of this base sequence : 62899338
  Distance between 3'-terminus of neighbour sequence of sequence listing upward to telomere on chrosomal short arm and 5'-terminus of this base sequence : 257558
tgtacctatcctaatttgtttcagcttctgtactgaccacattacacattctttcgtagtatccgatgacttacacacacacacacacacacacacacacacacacacacacactctgtaggaagcttaaagatagac

SEQ ID NO: 22962 - DNA, 186 bp, Homo sapiens
  Z67502
  Located on chromosome 17
  Distance between a terminus base of telomere on chromosomal short arm and 5'-terminus of this base sequence : 63002965
  Distance between 3'-terminus of neighbour sequence of sequence listing upward to telomere on chrosomal short arm and 5'-terminus of this base sequence : 103489
gtattagccaccgcacctgactggggtcctgagtttttttaagcacactgggatcctgaattttaaaatgtttgaaaaccactggtatgcatattctcgtacacacacacacacacacacacacacacattaaattactagtttgtttgtttatttctacagaaattcagatgagattggattggg

SEQ ID NO: 22963 - DNA, 441 bp, Homo sapiens
  AC005746.1_116108
  Located on chromosome 17
  Distance between a terminus base of telomere on chromosomal short arm and 5'-terminus of this base sequence : 63205844
  Distance between 3'-terminus of neighbour sequence of sequence listing upward to telomere on chrosomal short arm and 5'-terminus of this base sequence : 202693
ctttccaatctacttccaaaagggagccagaatccaagcccccaaaggggacgtcccacaccctgcatcctccaccttttcagtcatccttctcacccttctctggcaacagagagttcagtgccctcaagtgtgggctgccttccagttcaaagtagtcacatgccattatttatttatttatttatttatttatttattattattattattatttgagatggagtcttgccctgtcgcctaggctggagtgcagtggcgcaatcttggctcactgcaatctctgcctcctgggttcaagcagttctcctgcctcagcctcctgagtggctgggatgagaggcaccctgcaccatacccggctactttttatatttttagtagagatgagatttcgccatggtggccaggttggtctctaactcctgactttaggtgatc

SEQ ID NO: 22964 - DNA, 154 bp, Homo sapiens
  D17S1838
  Located on chromosome 17
  Distance between a terminus base of telomere on chromosomal short arm and 5'-terminus of this base sequence : 63282357
  Distance between 3'-terminus of neighbour sequence of sequence listing upward to telomere on chrosomal short arm and 5'-terminus of this base sequence : 76072
gatcacgggatggtttcagcaagttaataacaaatatttgttgattgctatgttttgcaaaagatgacctaaaagcactatttgtgtgtgtgtgtgtgtgtgtgtgtgtgtgtgtgtgtactaataaagtctttcattttaagactgtaaaaag

SEQ ID NO: 22965 - DNA, 239 bp, Homo sapiens
  AC005901.1_64907
  Located on chromosome 17
  Distance between a terminus base of telomere on chromosomal short arm and 5'-terminus of this base sequence : 63411826
  Distance between 3'-terminus of neighbour sequence of sequence listing upward to telomere on chrosomal short arm and 5'-terminus of this base sequence : 129315
gacactaaggatgtacaaatcaagagacaaaccacgtctctctgtctctccagtaccaacctctgtattcctattgccttctgggtattgttatttgatgtcctctagataactcaagcttgatgtgttcaaaactgaactcttttcttttccaaaacaaacaaacaaacaaacaaacaaacagaaaactcctcctctgtgtgctaagcagaggttgatgattcatctggtcatctaag

SEQ ID NO: 22966 - DNA, 256 bp, Homo sapiens
  AC002994.2_92803
  Located on chromosome 17
  Distance between a terminus base of telomere on chromosomal short arm and 5'-terminus of this base sequence : 63525690
  Distance between 3'-terminus of neighbour sequence of sequence listing upward to telomere on chrosomal short arm and 5'-terminus of this base sequence : 113625
ccaaacctaagacaacctctttactcaaacaaatgctgtttgttgaaatgatataaagaatcatttaggtctctgcttcaaatctggggaaaaacaaaaacaaaaggaaaattatgatgttaagctaaaaatgtttaacctgcataccttcttaatctctctctctccttctctctctctgtgtgtgtgtgtgtgtgtgtgtgtgtgtgtgtgtgtgtgtgtgtgtgtgtgtgtgtctgtagcattgaaaataggt

SEQ ID NO: 22967 - DNA, 384 bp, Homo sapiens
  HUMUT1514
  Located on chromosome 17
  Distance between a terminus base of telomere on chromosomal short arm and 5'-terminus of this base sequence : 63552150
  Distance between 3'-terminus of neighbour sequence of sequence listing upward to telomere on chrosomal short arm and 5'-terminus of this base sequence : 26204
ggaatgagaggaatgactagaagtgtgacttagagatgttgaagaaaaagagattgttcactttgacatttattaagcatctttctttccctttcttttccttccttccttcctttcttttctttcttttccttctttctctttccttctttctttccatccctccctctctcccttccttccttccttccttctttccttccttccttctttccaggttagagttgctatttgtgaagaacatatctcaaggggaatagaagacctacaccagtcagatatcaaaagctatttatgattgagtggttcaatgtatacaatagacaggaagcattatcagaaaagtgacagattcatgtggccacaaggttaagggaaggtttc

SEQ ID NO: 22968 - DNA, 211 bp, Homo sapiens
  AC002994.2_52797
  Located on chromosome 17
  Distance between a terminus base of telomere on chromosomal short arm and 5'-terminus of this base sequence : 63565804
  Distance between 3'-terminus of neighbour sequence of sequence listing upward to telomere on chrosomal short arm and 5'-terminus of this base sequence : 13270
acaactccagtatttggttcatctctcctcaaggatttcttgaactaattgtatagattctctattccctgccactgagttctcctgaatgtgtgtgtgtgtgtgtgtgtgtgtgtgtgtgtgtgtgttttattgtttttgtttttaagcatgggtttctagcagtcccctctgggtcactataatttagtgatcagctaaagaccatcag

SEQ ID NO: 22969 - DNA, 264 bp, Homo sapiens
  chr17.fa.O7frz.66810204
  Located on chromosome 17
  Distance between a terminus base of telomere on chromosomal short arm and 5'-terminus of this base sequence : 63679319
  Distance between 3'-terminus of neighbour sequence of sequence listing upward to telomere on chrosomal short arm and 5'-terminus of this base sequence : 113304
aaaaggtagaaacaatccaaatacccatcgacagatgaatggataagcaaatgtgagattatatatatatatatatatatatatatatatatatatatatatatatatataaaatgaaatattattctgccataaaaaggattccgatgtatgctacaagatggacgaaccctgaaaacattatggctaatgaaataaatcagaaacaaaggacaaatactgtatgattccacttatatgaagtagctacaatagccaaattca

SEQ ID NO: 22970 - DNA, 475 bp, Homo sapiens
  chr17.fa.O7frz.67115677
  Located on chromosome 17
  Distance between a terminus base of telomere on chromosomal short arm and 5'-terminus of this base sequence : 63816909
  Distance between 3'-terminus of neighbour sequence of sequence listing upward to telomere on chrosomal short arm and 5'-terminus of this base sequence : 137326
ttgttacatgaatctattgcatagaagtctgggctgttggtgtagtcatcaccctgatagtataccctgtacccaatataggtaacttctcaaccctcacccccttcccaccctcccaacatttggagtctatgatgtgtattatcccactcgcttatgtccatgtgtacacatgattagcacccactcataattgagaatatgcaatatttgactttgtttatgcgttatttcacttaatataatggcctccagttccatccatgttactgtcagacatgattttattcttttttatggttgagttgtattccatggtgtgtgtgtttgtgtgtgtgtatacatatatacgtgtgtgtgtacatgtgtgtatgtgtgtgtgtgtgtgtgtgtgtgtgtgtgtgtgcatatatcacattttctttaagcaaccatccgttgatagatgcttaggttgattccataacattgctac

SEQ ID NO: 22971 - DNA, 434 bp, Homo sapiens
  chr17.fa.O7frz.67451907
  Located on chromosome 17
  Distance between a terminus base of telomere on chromosomal short arm and 5'-terminus of this base sequence : 63970109
  Distance between 3'-terminus of neighbour sequence of sequence listing upward to telomere on chrosomal short arm and 5'-terminus of this base sequence : 152725
tctaaagtagcatttggtcctaaaagtcaagaaaataaggaagtaatcacattgatttgctcacaataaaattgtttgtgtaaccttttagattatgatcccatgtcccataaaagctaaacaagttggcacttttctcttattatgtttgacagaacagtatatgagtcactttccaaaaataactaaattaacatatgccttcataagttaatcaaatagcacaaatgacaataacaaaatacatgccttaaaacacacacacacacacacacaccacacacacacacacacacacacacacggatagttacatttccagtacttttagaatcatctgcctattcaatgcaaaagactcaacttcagcagtggctgaagtgactcaaaagttacatctggcttctaaactattacacgactttgttaggaac

SEQ ID NO: 22972 - DNA, 98 bp, Homo sapiens
  D17S1811
  Located on chromosome 17
  Distance between a terminus base of telomere on chromosomal short arm and 5'-terminus of this base sequence : 64040893
  Distance between 3'-terminus of neighbour sequence of sequence listing upward to telomere on chrosomal short arm and 5'-terminus of this base sequence : 70350
ggcatgagccaccttaacatatatgtgtgtgtgtgtgtgtgtgtgtgtgtgtgtgtgtgtgtgtgtgtgtgtattctacaaaattagtgtggcgctcc

SEQ ID NO: 22973 - DNA, 226 bp, Homo sapiens
  DISO7_10004257
  Located on chromosome 17
  Distance between a terminus base of telomere on chromosomal short arm and 5'-terminus of this base sequence : 64142945
  Distance between 3'-terminus of neighbour sequence of sequence listing upward to telomere on chrosomal short arm and 5'-terminus of this base sequence : 101954
ccacactgctatttcttagctgaaaaattgtgaatggtttttggtatactgtattctctctatttactgtatatatatatatatatatatatatatatattatttatgatttttaaacagacccatttttgctagcattttaatgtatataaataggacaaattgttttttcttccttaacctctttgactctttgatattttcaaggttgatagcaatgtaatga

SEQ ID NO: 22974 - DNA, 132 bp, Homo sapiens
  DISO7_10004258
  Located on chromosome 17
  Distance between a terminus base of telomere on chromosomal short arm and 5'-terminus of this base sequence : 64214328
  Distance between 3'-terminus of neighbour sequence of sequence listing upward to telomere on chrosomal short arm and 5'-terminus of this base sequence : 71157
tcaactgccactgctagccctctaccccaggctgtaaacacacacacacacacacacacacacacacatatacagcttttcatttcccaagaattttgttatggcttttcacttggttcccacaatccaatg

SEQ ID NO: 22975 - DNA, 263 bp, Homo sapiens
  D17S1835
  Located on chromosome 17
  Distance between a terminus base of telomere on chromosomal short arm and 5'-terminus of this base sequence : 64688334
  Distance between 3'-terminus of neighbour sequence of sequence listing upward to telomere on chrosomal short arm and 5'-terminus of this base sequence : 473874
gctgtggggtggtgaggagacttttacaaagaaaatatggcaacacacacacacacacacacacacacacacacacacacacaacactaactacagacagtaaagagtttacagagcaaaacttctgctcctgaccatggaagtcttgccaatgatcgactcaggactggtttttttgtttgtttgtttgagacagggtctcactctgtcacccaggctggagtgtagtggtgcgatcttggctcaccacaacctctgcctcc

SEQ ID NO: 22976 - DNA, 232 bp, Homo sapiens
  D17S794
  Located on chromosome 17
  Distance between a terminus base of telomere on chromosomal short arm and 5'-terminus of this base sequence : 64759169
  Distance between 3'-terminus of neighbour sequence of sequence listing upward to telomere on chrosomal short arm and 5'-terminus of this base sequence : 70572
tgagttgccacagagtgatgctggcctgggggacagaagaagtcccagggtatgcgcggtgttgcggctcctgcagattcctgaaacatgcatcttcacccctgtctcgtcaccacaatggtcttcctctttaaaaattcaatcagagcttctctgcagtgtgtgtgtgtgtgtgtgtgtgtgtgtgtgtgcgtgtgtgtgtgtgtttcccctaaaggtggcagactgtgcc

SEQ ID NO: 22977 - DNA, 127 bp, Homo sapiens
  D17S924
  Located on chromosome 17
  Distance between a terminus base of telomere on chromosomal short arm and 5'-terminus of this base sequence : 64878990
  Distance between 3'-terminus of neighbour sequence of sequence listing upward to telomere on chrosomal short arm and 5'-terminus of this base sequence : 119589
caatatggcttggtatggcactgagagttaatggccagaaatacagtggaatatggcgtgtgtgtgtgtgtgtgtgtgtgtgtgtgtgtgtgtgtgtagagggaaagagatgaaccacaaagccaga

SEQ ID NO: 22978 - DNA, 147 bp, Homo sapiens
  D17S948
  Located on chromosome 17
  Distance between a terminus base of telomere on chromosomal short arm and 5'-terminus of this base sequence : 64931391
  Distance between 3'-terminus of neighbour sequence of sequence listing upward to telomere on chrosomal short arm and 5'-terminus of this base sequence : 52274
gtctctgtccttagggagtttacattttgatgagagaggtctctctctctctgtctctctctctctctcacacacacacacaaacacacacacacacacacacacacacacacacacacacacacacacaagaaatgggcaaagata

SEQ ID NO: 22979 - DNA, 308 bp, Homo sapiens
  chr17.fa.O7frz.68585885
  Located on chromosome 17
  Distance between a terminus base of telomere on chromosomal short arm and 5'-terminus of this base sequence : 65117682
  Distance between 3'-terminus of neighbour sequence of sequence listing upward to telomere on chrosomal short arm and 5'-terminus of this base sequence : 186144
agtcaagtttcagttcctactttctcctagagtatagttctttgggcttttaacaaaagtgttggagttttgctatctccactttcaccccttggtgggccttagactacacacacacacacacacacacacacacacacacacacacacacacacatacactctctctctctctctctctctctctgtgtgtatatatatatatatatatgtaaaaatttatatatatataattttataccatatgtttatggttctaattttccttgggaaaagtttatctgaagtacataattctgccattacca

SEQ ID NO: 22980 - DNA, 216 bp, Homo sapiens
  D17S944
  Located on chromosome 17
  Distance between a terminus base of telomere on chromosomal short arm and 5'-terminus of this base sequence : 65378303
  Distance between 3'-terminus of neighbour sequence of sequence listing upward to telomere on chrosomal short arm and 5'-terminus of this base sequence : 260313
ccttccataggaacggctctcagattaatatttgtgtgtgtgtgtgtgtgtgtgtgtgtgtgtaagattttgccagagattaaaagactactgcgttattatgtgtgtatttttgtggggtttgtttttatttttttaatacagtatctcactctgtcactcaggctggagtgcagtggcacagtcacggctcactgaagtctcaacctcctgggc

SEQ ID NO: 22981 - DNA, 306 bp, Homo sapiens
  chr17.fa.O7frz.69780033
  Located on chromosome 17
  Distance between a terminus base of telomere on chromosomal short arm and 5'-terminus of this base sequence : 65551999
  Distance between 3'-terminus of neighbour sequence of sequence listing upward to telomere on chrosomal short arm and 5'-terminus of this base sequence : 173480
ctacgtacctgttaccactttaaaaaaatctacagtcggtgtgaatgtgaactaactgctaatcatcaaatataccaaataaagttataaaattgttttttgtttgtttgtttgtttgttttttgggggggtgggatagaatcttgctctgtcacccaggctggaccacagtggcgtgattttggctcactgcaacccccacctcccgggttcaagcaattctcctacctcagcctcccttgtagctgggactgcaggcatgcaccaccatgcccagctaattttggtatctttagtacagatggg

SEQ ID NO: 22982 - DNA, 125 bp, Homo sapiens
  DISO7_10004260
  Located on chromosome 17
  Distance between a terminus base of telomere on chromosomal short arm and 5'-terminus of this base sequence : 65568984
  Distance between 3'-terminus of neighbour sequence of sequence listing upward to telomere on chrosomal short arm and 5'-terminus of this base sequence : 16679
atgctcacactgtgcctgggccacccagctgctgtctcagtgtgtgtgtgtgtgtgtgtgtgtgtgtgtgtgtgtgtgtgtgtgtatacatgtgtgcatacgtgtgtctaatgaaattccagctg

SEQ ID NO: 22983 - DNA, 214 bp, Homo sapiens
  D17S1297
  Located on chromosome 17
  Distance between a terminus base of telomere on chromosomal short arm and 5'-terminus of this base sequence : 65735693
  Distance between 3'-terminus of neighbour sequence of sequence listing upward to telomere on chrosomal short arm and 5'-terminus of this base sequence : 166584
gtttattccctccctcttgcacttttcacagtcagtctttattattattattattattattattattattatttttagatgaagttttgctcttgtcgcccaggctggagtgcaatggcatgatctcagctaactgcaacctctgcctcctggggttcaagtgattctcctgcctcagtctcccaagtagctggtactaaaggcatctgccacc

SEQ ID NO: 22984 - DNA, 408 bp, Homo sapiens
  chr17.fa.O7frz.69470582
  Located on chromosome 17
  Distance between a terminus base of telomere on chromosomal short arm and 5'-terminus of this base sequence : 65872788
  Distance between 3'-terminus of neighbour sequence of sequence listing upward to telomere on chrosomal short arm and 5'-terminus of this base sequence : 136881
ggctcagccttagagctatatgcacatgcatgcacacacacgcttgcacacacccccacttgcacacacttgcttgcacgcacacacttgcttgcacgcacacacttgccttcacaacccgctcgcacacacgtgcacgcacacccttgcacacgcacgtgaacacacacttgcacacacatatgcatgtacacagccttgcacacacacacgcatgcacacagacacccacttgcacacacatacacacacacactcttgcacacacacactgccgcacacggtttcccccattctgtctcctgactctgcccctgccagcctggatgggggacacacccttcgcctcctccaagggtcaaaatcctacctggctttcaagggctggttctaagatcctctgctcct

SEQ ID NO: 22985 - DNA, 229 bp, Homo sapiens
  chr17.fa.O7frz.69264881
  Located on chromosome 17
  Distance between a terminus base of telomere on chromosomal short arm and 5'-terminus of this base sequence : 66078651
  Distance between 3'-terminus of neighbour sequence of sequence listing upward to telomere on chrosomal short arm and 5'-terminus of this base sequence : 205455
acagctagaccttcaggactactaagcaagcgaaattagatttgagttccaggtctgccacattaagtaccaatatgatttggggcaagtgatttgaattatcttgggtctcggttttgttatcagttaaaaaattatatatatatatatatatatataaatttttctgcctatttcccaccattattttgaggattaaattaaataatgaacattcttaatgatctgc

SEQ ID NO: 22986 - DNA, 444 bp, Homo sapiens
  chr17.fa.O7frz.69059086
  Located on chromosome 17
  Distance between a terminus base of telomere on chromosomal short arm and 5'-terminus of this base sequence : 66253504
  Distance between 3'-terminus of neighbour sequence of sequence listing upward to telomere on chrosomal short arm and 5'-terminus of this base sequence : 174624
gaggtcaggagttcgaaaccagcttggccaatatggtgaaaccccatctctattaaaaatataaaaattagccaggtgtggtggcctgtaatcctaactacttggaggctgaggcaggagaatcgcttgaacctagaaagcggaggttgcagtgagccgagattgtgccactgcactccagcctgagcaatagagtgaaaccctgtctcctaaaaaaatacaataaaaatacacacacacacacacacacacacacacacacacacacacctgaatccaaccacttctcatcccaccccccttatccaagccaccacctactctcctgaatgactgccccagactcctatctggcctccattgtttcctctgtggcagcccaacaaatgattccccaatagcaaccagagtgatccctgtaaaatgtaattcagatcacgccac

SEQ ID NO: 22987 - DNA, 277 bp, Homo sapiens
  chr17.fa.O7frz.73068025
  Located on chromosome 17
  Distance between a terminus base of telomere on chromosomal short arm and 5'-terminus of this base sequence : 66394454
  Distance between 3'-terminus of neighbour sequence of sequence listing upward to telomere on chrosomal short arm and 5'-terminus of this base sequence : 140506
gaatttctgacctcaagtgatccgcctgcctcagcctcccaaagtgctgggattataggcatgagccaccgcacccagccctcatctctttctctcctctctctctctcacacacgtacacacacacacacacacacacacacacacacacacacactctgacaccttcctgcacattggatcgttccttatacttcttgggctcctgagataaactcttctagcatcttcgtgggtcccttgtctacgcaggcaataatgtgctatgcaactgaat

SEQ ID NO: 22988 - DNA, 441 bp, Homo sapiens
  chr17.fa.O7frz.72959722
  Located on chromosome 17
  Distance between a terminus base of telomere on chromosomal short arm and 5'-terminus of this base sequence : 66509002
  Distance between 3'-terminus of neighbour sequence of sequence listing upward to telomere on chrosomal short arm and 5'-terminus of this base sequence : 114271
tgaggaaattgcatagaactacatgcatacacatgcgtacacacacacacacacacacacacaaacacacacacacacaaatgactgcatgtaacttggtgaaattttttttttgagacagggtcttgctctgttgcccaggctagagtgcagtggtgtaatctcagctcactgcaacctctgcctcccaggcttaagtgattctgccacctcagcctcccacgtagctgtgactacaggcacgcactaccgcgcctagccaatatttttgtactttttgtagagacggggtttcaccatgttgcccaggctggtcttgaactcctgggctcgtgatccgcctaccttggcctccaaaagtgctaggattacagcagtgagccaccgtgcctgcccatggtgaaatcttcataagctctatgaattgtaccaatgtcaact

SEQ ID NO: 22989 - DNA, 375 bp, Homo sapiens
  AC011618.2_26397
  Located on chromosome 17
  Distance between a terminus base of telomere on chromosomal short arm and 5'-terminus of this base sequence : 66599367
  Distance between 3'-terminus of neighbour sequence of sequence listing upward to telomere on chrosomal short arm and 5'-terminus of this base sequence : 89924
catgaagttctattcactccactgcctctgtatctcacaaatccaccttcctgatagacgtttgaatcccccatctcacctgcacaactgctggactcttaactctttttctcttgagactctgatctccacatccacccattgatccatccatccatccatccatccatccatccatccatccatccatccatccatccgcccatccatccacccagccacaccccaaccatgagttttcttcccaatatgctaggaagctttcttcaatgctcctggaacatatcagtttatggtggaaagagcagtgtccagaggtcaaaatatctcattctaatcctggctccaccacttaggagttgtacgactttagaa

SEQ ID NO: 22990 - DNA, 101 bp, Homo sapiens
  DISD22_0010936
  Located on chromosome 17
  Distance between a terminus base of telomere on chromosomal short arm and 5'-terminus of this base sequence : 66672981
  Distance between 3'-terminus of neighbour sequence of sequence listing upward to telomere on chrosomal short arm and 5'-terminus of this base sequence : 73239
ccaaaccatattggagctggatcaggggaaaataagcatatatatatatatatatatatatatatatatatgcatgaaaatatcctcccatattgtggacc

SEQ ID NO: 22991 - DNA, 115 bp, Homo sapiens
  DISD22_0010941
  Located on chromosome 17
  Distance between a terminus base of telomere on chromosomal short arm and 5'-terminus of this base sequence : 66873517
  Distance between 3'-terminus of neighbour sequence of sequence listing upward to telomere on chrosomal short arm and 5'-terminus of this base sequence : 200435
aaagttacataatgcatcctcgttaattaaaacacacacacacacacacacacacacacacacacacacagaaaagcctgtttccaaatctttaaaccttgggctgagatgtaca

SEQ ID NO: 22992 - DNA, 156 bp, Homo sapiens
  D17S1821
  Located on chromosome 17
  Distance between a terminus base of telomere on chromosomal short arm and 5'-terminus of this base sequence : 67020481
  Distance between 3'-terminus of neighbour sequence of sequence listing upward to telomere on chrosomal short arm and 5'-terminus of this base sequence : 146849
gaaaccagggcagtgctatgtactgaactgtttcacactatcacaaataaaattgcaggttgagcctcacttcacacacacacacactcacacacacacacacacacacacacacgtgcgcacgcagagtatcaggaaatagcctgtccgttttgg

SEQ ID NO: 22993 - DNA, 430 bp, Homo sapiens
  AC005544.1_79489
  Located on chromosome 17
  Distance between a terminus base of telomere on chromosomal short arm and 5'-terminus of this base sequence : 67235654
  Distance between 3'-terminus of neighbour sequence of sequence listing upward to telomere on chrosomal short arm and 5'-terminus of this base sequence : 215017
gaggtcaggagttccagaccagcctggctaacatagtgaaaccccgtctctacaaaaagtacaaaaactagccgggtgtggtggtgcgtgcctgtagtcacagctacttgggaggctgaggcagaattgcttgagcccaggaggcggagattgcaatgagccgagattgcgccattgcactccagcctgggcgacagaacaagactctgtctctaataataataataataataataataataataataataatgtagcagtaaggtagggctagctgtgtatgaaagtcatatcccctaaatgacgaaaatttccaaaaagtccaggctttcacatttaggcaaaaattcttgtcagaagcaaagccaaaagaatagaaagtatcgctgcttgtaatggcaatgaccttaattaactttctccaatgtgc

SEQ ID NO: 22994 - DNA, 259 bp, Homo sapiens
  AC005544.1_124124
  Located on chromosome 17
  Distance between a terminus base of telomere on chromosomal short arm and 5'-terminus of this base sequence : 67280396
  Distance between 3'-terminus of neighbour sequence of sequence listing upward to telomere on chrosomal short arm and 5'-terminus of this base sequence : 44312
gcacaagaattgcttgaacccgggaggcagaggttgcagtgagccaagatcgcgccactgcactccagcctggcgacagagcaagactctgtctcaaacaacaacaaacaacaacaacaacaacaacaacaacgaatttgcccactgggaatggggcacagggggctttccaggcagagaagcaagacatgtgaaggcaagggtggggttgaagtctgtctgtctgtgtctttccctctcttaaaccatagttatggcc

SEQ ID NO: 22995 - DNA, 229 bp, Homo sapiens
  AC027772.2_63509
  Located on chromosome 17
  Distance between a terminus base of telomere on chromosomal short arm and 5'-terminus of this base sequence : 67298619
  Distance between 3'-terminus of neighbour sequence of sequence listing upward to telomere on chrosomal short arm and 5'-terminus of this base sequence : 17964
acggactaatacaccagtcttctgagatggatacagaacacaggaccgaagtctgtgggggcggtgccctggggtcagggagctattcccatgctaactaccacaatgaccaccaccaccaccaccaccaccaactctactgccaactattacagtaatagcagctaatacttgttgaggtcatcgccgttctatgtacttcatattctaactcattcagtcctcactg

SEQ ID NO: 22996 - DNA, 442 bp, Homo sapiens
  AC005988.1_81462
  Located on chromosome 17
  Distance between a terminus base of telomere on chromosomal short arm and 5'-terminus of this base sequence : 67414756
  Distance between 3'-terminus of neighbour sequence of sequence listing upward to telomere on chrosomal short arm and 5'-terminus of this base sequence : 115908
atgtcaaagctactgtttatagctttggctatcgtgaagttcacagaaggaaaaataaaaagcttaactaaccctgagtctgtacctcatagacttcgtggaaatatcaccatgcaaaagctgggctgataacattcctggtgctcaataaatatgtgttgggttgatgcatggaagggtggaaggatgggttgatagatggaagaatggatggatgatgggttggtggtagattgaaaaatggatggacagatggatggaaagaagagtgggtaggtgtgtggatggatggattgatggatggatggatggatggatggatggatggatggaaggagaaagaaagagtggctcttggacatcagactttctgactgccacctggctcccaagctacgttgacaagaaaatattgggaaaaggatcctaaaattactcagga

SEQ ID NO: 22997 - DNA, 322 bp, Homo sapiens
  AC005988.1_33276
  Located on chromosome 17
  Distance between a terminus base of telomere on chromosomal short arm and 5'-terminus of this base sequence : 67463174
  Distance between 3'-terminus of neighbour sequence of sequence listing upward to telomere on chrosomal short arm and 5'-terminus of this base sequence : 47976
agtcagactcaccttcaaattccagcagctggggctgcagcctctgccgttgctgctgcttttaaataaggatgatgatgatgatgatgatgatgatgatggtgatagaacaacaatgccagctagtatttattgagcacttactagtgtaagcgttcaatgagcttcacatgtattaagtcatttaattctcacacgaatcccattttacagatgagaagactgaggcacagggcgcttaagtgaggagtctgaggacacacagctggaaaatggcagagccaggactgcagctcaggcctgtctaagtgcagaatctgag

SEQ ID NO: 22998 - DNA, 145 bp, Homo sapiens
  D17S1291
  Located on chromosome 17
  Distance between a terminus base of telomere on chromosomal short arm and 5'-terminus of this base sequence : 67643493
  Distance between 3'-terminus of neighbour sequence of sequence listing upward to telomere on chrosomal short arm and 5'-terminus of this base sequence : 179997
atagtgggaagggcatgcgtgtgtgctagaggcagctgggcaggctgcgggagctctacaagcctcagtttcctcacttacaaaagggtaatgatgctgctgctgctgctggtgatgatgatagcatttttcccaaaaggtggtt

SEQ ID NO: 22999 - DNA, 170 bp, Homo sapiens
  D17S942
  Located on chromosome 17
  Distance between a terminus base of telomere on chromosomal short arm and 5'-terminus of this base sequence : 67804631
  Distance between 3'-terminus of neighbour sequence of sequence listing upward to telomere on chrosomal short arm and 5'-terminus of this base sequence : 160993
ctgatgccaagattttttacatgggtaacaggaaaatgggtatatgacaaaatagacatacacacacacacacacacacacacacacaaatatacctacatagacatacacatatacacatatatacaactcagaggatgaagatacagtatattagggaaatagaatca

SEQ ID NO: 23000 - DNA, 360 bp, Homo sapiens
  AC006263.1_34791
  Located on chromosome 17
  Distance between a terminus base of telomere on chromosomal short arm and 5'-terminus of this base sequence : 67846500
  Distance between 3'-terminus of neighbour sequence of sequence listing upward to telomere on chrosomal short arm and 5'-terminus of this base sequence : 41699
agaaacagatgctcatatcattctgtgaaagagcaaaatttcattcatatatggcctgcatgttaccaaaaacaaaagcccaaaatgtgataataatcaaaaagcatcttccactgaacttgttttaggtaataaataaataaataaataaataaataaataaataaataaattctaactccgtattctaaaagttttgaaattaaagaatggaatcctattatattcaatcattagaatatccacacgtagatcaaatctggaaaaaaggcacagtttaagttttaagaggatttaatatgtggcttcactagaccagcatggatactttgttcccttctaagatgaatagcaatgtct

SEQ ID NO: 23001 - DNA, 283 bp, Homo sapiens
  D17S1816
  Located on chromosome 17
  Distance between a terminus base of telomere on chromosomal short arm and 5'-terminus of this base sequence : 67873231
  Distance between 3'-terminus of neighbour sequence of sequence listing upward to telomere on chrosomal short arm and 5'-terminus of this base sequence : 26371
tcacagcaagactctgtcacaaaaaaaaggcggtgggggtggggggaacagcacagaaacctatcaatgcattccttacattgtgcatagacacattaagacaaattcagaatatttatggatctttcatacattgatttttccagatttggaagacttccatccctatcagtaacttacttcaaagatgtgtgtgtgtgtgtgtgtgtgtgtgtgtgtgtgtgtgtgtgtgtttgagacagggtcgtgctctgctgcctcggctatagtgcagtggtgccat

SEQ ID NO: 23002 - DNA, 104 bp, Homo sapiens
  DISD22_0010943
  Located on chromosome 17
  Distance between a terminus base of telomere on chromosomal short arm and 5'-terminus of this base sequence : 68011215
  Distance between 3'-terminus of neighbour sequence of sequence listing upward to telomere on chrosomal short arm and 5'-terminus of this base sequence : 137701
agcctcaaggaacaatcagaaatttaacctgtgctaaagagagagacagagagagagagagagagagagagagagagagagagactggttattggaaaggctct

SEQ ID NO: 23003 - DNA, 167 bp, Homo sapiens
  D17S1874
  Located on chromosome 17
  Distance between a terminus base of telomere on chromosomal short arm and 5'-terminus of this base sequence : 68158838
  Distance between 3'-terminus of neighbour sequence of sequence listing upward to telomere on chrosomal short arm and 5'-terminus of this base sequence : 147519
tgtggtatgtgtggcatgcatgtggatttgtgtatgtggtttgagtgtgtgtgctttgtgtatgtgcccatgcgtatgcatgtgagtgtgtgtgtgtgtgtgtgtgtgtgtctgcgcatgcacgtgcacatgataattagttctttgtgtgccattgctgcctccta

SEQ ID NO: 23004 - DNA, 112 bp, Homo sapiens
  D17S1882
  Located on chromosome 17
  Distance between a terminus base of telomere on chromosomal short arm and 5'-terminus of this base sequence : 68443319
  Distance between 3'-terminus of neighbour sequence of sequence listing upward to telomere on chrosomal short arm and 5'-terminus of this base sequence : 284314
acccaccaccactactcctaccacacatacacacacacacacacacacacacacacacacacacacacactctttttcaaaacataatttaaggtagggtgaggtaatgata

SEQ ID NO: 23005 - DNA, 436 bp, Homo sapiens
  AC006080.1_37288
  Located on chromosome 17
  Distance between a terminus base of telomere on chromosomal short arm and 5'-terminus of this base sequence : 68680436
  Distance between 3'-terminus of neighbour sequence of sequence listing upward to telomere on chrosomal short arm and 5'-terminus of this base sequence : 237005
ccagtatgcaagataccactagcacatgctgcttcttagaaaagtgcactgctgcaaagatgtacgcacacggttgccaacttggtgagcagttaatattttggcggggaggcgtttcatggggggtgcttcttcttccaagaagatgtatcactttctggggtacatgtcttgataagtgtagcatggactgcatttcagcccctaattgctcccttggcagtaagcatttttgtgcagtgcacaaactgtaccgctgtacatggcaggcctgccagcacaagttgggatgaaagtttgtttgtttgtttgtttgtttgtttaggaaaagaagaaccaagatgaaaggagtaaagcctgaccttctctgatgtcagtcctgcccactccttggctttggagttttgaatgagtcactttagcactatctgatctt

SEQ ID NO: 23006 - DNA, 249 bp, Homo sapiens
  AC006080.1_167455
  Located on chromosome 17
  Distance between a terminus base of telomere on chromosomal short arm and 5'-terminus of this base sequence : 68810759
  Distance between 3'-terminus of neighbour sequence of sequence listing upward to telomere on chrosomal short arm and 5'-terminus of this base sequence : 129887
ttaaattaggcttatgatcaagacccagttctccttaatacacccaccctctggaatggtgatctccaaactacaggctgagactcatgagggggtcatcaaattagttcagtaggtctcgtacagcagaaaagggaaaggaagggaagggaagggaagggaagggaagggaagggaagggaagggaagggaagggaagggaagggaaaagatcagcgcatttgatatattaggataagcattctcgaa

SEQ ID NO: 23007 - DNA, 279 bp, Homo sapiens
  D17S1792
  Located on chromosome 17
  Distance between a terminus base of telomere on chromosomal short arm and 5'-terminus of this base sequence : 69008312
  Distance between 3'-terminus of neighbour sequence of sequence listing upward to telomere on chrosomal short arm and 5'-terminus of this base sequence : 197304
gttttcggttattaacaacaacaaacaaaaccaccaccaatttgattccacatgtctagtttcatacaaaattttccacatgagaggcttattctggtaaaggcaacatcaaatttcattacacacacacacacacacacacacacacacacacacacaaaagggtttctttttaaatcttcctacggtaagtgaaaaatgtgtggggcttgtgcatcatacaaataaacaaacaaacaagcttggctcctcttttcttatttctccatcagccacctg

SEQ ID NO: 23008 - DNA, 217 bp, Homo sapiens
  D17S1825
  Located on chromosome 17
  Distance between a terminus base of telomere on chromosomal short arm and 5'-terminus of this base sequence : 69039981
  Distance between 3'-terminus of neighbour sequence of sequence listing upward to telomere on chrosomal short arm and 5'-terminus of this base sequence : 31390
gactttatcaagatgtttccaggactgaaattattagtgtatacatatgcgaattattgataaaagcctatatctaggtctcttttatacacacacacacacacacacacacacacacacacactctctctctctctctctctctctctttctctctctctctctctctctctctctctatgttgtccgggttggtgtagaactcctgggctcaata

SEQ ID NO: 23009 - DNA, 472 bp, Homo sapiens
  AC037487.4_18382
  Located on chromosome 17
  Distance between a terminus base of telomere on chromosomal short arm and 5'-terminus of this base sequence : 69131598
  Distance between 3'-terminus of neighbour sequence of sequence listing upward to telomere on chrosomal short arm and 5'-terminus of this base sequence : 91400
tacgcctacttgatagtctttaaggatgactgctccaaggtatagccagctcgctggccagcccatctacccatccacttaccgattcacccatccacccacccatctacacactgcccacccatctacccatccacctacccatctacccagctagccatctacacaatcacccacccatctacccatctacctacccatccacctacccatctagctatctacccgttcacccacctatctacccatctacctactgatccacctacccaccaacccatccactcatccacctacccatttactcattcacctgcccaggtaaccatccacctacccatccactcatccaccatccacctgcctatctgtctgtctgtctgtctatctatctatctatctatctatctatctatctatctacctaatcagtcatttatctgctggtgccttaagcggttatgtctgtagc

SEQ ID NO: 23010 - DNA, 293 bp, Homo sapiens
  HUMUT748
  Located on chromosome 17
  Distance between a terminus base of telomere on chromosomal short arm and 5'-terminus of this base sequence : 69131912
  Distance between 3'-terminus of neighbour sequence of sequence listing upward to telomere on chrosomal short arm and 5'-terminus of this base sequence : -158
tgcccaggtaaccatccacctacccatccactcatccaccatccacctgcctatctgtctgtctgtctgtctatctatctatctatctatctatctatctatctatctacctaatcagtcatttatctgctggtgccttaagcggttatgtctgtagctgcaggaaaccatcctcagactccctcctggggaccaagacagccaccgacggagctctgcccagggctgtggacaggcaccaagcttttctcttggttagctcccccacgtcacagtgcctgaaccagtgaccc

SEQ ID NO: 23011 - DNA, 300 bp, Homo sapiens
  chr17.fa.O7frz.73674031
  Located on chromosome 17
  Distance between a terminus base of telomere on chromosomal short arm and 5'-terminus of this base sequence : 69263741
  Distance between 3'-terminus of neighbour sequence of sequence listing upward to telomere on chrosomal short arm and 5'-terminus of this base sequence : 131536
gcacaatttaagttgcagtaagttgtgtaacaaactcccaatagggccctggagaaatacatatatatatatatatatattttttttttagacagggtcttgctctgtcacccaggctggagtgcagtggtgccatcttggctcactgcaacctctacctcttggattcaagcaatcctcctgcctcattctcccagagtgctgggactacaggcatgtgccaccacacttggcgaagatatagatatatatatatatatagatacatatatatctatagctacatctacaaagaagcag

SEQ ID NO: 23012 - DNA, 261 bp, Homo sapiens
  AC007780.3_160116
  Located on chromosome 17
  Distance between a terminus base of telomere on chromosomal short arm and 5'-terminus of this base sequence : 69506189
  Distance between 3'-terminus of neighbour sequence of sequence listing upward to telomere on chrosomal short arm and 5'-terminus of this base sequence : 242148
gttcagttaagtagcacttagcaccttcccaatgttgtgcaacgaccacatctgtctagttccaaaacacttttatcacctcaaaagaaaaccctatatcctttaattaattaattaattaatattttagagatacagtcttgctctgtcccccaggctggagtgcaatggcgcgatcatagctcattgcagcctcaaactcctgagctcaagggattccccccacctcattctcctgagtaccttggactacaggagtgt

SEQ ID NO: 23013 - DNA, 156 bp, Homo sapiens
  D17S789
  Located on chromosome 17
  Distance between a terminus base of telomere on chromosomal short arm and 5'-terminus of this base sequence : 69762984
  Distance between 3'-terminus of neighbour sequence of sequence listing upward to telomere on chrosomal short arm and 5'-terminus of this base sequence : 256534
ctgcatacgaagggtaggaccccaatggttgtgtttcactctgtgtgtgtgtgtgtgtgtgtgtgtgtgtgtgttttcaaagttggcaattatggagtctttccactgattcaaactaataaatcaccatctctcagtacaaacttgatttggagt

SEQ ID NO: 23014 - DNA, 433 bp, Homo sapiens
  AC015844.4_130078
  Located on chromosome 17
  Distance between a terminus base of telomere on chromosomal short arm and 5'-terminus of this base sequence : 69966661
  Distance between 3'-terminus of neighbour sequence of sequence listing upward to telomere on chrosomal short arm and 5'-terminus of this base sequence : 203521
ttaccgcaagatgttatgtaagcctcccttctcttctgcttcatcattccagtcttctttcttctagaccattctttttgttgttgttgttgttgttgttgtttttgttgttgtttttttttgttgagacggggtctcactctgttgcccaggctggagtacagtggtgtgatctcggctcactgcaacctctgcctcccaggttcaagtgattctcctgcctcagcctcctatctgggattataggcgtgtgccaccatgcctggctaatttttgtatttttagtagagacggggtttcaccatgttggtcaactcctgacctcatgatctgcctgcctcagcctcccaaagtgctgggattacaggtgttagccaccatgccaggctagaccattcttattatcatacagtcaaacatgctgtaatttctc

SEQ ID NO: 23015 - DNA, 362 bp, Homo sapiens
  chr17.fa.O7frz.74073061
  Located on chromosome 17
  Distance between a terminus base of telomere on chromosomal short arm and 5'-terminus of this base sequence : 70004806
  Distance between 3'-terminus of neighbour sequence of sequence listing upward to telomere on chrosomal short arm and 5'-terminus of this base sequence : 37712
attggtcctaaataacctcaagatacagtagaaactgtggtcttatttttaaaaagaatagtcaatgcaaatttcaaaatttgacagattcaaatacacaccagtgttaaatgctagtttaacacacaccacacacacacaaacacacacacacacacgtatggtattttaagattcactgtccatatgatatccatactattcaagatagtgatattagaatttaagccagtaaaagtttagctcttttgaaataggtataaatcttatcagtatataagaagtatttatgactctgggataacatattcaaagtgctgaaagaaaataaagaaactgtgaatcagatacttgatatccag

SEQ ID NO: 23016 - DNA, 355 bp, Homo sapiens
  AC005922.1_120114
  Located on chromosome 17
  Distance between a terminus base of telomere on chromosomal short arm and 5'-terminus of this base sequence : 70104109
  Distance between 3'-terminus of neighbour sequence of sequence listing upward to telomere on chrosomal short arm and 5'-terminus of this base sequence : 98941
aattacagccttagcacttctcacctgtagcaaaagaaatgtatgctgcacctgggaggggtaggagaacttcttagaatttggtgggtttattagtcagggttgtgtagagaaacagaaccaatgagataaatatgttagatagatgatagatagatagatagatagatagatagatagatagatagatagagatgatagatgatatagatagatgatagatgatagataatagatgatacatagatagatatagcaaatagatctatagatatgacagagagagaatgagagagatttacattaaagaattggctcacatgattgtgggggctgcaaatcctacatctgtaga

SEQ ID NO: 23017 - DNA, 211 bp, Homo sapiens
  D17S940
  Located on chromosome 17
  Distance between a terminus base of telomere on chromosomal short arm and 5'-terminus of this base sequence : 70224601
  Distance between 3'-terminus of neighbour sequence of sequence listing upward to telomere on chrosomal short arm and 5'-terminus of this base sequence : 120137
cctattttttgatgtacttatctctccacgggaatttcaaattcagtttctgctccaccttcttgccctcccccaaataacatacagacatacacaaacacacacacacacacacacacacacacacacacagatatgtgggcatgcacacacacatacacacatacccctttccactctctattttaaggtatgaaaattccattaaaga

SEQ ID NO: 23018 - DNA, 203 bp, Homo sapiens
  Z23906.1_109
  Located on chromosome 17
  Distance between a terminus base of telomere on chromosomal short arm and 5'-terminus of this base sequence : 70224642
  Distance between 3'-terminus of neighbour sequence of sequence listing upward to telomere on chrosomal short arm and 5'-terminus of this base sequence : -170
ttcagtttctgctccaccttcttgccctcccccaaataacatacagacatacacaaacacacacacacacacacacacacacacacacacagatatgtgggcatgcacacacacatacacacatacccctttccactctctattttaaggtatgaaaattccattaaagaaagactctttgattatctcaattgccatttgtt

SEQ ID NO: 23019 - DNA, 268 bp, Homo sapiens
  AC005495.1_63789
  Located on chromosome 17
  Distance between a terminus base of telomere on chromosomal short arm and 5'-terminus of this base sequence : 70286032
  Distance between 3'-terminus of neighbour sequence of sequence listing upward to telomere on chrosomal short arm and 5'-terminus of this base sequence : 61187
aacttggtccttgaaaggttggtaagctggagttcatattcctgcaggaatccagagggtttataggactgtccggtgctaaaaacagactaggaaaatttcacctacaacctcaggggagagcaaagctgtattctctgcccaatttctggaagacagacagacagatagtagatagatagatagatagatagatagatagatagatagatagatagatagatcgcccatagaaaatgaaaccacaaagtatgtagagcatgtatca

SEQ ID NO: 23020 - DNA, 413 bp, Homo sapiens
  chr17.fa.O7frz.74570132
  Located on chromosome 17
  Distance between a terminus base of telomere on chromosomal short arm and 5'-terminus of this base sequence : 70490584
  Distance between 3'-terminus of neighbour sequence of sequence listing upward to telomere on chrosomal short arm and 5'-terminus of this base sequence : 204284
tcaaagttagcttggcctaagcccaggaataattaagggcagtttggggattaaaggcaagatgcgggttggttagtcctctcactgtcataattttctcacttttataatttttgtgaaggcgatttcaagaagtggagtctattcagttagttgggggatttagaattttatttttggtttacactttccaaaaagcccagctctgagaagtaaaagtctaggctttcaaatatgtatgtgtgtgtgtgtgtgtgtgtgtgtgtgtgtgtgtgtgtgtgtgtattcagacagggtcttgctctgtcacccaggctagagtgcagtggcatgatcccagctcactgcagcctcaaactcctaggctccagagatcctactgttacagtaggtaattagtctgatatgagcag

SEQ ID NO: 23021 - DNA, 161 bp, Homo sapiens
  D17S1786
  Located on chromosome 17
  Distance between a terminus base of telomere on chromosomal short arm and 5'-terminus of this base sequence : 70641288
  Distance between 3'-terminus of neighbour sequence of sequence listing upward to telomere on chrosomal short arm and 5'-terminus of this base sequence : 150291
gagactctgtatggcacccagcacgcctggaagccacacacacacacctggaagccacacacacacacacacacacacacacacacacacgtgcacgcagagagagagagaagggaccactgagccaatgtctttattgggtacagggcgttatccagttt

SEQ ID NO: 23022 - DNA, 437 bp, Homo sapiens
  AC002546.1_76434
  Located on chromosome 17
  Distance between a terminus base of telomere on chromosomal short arm and 5'-terminus of this base sequence : 70678323
  Distance between 3'-terminus of neighbour sequence of sequence listing upward to telomere on chrosomal short arm and 5'-terminus of this base sequence : 36874
tatctcaggcagatttggttaggactatataaaagcaaattatacattcatgggaaacagaagcaaaaagaaccaggtacctgacagtgaagagataacaaatggcaatgtaagaaacacttgccaatttctttgtctgtggaaatggcattaaagctgctttgaaggaaagtagattttttgaaataaaatggctatagatcagaaaaattagtgtgcatatcatcggtaaagtatcaaaaggaaagtacacacacacacacacacacacacacacacaactatttttcccattaaggcacaaccagggtgatttaaaacatgatacataagtgttacagaagaggaaagtcaagataggaggctgtgttttcaatacacttttaaagctgattatgtttagtgttctacaggttctgaaatccttgtctaatgaa

SEQ ID NO: 23023 - DNA, 234 bp, Homo sapiens
  AC003051.1_104548
  Located on chromosome 17
  Distance between a terminus base of telomere on chromosomal short arm and 5'-terminus of this base sequence : 70723438
  Distance between 3'-terminus of neighbour sequence of sequence listing upward to telomere on chrosomal short arm and 5'-terminus of this base sequence : 44678
tgtaggctagaatccttctcatacttcttgtactcagtatttttttttttgcgctattctccttagcagcatctaataccagttttcccctttggaggtttgcccagtggtgcagttagggaaataatgataatgattctgcctcgtgtgtgtgtgtgtgtgtgtgtgtgtgtgtgtgtgtgtgtattatagctcagtctataagggaacgtgcaatctttaacttatctgacc

SEQ ID NO: 23024 - DNA, 410 bp, Homo sapiens
  AC003051.1_82171
  Located on chromosome 17
  Distance between a terminus base of telomere on chromosomal short arm and 5'-terminus of this base sequence : 70745754
  Distance between 3'-terminus of neighbour sequence of sequence listing upward to telomere on chrosomal short arm and 5'-terminus of this base sequence : 22082
ggtaaggaaattcaggctagactactgaatgattggagaccatatatagaggggttgagaataagtaggtcatagtgttgcacgtgtaaacctcacagtctagtgggggagacagttccataaaccaaaaaccacaaagcattgtaatgtgtgttgtactagaggtgagtaaaaaatgttgtagaagccagaataaagtggtagcctcgtgtgtgagtgtgtgtgtgtgtgtgtgtgtgtgtgtgtagaacgtagctttgtggaagtggtgacagcacttgtcccccatctcgaagggtatgcagagatttcctaggtagaaaaaggcatcccgggctaagagaacagtatttgcaaagttatggaaatgtaacagaacaagacatgtttaggaaatggtgagtcaatag

SEQ ID NO: 23025 - DNA, 287 bp, Homo sapiens
  AC004756.1_64427
  Located on chromosome 17
  Distance between a terminus base of telomere on chromosomal short arm and 5'-terminus of this base sequence : 70887067
  Distance between 3'-terminus of neighbour sequence of sequence listing upward to telomere on chrosomal short arm and 5'-terminus of this base sequence : 140903
tacatgattgcatgattactacacatttcttgcctgtatcaaagtatctcatgtaccttataaatatatacacctactatgtacccacacaaatagatagatagatagatagatagatagatgatagatagataaaagaacagaagagcttgcaaattgcaaagaaaaagaagaaagacttttaagtagaagggtgtggtgaaggaagatgagaacagagaaatcgccttgagatttatttagagtgaggtcgctgatgaccttggaaaggacagtgttagtggagt

SEQ ID NO: 23026 - DNA, 408 bp, Homo sapiens
  AC004756.1_26580
  Located on chromosome 17
  Distance between a terminus base of telomere on chromosomal short arm and 5'-terminus of this base sequence : 70924780
  Distance between 3'-terminus of neighbour sequence of sequence listing upward to telomere on chrosomal short arm and 5'-terminus of this base sequence : 37426
tgtctattgaaatggttgtatgagttttgtccttgattctgttaatatgataaatcacatttattgatttgtgtgttgaaccatccttgcaaccatgggatgagtctcacttgccatagtgaatgatcttttactgtgctgtcgaatttgttttgctggtattttgtcaaggattttcgcacctatattcatcagagatattggcttgtagttttcttttctgtttttgagtgtgtgtgtgtgtgtgtgtgtgtgttcttgcttgatttttgaattctaaaatcacctatacccacaaaagaccctgaatgaccacagcaattttgagccaaaagaacaaagctggtggcatcacactacctgacttcaaaatatactacaaaggtacagaaatagaaacagcatggt

SEQ ID NO: 23027 - DNA, 156 bp, Homo sapiens
  AC002538.1_61161
  Located on chromosome 17
  Distance between a terminus base of telomere on chromosomal short arm and 5'-terminus of this base sequence : 70995128
  Distance between 3'-terminus of neighbour sequence of sequence listing upward to telomere on chrosomal short arm and 5'-terminus of this base sequence : 69940
tacaatttactgtgcattgtatgactttagaaatggtgagaaaattgtaggtttgttttcttgttccagatgcttttcactctgtcatatgtgtgtgtgtgtgtgtgtgtgtgtgtgtgtatacacacagatgtagtcatgtattgcgtaatgacg

SEQ ID NO: 23028 - DNA, 386 bp, Homo sapiens
  AC004562.1_23382
  Located on chromosome 17
  Distance between a terminus base of telomere on chromosomal short arm and 5'-terminus of this base sequence : 71080347
  Distance between 3'-terminus of neighbour sequence of sequence listing upward to telomere on chrosomal short arm and 5'-terminus of this base sequence : 85063
ataagagtaaagtggccagaagttgtgactcatgcctataatcccggtgctttggagggattacaggcatgagctgaaggtgaggatgatccctgcagctcaggagtttgagatcaatctgggcaacattgcaagatcccatctctatgaaaaacaaacaaacaaacaaacaacaacaaaaaagcaatgtggtggtgcatgccggtagtcccagttactcagaaggttgaggccagaggattgcttgagcccaggagattgaggctgcagtgagccatgattgtgccactgcactcagcctggacaacagagcaagaccctgtctcaaaaaagagagaaagagtaaagaagtgagaaagtactgtagttaaaagtgacataagcaa

SEQ ID NO: 23029 - DNA, 390 bp, Homo sapiens
  AC002989.1_49305
  Located on chromosome 17
  Distance between a terminus base of telomere on chromosomal short arm and 5'-terminus of this base sequence : 71080347
  Distance between 3'-terminus of neighbour sequence of sequence listing upward to telomere on chrosomal short arm and 5'-terminus of this base sequence : -386
ataagagtaaagtggccagaagttgtgactcatgcctataatcccggtgctttggagggattacaggcatgagctgaaggtgaggatgatccctgcagctcaggagtttgagatcaatctgggcaacattgcaagatcccatctctatgaaaaacaaacaaacaaacaaacaacaacaaaaaagcaatgtggtggtgcatgccggtagtcccagttactcagaaggttgaggccagaggattgcttgagcccaggagattgaggctgcagtgagccatgattgtgccactgcactcagcctggacaacagagcaagaccctgtctcaaaaaagagagaaagagtaaagaagtgagaaagtactgtagttaaaagtgacataagcaaagga

SEQ ID NO: 23030 - DNA, 464 bp, Homo sapiens
  AC004562.1_50989
  Located on chromosome 17
  Distance between a terminus base of telomere on chromosomal short arm and 5'-terminus of this base sequence : 71107902
  Distance between 3'-terminus of neighbour sequence of sequence listing upward to telomere on chrosomal short arm and 5'-terminus of this base sequence : 27165
gttcaccaaacatctattccatttttcctgccacacatggaacacacgggtgtcctttctgaaggtggaaaactaaaggtcccaacaagtcattgcagaaaacttaaagtccagcatccttgagtgatgctcatctctctagaccagaattgaagtggcttctttgagcctacaaatgatatatatttatacacacacacacacacacacacacacatgcaaacaaacacacacatgcatacatataccatgcagggaagatacatagatacgggaaaacattttagacacctgtttggtaaaggaaaaaatgagaggcatgcagctgttactgaaccatagcaattttgaaatcatgttaggcacatattaagggtcctattatttggctgggaaaaaatctttcgtttattcctaaattatgctccctagaatctcctttcttcactgttctccatggttac

SEQ ID NO: 23031 - DNA, 450 bp, Homo sapiens
  AC004562.1_88619
  Located on chromosome 17
  Distance between a terminus base of telomere on chromosomal short arm and 5'-terminus of this base sequence : 71145572
  Distance between 3'-terminus of neighbour sequence of sequence listing upward to telomere on chrosomal short arm and 5'-terminus of this base sequence : 37206
tgtaactggaattgtaatccagtaaaatagctacaactaatgtatacaatcatttctaagaaaactgaggagaagttgatgctaggaagagcagcagaatgctaggcttcatttattttccttccttcccttccttccttccttcccttccttccttccttccttccttccttccttccttccttccttccttccttcctttctttctctcttttccttttttgagataatgtctcactctgttacccaggctgagtgcagtagcacaatcacaactcactgcagcctcaaactcccgggcttaggtggtcctcctgcctctcggcctcccaaagtgctgggattacaggcatgagccacctcttctggccttgattcttcattaaatatagccgcctcacatagagtgcttttggtgggtatttttttgtgtacttccactggtctctg

SEQ ID NO: 23032 - DNA, 219 bp, Homo sapiens
  D17S1295
  Located on chromosome 17
  Distance between a terminus base of telomere on chromosomal short arm and 5'-terminus of this base sequence : 71160520
  Distance between 3'-terminus of neighbour sequence of sequence listing upward to telomere on chrosomal short arm and 5'-terminus of this base sequence : 14498
tctagccgttgtgtgtggtaagaattttgagctcaggccgactgggatcaaatcctggctctctactagggcaagtttcaaacactatgaagctcaatttctttttctgtagggagaactaccataaataactacttttgttattgttaatatttattattattattattattattattattattattacttgcaaccaagactgagagagtctgagaa

SEQ ID NO: 23033 - DNA, 270 bp, Homo sapiens
  chr17.fa.O7frz.75320086
  Located on chromosome 17
  Distance between a terminus base of telomere on chromosomal short arm and 5'-terminus of this base sequence : 71235074
  Distance between 3'-terminus of neighbour sequence of sequence listing upward to telomere on chrosomal short arm and 5'-terminus of this base sequence : 74335
aactcagagcatgagttatgtaagaggcagttggttttacagttcgaaataactgaaatatgtactagtccattgtattagtcaaggttctctagagaaacagaaccaatagatagatagatagatagatagatagatagatacatagacagatagatatagatagatatagatagatgatagatatagatagatagatagatagatagatagatagatagatagatagatgagattcataatgaaaactgacttattcaattatgcagg

SEQ ID NO: 23034 - DNA, 199 bp, Homo sapiens
  AC005242.1_22535
  Located on chromosome 17
  Distance between a terminus base of telomere on chromosomal short arm and 5'-terminus of this base sequence : 71311220
  Distance between 3'-terminus of neighbour sequence of sequence listing upward to telomere on chrosomal short arm and 5'-terminus of this base sequence : 75876
ataggcacttactcttcggtttacacacacacacacacacacacacacggattagtttataaagttccaggatccagacccggttaacactgaagttgctttttaggggtctgcgcgctctcgcctggctgctgggaaggagggctgggaggcgctgaagcgagggcagatctgagtgtctgtaggagttgctattcca

SEQ ID NO: 23035 - DNA, 295 bp, Homo sapiens
  AC005242.1_46003
  Located on chromosome 17
  Distance between a terminus base of telomere on chromosomal short arm and 5'-terminus of this base sequence : 71334547
  Distance between 3'-terminus of neighbour sequence of sequence listing upward to telomere on chrosomal short arm and 5'-terminus of this base sequence : 23128
tttaccaaatattcatgtcactgaaatctttctggcaaatctgctaaaatgaatcatttattttcctttgcaaaaatctgttaaaaagaaagcagtattcctgaaaagaggtttgaggaggttcaatttttccatcacttcaccataacacatgcagacacagacacacacacacacacacacacacacacaacttctatgtgtacatgcatgaaactaaaggcacaccatagcgattgtcacagtcctcattcttgagtctctcttgtgactttggtaagatcaaaggagaaat

SEQ ID NO: 23036 - DNA, 221 bp, Homo sapiens
  D17S949
  Located on chromosome 17
  Distance between a terminus base of telomere on chromosomal short arm and 5'-terminus of this base sequence : 71611997
  Distance between 3'-terminus of neighbour sequence of sequence listing upward to telomere on chrosomal short arm and 5'-terminus of this base sequence : 277155
atagaaactccacatttgcattaaagtctaaaggaaattgaattgtactttggtgataagaacacctaacaggtcacctgctgataatgccgtgataaatattatttcaatgataaatatttcaaaacagccacattcttcctcttcaaccataacacacacacacacacacacacacacacacacacacacacacacacacacagacacgagtgggaaag

SEQ ID NO: 23037 - DNA, 243 bp, Homo sapiens
  D17S1300
  Located on chromosome 17
  Distance between a terminus base of telomere on chromosomal short arm and 5'-terminus of this base sequence : 71729908
  Distance between 3'-terminus of neighbour sequence of sequence listing upward to telomere on chrosomal short arm and 5'-terminus of this base sequence : 117690
tagtgtgtatatatgtatgcatgcatctctatctatctatctgtctgtctatctatctatctatctatctatctatctatctatctatctatctatctctacctgtctatttctttccctccctatttatctctttttctctctatcacatcatatgtccagcaacaccaatggtttttctgtctaaaaacaatcatttctaattctaaatgtggaatgaaagccaaaagacagatatctgca

SEQ ID NO: 23038 - DNA, 242 bp, Homo sapiens
  D17S840
  Located on chromosome 17
  Distance between a terminus base of telomere on chromosomal short arm and 5'-terminus of this base sequence : 71768143
  Distance between 3'-terminus of neighbour sequence of sequence listing upward to telomere on chrosomal short arm and 5'-terminus of this base sequence : 37992
tctgggtggcagtgtgagaccctgtataaaaaataattatgcgtgtgtgtgtgtgtgtgtgtgtgtgtgtatatatgtatatgtgtgtgtgtgtgtttgtgtgtgtgtggtaattaacaacatacataatacttaaccaagccccttattttttccacttttaccacacaagttacttgaagagaaattgttgtcatttttcatgatcatttcctcaccatagggagttagaagcataaata

SEQ ID NO: 23039 - DNA, 440 bp, Homo sapiens
  chr17.fa.O7frz.76003588
  Located on chromosome 17
  Distance between a terminus base of telomere on chromosomal short arm and 5'-terminus of this base sequence : 71878731
  Distance between 3'-terminus of neighbour sequence of sequence listing upward to telomere on chrosomal short arm and 5'-terminus of this base sequence : 110346
ggcaatacatagtgaagatcactaaattatctacattttctattaagagacccatgaatgaagaagagagaagcagagggaaagagagaaactgattgaaaagatgcagtcaaaacgggcgttaggaaaaagaaggaggtaagtagaaaaaaattttcagtttgtctacaataaaatgtaaagtctaattaactctattttccaaaagtcatatttgctgtcaagatacagttttgcctacataaattagatggacatggaaccattttttcctctctaggcttgaaatttctattgcatttctttacgcaaggaacagctccttctaattctctgaaggtctctctttacctctctgttgtacttcctgtgaaatatattctttgtgtgtgtgtgtgtgtgtgtgtgtgtgtgtgtttgtgtgaactcacttgctggaa

SEQ ID NO: 23040 - DNA, 381 bp, Homo sapiens
  chr17.fa.O7frz.76073761
  Located on chromosome 17
  Distance between a terminus base of telomere on chromosomal short arm and 5'-terminus of this base sequence : 71949235
  Distance between 3'-terminus of neighbour sequence of sequence listing upward to telomere on chrosomal short arm and 5'-terminus of this base sequence : 70064
gcactcagattacaagagtttaaggagctctgtgtcaggaactggggccagattctctctctctctctctctctctctctgtctgtctctattctttgttctgttctctctctctctctctctctctctgtctgtctctattctttgttctgttgtctctctctctctctctctattctctttgttctattctctctctctctctgtctctattctcttgaattcccaagaagcagatgattcatataaaagttgatttgtttgcttttaaaagactattccccaagaactaccagtggaaaatcagggaagtgagacagagaagaaaagaaggcattctctatgccaacaaatgccaagtaagaggcatgtatttagcaa

SEQ ID NO: 23041 - DNA, 233 bp, Homo sapiens
  chr17.fa.O7frz.76177746
  Located on chromosome 17
  Distance between a terminus base of telomere on chromosomal short arm and 5'-terminus of this base sequence : 72053125
  Distance between 3'-terminus of neighbour sequence of sequence listing upward to telomere on chrosomal short arm and 5'-terminus of this base sequence : 103509
catcagataaagatgtccacagcaggaaccactagatagagatggagatgaagatgaaactcacgttatttcccggtattctctgcctgaatattctctgcagtggtgcaaagtgttaaataaagagatcttggagccattcctcctctgtgtgtgtgtgtgtgtgtgtgtgtgcgtgcacacatgctttatacagagaaaatgcagtgcagtattgaagagccttaggattc

SEQ ID NO: 23042 - DNA, 255 bp, Homo sapiens
  AC005181.1_153314
  Located on chromosome 17
  Distance between a terminus base of telomere on chromosomal short arm and 5'-terminus of this base sequence : 72129635
  Distance between 3'-terminus of neighbour sequence of sequence listing upward to telomere on chrosomal short arm and 5'-terminus of this base sequence : 76277
ttgcactgaagaaactaagacattttactgccctttaggttaggtggtggtgtgggagtcggggttgagatgggggagttcccccattccaaaaaattgaagtagaaatatttgttttgttccacatacctaccccaccaccaccactaccaccaccaacaacaacaacagcaaagaaaaacacacacacacacacacacactcaaaactaaaacacatggaagaaccctagataattaaaggacattccaaagg

SEQ ID NO: 23043 - DNA, 242 bp, Homo sapiens
  AC005181.1_184277
  Located on chromosome 17
  Distance between a terminus base of telomere on chromosomal short arm and 5'-terminus of this base sequence : 72160696
  Distance between 3'-terminus of neighbour sequence of sequence listing upward to telomere on chrosomal short arm and 5'-terminus of this base sequence : 30806
gaattactcataatcgcactgaagtgtttgaccaagcaaggaatgtcgtaacgtgcgtgcatgcatacacacacacacacatacacacacacacacacacacaccagtgtataccagtctaattcaggaatagaaaatgggttctctcctgcttgttgtctcttaccatcaacaatatcctgtgatgtttttgactgaaacacttttcagctggcttccttggcattcttgtacaactttat

SEQ ID NO: 23044 - DNA, 183 bp, Homo sapiens
  D17S1350
  Located on chromosome 17
  Distance between a terminus base of telomere on chromosomal short arm and 5'-terminus of this base sequence : 72248748
  Distance between 3'-terminus of neighbour sequence of sequence listing upward to telomere on chrosomal short arm and 5'-terminus of this base sequence : 87810
tcacaaatgtcatatatccatatattgagacacacacacacacacacacacacacacacacatatatatacacatacatacagtcttgctatcatcgctaaaatttttgtcatcatctaactcatttttggctttttttttctggctttcatacttttccttatctcatctgttagattgcca

SEQ ID NO: 23045 - DNA, 166 bp, Homo sapiens
  AC005273.1_17153
  Located on chromosome 17
  Distance between a terminus base of telomere on chromosomal short arm and 5'-terminus of this base sequence : 72256360
  Distance between 3'-terminus of neighbour sequence of sequence listing upward to telomere on chrosomal short arm and 5'-terminus of this base sequence : 7429
tcagtctattaccaaaggttcaaggctgcaatcttctggcatgtgtcaggaataaaacacacacatacacacacacacacacacacacacacacacacacacacaaactcaaacaagattgcagaagatgtgttctgatttaatctaggtgtcaagtctttgatgc

SEQ ID NO: 23046 - DNA, 315 bp, Homo sapiens
  AC005273.1_103231
  Located on chromosome 17
  Distance between a terminus base of telomere on chromosomal short arm and 5'-terminus of this base sequence : 72342382
  Distance between 3'-terminus of neighbour sequence of sequence listing upward to telomere on chrosomal short arm and 5'-terminus of this base sequence : 85856
ttctgtatgaaactgcatgtaaagcgtctctttaccacagatgtctcaggttctctaccttactatggtgaactctgagttttgagggagggatgaaatattgtatacctgcacattaacaaacacacacacacacacacacacacacacacacacacacacacagagagagagagagagagagaaagagggttttcagactttgtttttagatttaacattttttaataaatgtagattgagtacaatactgaataagtaaggttaatgagaagaagaaagatgacaaaagtctgtcatttaggagcattaatc

SEQ ID NO: 23047 - DNA, 374 bp, Homo sapiens
  AC005273.1_111317
  Located on chromosome 17
  Distance between a terminus base of telomere on chromosomal short arm and 5'-terminus of this base sequence : 72350441
  Distance between 3'-terminus of neighbour sequence of sequence listing upward to telomere on chrosomal short arm and 5'-terminus of this base sequence : 7744
agttgagtcctgttggcacaagaactgggaagatataaaggagctaaagtgatattctttctcctccatctacgagaatagagaaaagtgatggagggggtaatcagaaaaagagagagagagacagacagacagaaacatacacacagacacacacacacacacacacacacacacacacacacacacacacacagagttagagagagtcagtaatcacagagatagagatgaagagaagagtttctatcagtatgtcaattagagtccaagaaggaaacagatgccacactcacatacagctaatttaaggagggcttagttagcaggataagtggaaggagtagtagctgtaatgagaaatgcaagattct

SEQ ID NO: 23048 - DNA, 479 bp, Homo sapiens
  AC005138.1_132606
  Located on chromosome 17
  Distance between a terminus base of telomere on chromosomal short arm and 5'-terminus of this base sequence : 72491858
  Distance between 3'-terminus of neighbour sequence of sequence listing upward to telomere on chrosomal short arm and 5'-terminus of this base sequence : 141043
gcttattcctgtaatcctagcactttgggaggccaaggcgggaggattgcttgagcccaggggttcaacaccagcctgggcaacatagagatactcccatctctaaaaaatattaataaattagccgggcatggtggtgcatacctgtagtcccagctactcaagagggtgaggcaggaggattgcttgagcccaggaggttgaggctgcagtgagcagtgattgcactactgcactccatcctgggtgacaaagcaagagcctgtttcaacacacacacacacacacacacacacacacacacaccccaccaccaccaacaacaacaactttttcctggaataaatatctataagatagaggtggaaagcttatttttgtcaagtgttctcttattgttagtattctttcaaagctagcatggtaaacaagtgttggattttgttgtgtacaaagttggagtcatttcttagtgctac

SEQ ID NO: 23049 - DNA, 348 bp, Homo sapiens
  AC005138.1_140283
  Located on chromosome 17
  Distance between a terminus base of telomere on chromosomal short arm and 5'-terminus of this base sequence : 72499647
  Distance between 3'-terminus of neighbour sequence of sequence listing upward to telomere on chrosomal short arm and 5'-terminus of this base sequence : 7310
aatcttcatgacagtaagccagctggcacagaaattcacactcatgaggaagtaaaccattgctgcacaatagggcctgagaagaatatgtgtgccactgggacatttcttggtatccccatgtccaggttttaactgtaagtagagaagcacctaaaacacacacacacacacacacacacacacacacacacacacacacaaaacctcagttactgagaggcctccaggatgaggagataggttaccctaccaggcaagaacccagatcatccaaaatgctagagaaggggaaagaagcctagaaagagtaatggagggaagagaccgtgagtagcggttactgcc

SEQ ID NO: 23050 - DNA, 300 bp, Homo sapiens
  AC005279.1_33159
  Located on chromosome 17
  Distance between a terminus base of telomere on chromosomal short arm and 5'-terminus of this base sequence : 72621295
  Distance between 3'-terminus of neighbour sequence of sequence listing upward to telomere on chrosomal short arm and 5'-terminus of this base sequence : 121300
agattagaacagaaaggagcaccatgtcctctggttctggcttctgtgttaatttgaaaaaagaggtttttatctatctatctatctatctatctatctatctatctatctatctatatctatgcatgatttttatagttacaaatgaaagtggatagatagatgctgggtgaacattttaagatgtaaaacaaagatactttcaccaagtcccacctgttcaaacatgcgatcattttttttccttaggggaaaacctctgaagctggtttgcaattgttaagctaatctgtagcctag

SEQ ID NO: 23051 - DNA, 154 bp, Homo sapiens
  D17S1304
  Located on chromosome 17
  Distance between a terminus base of telomere on chromosomal short arm and 5'-terminus of this base sequence : 72621325
  Distance between 3'-terminus of neighbour sequence of sequence listing upward to telomere on chrosomal short arm and 5'-terminus of this base sequence : -270
ctggttctggcttctgtgttaatttgaaaaaagaggtttttatctatctatctatctatctatctatctatctatctatctatctatatctatgcatgatttttatagttacaaatgaaagtggatagatagatgctgggtgaacattttaaga

SEQ ID NO: 23052 - DNA, 150 bp, Homo sapiens
  D17S970
  Located on chromosome 17
  Distance between a terminus base of telomere on chromosomal short arm and 5'-terminus of this base sequence : 72621325
  Distance between 3'-terminus of neighbour sequence of sequence listing upward to telomere on chrosomal short arm and 5'-terminus of this base sequence : -154
ctggttctggcttctgtgttaatttgaaaaaagaggtttttatctatctatctatctatctatctatctatctatctatctatctatatctatgcatgatttttatagttacaaatgaaagtggatagatagatgctgggtgaacatttt

SEQ ID NO: 23053 - DNA, 355 bp, Homo sapiens
  AC005279.1_31319
  Located on chromosome 17
  Distance between a terminus base of telomere on chromosomal short arm and 5'-terminus of this base sequence : 72623106
  Distance between 3'-terminus of neighbour sequence of sequence listing upward to telomere on chrosomal short arm and 5'-terminus of this base sequence : 1631
ttccagttccttactgaaagtattccccaatcctctataaacacctatggcataaccaaagaatgaaagctaatctataaacacaaaacaaaaaaaaaggtgagggttttgggtgtgtgtgtgtgtgtgtgtgtgtgtgtgtgtgtttaattatcattattgtataatcacagtttaaaaggaatcattttctgcttcctttttattatatttgccttcttcactcaatgtttgggtcaatcaattggcattcagtgttaatgtggccaagttttctgtttggtgctgaaaagaacaactttgcctgtgagagaggaaatgatttccagccataactccagctaggtacttacca

SEQ ID NO: 23054 - DNA, 276 bp, Homo sapiens
  chr17.fa.O7frz.76853599
  Located on chromosome 17
  Distance between a terminus base of telomere on chromosomal short arm and 5'-terminus of this base sequence : 72728934
  Distance between 3'-terminus of neighbour sequence of sequence listing upward to telomere on chrosomal short arm and 5'-terminus of this base sequence : 105473
cacagtcattcagaaagattctagccagccagaacctgcccactagtgggaagctaaatagttggttagatgtaatttgtttttaaatttgcaatataaaagaaaagacaagttgccaggatatacttctcttatttacatagcttaaagcaaatatactttgaagccaattttttttttaatcatcaaggatgtgtgtgtgtgtgtgtgtgtgtgtgtgtgtgtgtgtgtgtgtaacaagaggagcaaataggtaataaagccttgaggtaaacc

SEQ ID NO: 23055 - DNA, 431 bp, Homo sapiens
  chr17.fa.O7frz.77183484
  Located on chromosome 17
  Distance between a terminus base of telomere on chromosomal short arm and 5'-terminus of this base sequence : 72978245
  Distance between 3'-terminus of neighbour sequence of sequence listing upward to telomere on chrosomal short arm and 5'-terminus of this base sequence : 249035
aatctaactttcccatttgagtactgggtttggagaatgagtattatgtaagccttctctttttccctatccaagaaaatattcagagacaaacaaagttccaacagagcgccagagaaatagctctacatcttgctatatatgttgctacatcttgctatatatctggagatccttgtccaccaccttttcctacccatatcaactctcaaacaaaaaaacatgtttgagcacacaaatacacacacacacacacacaggccttcctcaaggagctttcacccaacatacattctgggatcattccattctaagctagtcccattttctttcccaagtgtgatctttgaaacacagagcacatttttcatatttatatatggtacttactaaatatatagattccatggttcctttacaggcctatagaa

SEQ ID NO: 23056 - DNA, 290 bp, Homo sapiens
  AC005144.1_42498
  Located on chromosome 17
  Distance between a terminus base of telomere on chromosomal short arm and 5'-terminus of this base sequence : 73143755
  Distance between 3'-terminus of neighbour sequence of sequence listing upward to telomere on chrosomal short arm and 5'-terminus of this base sequence : 165079
gcatgaactaatcgatatgaaattacttatgataatagtttccagagtgattacattgcttttggattctaaacacaggttttgtttctaaaagaaaactatattattgtttgtttctaatagttgtgtgtgtgtgtgtgtgtgtgtgtgtgtgtgttttaacacttctctggagttttttacatggaaagcggcagtagcaatattgtttttcctaactacaaaacatccaaaggtccatttagcaacttattgtgtatatatttagccatagtcctatagttcctaca

SEQ ID NO: 23057 - DNA, 229 bp, Homo sapiens
  G07955
  Located on chromosome 17
  Distance between a terminus base of telomere on chromosomal short arm and 5'-terminus of this base sequence : 73205157
  Distance between 3'-terminus of neighbour sequence of sequence listing upward to telomere on chrosomal short arm and 5'-terminus of this base sequence : 61112
tttggagtggaagttaaagatgtaacaacccctacatccctccctatctatctatctatctatctatctatctatctatctatcatctacctacctacctacctacatatctacctccctccctccctattcctagtctataatgtagaaaaaaagtacactaacatttcttcccatgggcaatgatactaatattgtatttttggcagttttatctgtacttgaaaat

SEQ ID NO: 23058 - DNA, 234 bp, Homo sapiens
  DISO7_10004264
  Located on chromosome 17
  Distance between a terminus base of telomere on chromosomal short arm and 5'-terminus of this base sequence : 73313025
  Distance between 3'-terminus of neighbour sequence of sequence listing upward to telomere on chrosomal short arm and 5'-terminus of this base sequence : 107639
gcagttacttgtgcaatacttatgtaatattgcaattgcttttgttcaagaatgcaaagtcttgtatttatgtccatataataacatggcatatattatatagactttgacatatatatatatatatatatatatatatatatatatatatatagagagagagagagagagagagagagatagagagagagagagagagacagaaatatgtctctgtaggtagaaatatggaca

SEQ ID NO: 23059 - DNA, 101 bp, Homo sapiens
  DISO7_10004267
  Located on chromosome 17
  Distance between a terminus base of telomere on chromosomal short arm and 5'-terminus of this base sequence : 73389637
  Distance between 3'-terminus of neighbour sequence of sequence listing upward to telomere on chrosomal short arm and 5'-terminus of this base sequence : 76378
acaatgaagtgaagtggtgtgtgtgcacatatgtatctgtgtgtgtgtgtgtgtgtgtgtgtgtgtgtgtgtggtattagtcatcaactacccatgctgac

SEQ ID NO: 23060 - DNA, 271 bp, Homo sapiens
  DISO7_00003794
  Located on chromosome 17
  Distance between a terminus base of telomere on chromosomal short arm and 5'-terminus of this base sequence : 73496701
  Distance between 3'-terminus of neighbour sequence of sequence listing upward to telomere on chrosomal short arm and 5'-terminus of this base sequence : 106963
gtttggagtcctgactcactttaaaaagcatgcagtaggcccaatcatcttgtgtgtgtgcagagaagactttaaactagttctcacacacacacacacacacacacacacacacagagacacccccacacacacagtgcctccagcctcttctccagccagggatatgatgggaaatggaggcctctttatcatccacgcagtgggtagcattgagggcctccagctcctggggaccactcaactcctcagatcctgaatacaggactgg

SEQ ID NO: 23061 - DNA, 254 bp, Homo sapiens
  chr17.fa.O7frz.77844477
  Located on chromosome 17
  Distance between a terminus base of telomere on chromosomal short arm and 5'-terminus of this base sequence : 73639305
  Distance between 3'-terminus of neighbour sequence of sequence listing upward to telomere on chrosomal short arm and 5'-terminus of this base sequence : 142333
caacgctcaatctacatttaaggcgactgtatttgtaagattggggacaaggaagaggggagaagcagctcttgagagagagagtcctaaatctgtatattcagaatccatgggtgaatgtttgggaagcagtgatttgtgtgtgtatgtgtgtgtgtgtgtgtgtgtgtgtatacacacgcacacatataagcacacacattctcacacactcgaacccacacactccaggtttctgaagagctgtataccat

SEQ ID NO: 23062 - DNA, 285 bp, Homo sapiens
  AC006948.4_58801
  Located on chromosome 17
  Distance between a terminus base of telomere on chromosomal short arm and 5'-terminus of this base sequence : 73811483
  Distance between 3'-terminus of neighbour sequence of sequence listing upward to telomere on chrosomal short arm and 5'-terminus of this base sequence : 171924
tctcaagtactcagtgatccaggagagcaaggacatgtgaggtcaatggacctctatgtgaggatattggctgagaaaacaaaacaaaacaaaacaaaacaaaacaaaacaaaacaaaaactcctatgaaggattttctcttaaccggcctaatgcagacataagctatacaaacacattgcaccaagattatttggggcacagggcatgaaatagtgagatgggaataagaagggcataaaaatgattcttaaatactccatgtttcagtaacagctcctaaca

SEQ ID NO: 23063 - DNA, 194 bp, Homo sapiens
  D17S1797
  Located on chromosome 17
  Distance between a terminus base of telomere on chromosomal short arm and 5'-terminus of this base sequence : 73833360
  Distance between 3'-terminus of neighbour sequence of sequence listing upward to telomere on chrosomal short arm and 5'-terminus of this base sequence : 21592
ctaaggcattcatttgcggtttttatttatagtcctgcatatatttgtgcacacatagatacaccagccaggaagtgcaggtccaggtacacacttacacacacacacacacacacacactctctctctctctctctctctcggaaaatcaagatttatttgtatgtacatacagcccagttaaagataagtcc

SEQ ID NO: 23064 - DNA, 129 bp, Homo sapiens
  DISD22_0010954
  Located on chromosome 17
  Distance between a terminus base of telomere on chromosomal short arm and 5'-terminus of this base sequence : 73924745
  Distance between 3'-terminus of neighbour sequence of sequence listing upward to telomere on chrosomal short arm and 5'-terminus of this base sequence : 91191
tgcaaggatagcaggaaagggtgtgtgtgtgtgtgtgtgtgtgtgtgtgtgtgtgtgtgtgtgtgtgtgtataaaaccaaaaaataaaccaagctatcatagccccactgtaaattctcattcatagtt

SEQ ID NO: 23065 - DNA, 121 bp, Homo sapiens
  DISD22_0010955
  Located on chromosome 17
  Distance between a terminus base of telomere on chromosomal short arm and 5'-terminus of this base sequence : 74034152
  Distance between 3'-terminus of neighbour sequence of sequence listing upward to telomere on chrosomal short arm and 5'-terminus of this base sequence : 109278
agtgctgaaatgagcacgtgtcttaaaatccctcccaggattttctttgtctttgtaggagtgtaagagtgtgtgtgtgtgtgtgtgtgtgtgtgtgtttgcagcctagctgtcaggaggt

SEQ ID NO: 23066 - DNA, 101 bp, Homo sapiens
  DISD22_0010958
  Located on chromosome 17
  Distance between a terminus base of telomere on chromosomal short arm and 5'-terminus of this base sequence : 74120095
  Distance between 3'-terminus of neighbour sequence of sequence listing upward to telomere on chrosomal short arm and 5'-terminus of this base sequence : 85822
aatttcggcttagatcatcttctttcttttctttctctctctctctctctctctctctctttctttctgccctctcaggcccaccttctcctgggattcac

SEQ ID NO: 23067 - DNA, 461 bp, Homo sapiens
  chr17.fa.O7frz.78437311
  Located on chromosome 17
  Distance between a terminus base of telomere on chromosomal short arm and 5'-terminus of this base sequence : 74311757
  Distance between 3'-terminus of neighbour sequence of sequence listing upward to telomere on chrosomal short arm and 5'-terminus of this base sequence : 191561
tagcgatgtctagacaaatgagaatagatgagaggaagggcatatgtgttcattttcaacatttggttggaagcagataatgaaataaaagatctgaatcattaggttctctttcttaactctcatcatcatgacagtgaaaaaacaagaaggggtgtgtgtgtgtgtgtgtgtgtgtgtgtgtgtgtgtgtgtgtgtgtcacagcagcctggtatcccttttgtgagattccttcatgaaaggaacttatccaagaaaattgttttagtattttttaaaataaatggatgcatttatgtgattagattttaagccttctcctctcccgcattagagacacatgttttaaatgaaaacttgtgtttgtttggacctatttctgcttggtgctgtggcctgaaaatgtttgcatcccctcagaattcctatgttgagatcctaactgccacagtgattgtat

SEQ ID NO: 23068 - DNA, 274 bp, Homo sapiens
  DISO7_00029759
  Located on chromosome 17
  Distance between a terminus base of telomere on chromosomal short arm and 5'-terminus of this base sequence : 74461877
  Distance between 3'-terminus of neighbour sequence of sequence listing upward to telomere on chrosomal short arm and 5'-terminus of this base sequence : 149659
cacttgctgtctttctgtcacagtgtgtgtgtgtgtgtgtgtgcgcgcgcgcgcgcgtgcatgcgcgtgtgtttttatatatatatataacatttaccaccttttaaaaactgctttcagccgtatgctttcctctaactaaccattgctgtttccctccttttctcagctaagctcctggaaagaactgactccacttgccatctctaccacctctcatccaagccgccttcctcctcaacatgctgccatccgccttctacccacgccactt

SEQ ID NO: 23069 - DNA, 346 bp, Homo sapiens
  chr17.fa.O7frz.78749517
  Located on chromosome 17
  Distance between a terminus base of telomere on chromosomal short arm and 5'-terminus of this base sequence : 74511780
  Distance between 3'-terminus of neighbour sequence of sequence listing upward to telomere on chrosomal short arm and 5'-terminus of this base sequence : 49629
tctgaactcactggtagatcacctaatggggtgttacaaccattagtttcagccttgcttactgaacattgaccagaatagcctgctgtgccgtcctgtgctgtcctgtcctgtcctatcctatgctgtcctgtcctgtcctgtgctgtgctgtgctgtgctgtgctgtgctgtcctgtcctgtgctgtgctgtgctgtgctgtcctgtcctgtcctgtcctgtcctgtcctgtcctgtcctgtcctgtgctgtgctgtcctgtcctgtgctgtcctgtcctgtcctgtcctgtgctgtgctgtgctgtgctgcgctgtgcttcctggcagtggtattaacaagta

SEQ ID NO: 23070 - DNA, 455 bp, Homo sapiens
  chr17.fa.O7frz.78835314
  Located on chromosome 17
  Distance between a terminus base of telomere on chromosomal short arm and 5'-terminus of this base sequence : 74572585
  Distance between 3'-terminus of neighbour sequence of sequence listing upward to telomere on chrosomal short arm and 5'-terminus of this base sequence : 60459
attcagtcctaggagccatcagagggccagtggacgtcgactggtcccagctgtccctgcgtcccacagcttggaggtgcagcggccatacaggtggtccccttgctgtagccacgtcagtcagcacctgctggtctgacccagcacagtctctcctacatgctgtgagggagcaaaggggagcaggcaagaagtgggagtcgcatggagttgcagctgtttatttttgactgtgatgattcagcctcttttccaatagtttaataagtcataatcaatcctgcagcctccccttcctcaccctcctccaagtacataggtatacacacacacacacacacacacacacacacacaccatcctcagtacagttttagaggatgtgaaaacagaaagcaaaccccaactagctttctctgtgagctgagctgccttgatttgtccatcctattatc

SEQ ID NO: 23071 - DNA, 217 bp, Homo sapiens
  D17S1862
  Located on chromosome 17
  Distance between a terminus base of telomere on chromosomal short arm and 5'-terminus of this base sequence : 74734465
  Distance between 3'-terminus of neighbour sequence of sequence listing upward to telomere on chrosomal short arm and 5'-terminus of this base sequence : 161425
ccatctacagctctgtaaccggtcaaatacagtaggggggaagaaacaatgactacacacacacacacacacacacacacacacacacacacacacacacacacacacacacagtaaggtaaatctgctaagaagatgggtggtgaaatggcgctttcgaaaaccaaggagaagctgggcgcagtggcttatgcctgtaatctcagtgctttgggag

SEQ ID NO: 23072 - DNA, 90 bp, Homo sapiens
  DISO7_10002151
  Located on chromosome 17
  Distance between a terminus base of telomere on chromosomal short arm and 5'-terminus of this base sequence : 75133777
  Distance between 3'-terminus of neighbour sequence of sequence listing upward to telomere on chrosomal short arm and 5'-terminus of this base sequence : 399095
attaagctggagatgagcgcacacacacacacacacacacacacgatggccatgagggtgccttgccccaggcaacacaaccctgagctg

SEQ ID NO: 23073 - DNA, 227 bp, Homo sapiens
  D17S1829
  Located on chromosome 17
  Distance between a terminus base of telomere on chromosomal short arm and 5'-terminus of this base sequence : 75230238
  Distance between 3'-terminus of neighbour sequence of sequence listing upward to telomere on chrosomal short arm and 5'-terminus of this base sequence : 96371
ttccataagtgcctctgtatcctccactgaaattatatttcccaacttcctacagtgatttctctcccctcgtgactcctctcttcctatttgctaggtcttgtgcactctgtctctctcttctccccatctcctacaaacacatacacacacacacacacacacactcatgcagagatgcccatatccatgaactcacaaacttaactacccctatgaccactcag

SEQ ID NO: 23074 - DNA, 434 bp, Homo sapiens
  AC021104.2_130863
  Located on chromosome 17
  Distance between a terminus base of telomere on chromosomal short arm and 5'-terminus of this base sequence : 75462579
  Distance between 3'-terminus of neighbour sequence of sequence listing upward to telomere on chrosomal short arm and 5'-terminus of this base sequence : 232114
ctgaaagtgagagccttagctattggagagatcaggcgtgtgtagagaaccttcagaagcctgactacctgatgatgttatgcactgtttgtggcttggagagaaaggtgtgcatctcatttgattttttcctttactttttgttgaaattactttgggaaagtctagcctatatcaagaaagagacaaatgggcaaagggagggagatggatggatggatggatggatggatggatggatggatgcagagatatagagagatatagattgtgcaaaatccaggttataaagaaagggaagggggctgggaaagggtggacccctaagccaggcttaacagcagctgtagagaacaaaataaaagtaaaattaaccaacctcccaaatcagtcaaaatcctacctgatttctaaggctcaacagaattatgttc

SEQ ID NO: 23075 - DNA, 203 bp, Homo sapiens
  D17S1602
  Located on chromosome 17
  Distance between a terminus base of telomere on chromosomal short arm and 5'-terminus of this base sequence : 75675464
  Distance between 3'-terminus of neighbour sequence of sequence listing upward to telomere on chrosomal short arm and 5'-terminus of this base sequence : 212451
aggcggatatgatttcagaaacagccgtgtgtgtgtgtgtgtgtgtgtgtgtgtgtgtgtgtccccatcccaaaccctgtgccccacatcccacacccggggtctccagccatagttttctcctctccactggaggaaatctaaacttttcattgggtcaagaagacccctaggtgggggtagggatggtaaggggactccct

SEQ ID NO: 23076 - DNA, 279 bp, Homo sapiens
  Z23330.1_178
  Located on chromosome 17
  Distance between a terminus base of telomere on chromosomal short arm and 5'-terminus of this base sequence : 75704191
  Distance between 3'-terminus of neighbour sequence of sequence listing upward to telomere on chrosomal short arm and 5'-terminus of this base sequence : 28524
atgtttgctgttgacaaagttccagcctttggaagcaagactcataggcagatcactgcaaccccaggctttgatacagtggaggtgcagtgtgtgtgtgtgtgtgtgtgtgtgtgtgtgtgtttgtgtgtgtgtgttcatgcacatgcacgtgatagaagagaacacagtttaccaggggaattcaaggaacccctcactgattcaaagtccacagactaaccctgggacatgcatctgttctgccatagtgacctgaggcttgataggataagatgg

SEQ ID NO: 23077 - DNA, 231 bp, Homo sapiens
  D17S929
  Located on chromosome 17
  Distance between a terminus base of telomere on chromosomal short arm and 5'-terminus of this base sequence : 75704195
  Distance between 3'-terminus of neighbour sequence of sequence listing upward to telomere on chrosomal short arm and 5'-terminus of this base sequence : -275
ttgctgttgacaaagttccagcctttggaagcaagactcataggcagatcactgcaaccccaggctttgatacagtggaggtgcagtgtgtgtgtgtgtgtgtgtgtgtgtgtgtgtgtttgtgtgtgtgtgttcatgcacatgcacgtgatagaagagaacacagtttaccaggggaattcaaggaacccctcactgattcaaagtccacagactaaccctgggacatgc

SEQ ID NO: 23078 - DNA, 103 bp, Homo sapiens
  HUMUT157
  Located on chromosome 17
  Distance between a terminus base of telomere on chromosomal short arm and 5'-terminus of this base sequence : 75834367
  Distance between 3'-terminus of neighbour sequence of sequence listing upward to telomere on chrosomal short arm and 5'-terminus of this base sequence : 129941
cggcctctcattttcgtaacagagcattgctggagtgtgtgtgtgtgtgtgtgtgtgtgtgtgtatggtatgcatgtgcacatgtgtgtatgcagtgcgtgtg

SEQ ID NO: 23079 - DNA, 260 bp, Homo sapiens
  D17S1807
  Located on chromosome 17
  Distance between a terminus base of telomere on chromosomal short arm and 5'-terminus of this base sequence : 75834380
  Distance between 3'-terminus of neighbour sequence of sequence listing upward to telomere on chrosomal short arm and 5'-terminus of this base sequence : -90
tcgtaacagagcattgctggagtgtgtgtgtgtgtgtgtgtgtgtgtgtgtatggtatgcatgtgcacatgtgtgtatgcagtgcgtgtgtgtgcatgtgcctatttatatgtgtgtgcgtattgtgtgtgtccatgcatgtgcgtggtgtgtgtgcatgcatatttgtggatatgtgtgtgtggtatgtgtacatgcatatgtatgtgtgggggagtgtcctggggcgggagagaggaagccaggtatttgccctgagc

SEQ ID NO: 23080 - DNA, 390 bp, Homo sapiens
  chr17.fa.O7frz.80253596
  Located on chromosome 17
  Distance between a terminus base of telomere on chromosomal short arm and 5'-terminus of this base sequence : 75845101
  Distance between 3'-terminus of neighbour sequence of sequence listing upward to telomere on chrosomal short arm and 5'-terminus of this base sequence : 10461
  misc_feature (1)...(390): n = A,T,G or C
agctgcaatattagctcaactgtctctgagcaccagtgaaaccaggaacttccagaaactgttggggaggctctttcaagacacagttttgttttgttttgttttgttttgttgacatggagtctcgctctgttgcccagtcgctcaggctggagtgcagtggtgtgatctcagctcactgcaacctccgcctcctgggttcaagtgactttcctgcctcagcctcccaagtagctgggactacaagcgcacaccaccacatccagctaatttttttatttttagtagagacggggttccaccatgttggccaggctggttgaaacaattttgcattgagccaccataaccccagtgttaatattgctataacctcacttgtaccgacan

SEQ ID NO: 23081 - DNA, 287 bp, Homo sapiens
  HUMUT2284
  Located on chromosome 17
  Distance between a terminus base of telomere on chromosomal short arm and 5'-terminus of this base sequence : 75966534
  Distance between 3'-terminus of neighbour sequence of sequence listing upward to telomere on chrosomal short arm and 5'-terminus of this base sequence : 121043
tccctaaatatctcccctcatgaaatgttaataccaaagatgtattgtacatccatccattcacctgtctatctatctatctatctatctatctatctatctatctatctacctacctacctatctatctatctacctatctatctatctatccatccatccatctatatctctgttttgtatctagaaagagtaaaaatatttttccaccctgcaagaaccaatatttgcccccatggggaatgcaagagggcctccgtatggcttccaaggctaagtcagaagaa

SEQ ID NO: 23082 - DNA, 164 bp, Homo sapiens
  G07951
  Located on chromosome 17
  Distance between a terminus base of telomere on chromosomal short arm and 5'-terminus of this base sequence : 75966547
  Distance between 3'-terminus of neighbour sequence of sequence listing upward to telomere on chrosomal short arm and 5'-terminus of this base sequence : -274
cccctcatgaaatgttaataccaaagatgtattgtacatccatccattcacctgtctatctatctatctatctatctatctatctatctatctatctacctacctacctatctatctatctacctatctatctatctatccatccatccatctatatctctgtt

SEQ ID NO: 23083 - DNA, 366 bp, Homo sapiens
  HUMUT1523
  Located on chromosome 17
  Distance between a terminus base of telomere on chromosomal short arm and 5'-terminus of this base sequence : 75976831
  Distance between 3'-terminus of neighbour sequence of sequence listing upward to telomere on chrosomal short arm and 5'-terminus of this base sequence : 10120
gctgcaccttctcttgggattttggagtgtcttggtgagccctggtgctgctgcctagagccaagaacgcatgggagggggcaggacttcagggaccatagacagactttctttcttccttctttccttccttccttccttccttccttccttccttccttccttccttccttcccagttttattaaggtataattgggataaaataaactgcacatatttaaagtgcacaatttgaaacacttttcttgttgtttttatgattttttcaaatgtattatttatgggcattcagctagtttcaagttcagggccatgatgcatagtgtgctgtgaacattttagaccatgcctttggcgggcttct

SEQ ID NO: 23084 - DNA, 191 bp, Homo sapiens
  G07959
  Located on chromosome 17
  Distance between a terminus base of telomere on chromosomal short arm and 5'-terminus of this base sequence : 76009498
  Distance between 3'-terminus of neighbour sequence of sequence listing upward to telomere on chrosomal short arm and 5'-terminus of this base sequence : 32301
agatggatgggtgggtagatgaaagatggatggatggatagatagtagatagatagatagatagatagatagatagatagatagatagttgataggtagacagattacatccacaattccttttcaggagcttggtattttgccaaaaccatttctcaatagccgttttgtcctgagttaaccacctccct

SEQ ID NO: 23085 - DNA, 169 bp, Homo sapiens
  HUMUT7429
  Located on chromosome 17
  Distance between a terminus base of telomere on chromosomal short arm and 5'-terminus of this base sequence : 76009506
  Distance between 3'-terminus of neighbour sequence of sequence listing upward to telomere on chrosomal short arm and 5'-terminus of this base sequence : -183
gggtgggtagatgaaagatggatggatggatagatagtagatagatagatagatagatagatagatagatagatagatagttgataggtagacagattacatccacaattccttttcaggagcttggtattttgccaaaaccatttctcaatagccgttttgtcctgag

SEQ ID NO: 23086 - DNA, 245 bp, Homo sapiens
  G07958
  Located on chromosome 17
  Distance between a terminus base of telomere on chromosomal short arm and 5'-terminus of this base sequence : 76012602
  Distance between 3'-terminus of neighbour sequence of sequence listing upward to telomere on chrosomal short arm and 5'-terminus of this base sequence : 2927
tggagattctagagatgcaacagtgaacaaaggggcaagattgtgctcttgaggaagttgcaaataggtagattcaggcaatggccagatggatagatagatagacagacagacaggtggacagacagatagatggatagatagatagatagatagatagatagataggtggatagatagataaacagacagatgatagatatgatatgaaagatgatagagatggctggctggctgactggaaa

SEQ ID NO: 23087 - DNA, 419 bp, Homo sapiens
  chr17.fa.O7frz.80972097
  Located on chromosome 17
  Distance between a terminus base of telomere on chromosomal short arm and 5'-terminus of this base sequence : 76308759
  Distance between 3'-terminus of neighbour sequence of sequence listing upward to telomere on chrosomal short arm and 5'-terminus of this base sequence : 295912
aggtaatctaggtagtggcattacgaggtgaaactaattatggctagaagatcatgaaatccttttttaatcacccatatccgtggcttgtttgtttgtttgtttgttttgatggtggagtcttgccctgttgcccaggctgaagtgcagtggcacaatctcagctcactgcaacctctgcctcccaggttcaagtgattctcctgcctcagcctcccgagtagctgggattgcaggtgcgcgtcaccaagcccagctaatttttaggagagacagggtttcaccatgttgccaggctggtctcaaactcctgacctcaggtgatctgcctgcctcggcctcccaaggtgctgggattacaggcgtgagccactgtgcccagccgccatggctttgttctagctgaaggttctagaagt

SEQ ID NO: 23088 - DNA, 252 bp, Homo sapiens
  chr17.fa.O7frz.80732118
  Located on chromosome 17
  Distance between a terminus base of telomere on chromosomal short arm and 5'-terminus of this base sequence : 76332666
  Distance between 3'-terminus of neighbour sequence of sequence listing upward to telomere on chrosomal short arm and 5'-terminus of this base sequence : 23488
gagccactgttcactgtactccagcctgggcaacagagcagacgctgtctctttaaacacacacacacacacacacacacacacacacacacacgcacgcacagagaggttcagagagaagggagatgcaagcagggaactactggcccactgacaagaggcgctttgtcctgagaacacgaaggaagctcctactgctgtaccccagcccaccaggtgagatcccagggatacctacatctggaatcttcc

SEQ ID NO: 23089 - DNA, 432 bp, Homo sapiens
  chr17.fa.O7frz.81046914
  Located on chromosome 17
  Distance between a terminus base of telomere on chromosomal short arm and 5'-terminus of this base sequence : 76483230
  Distance between 3'-terminus of neighbour sequence of sequence listing upward to telomere on chrosomal short arm and 5'-terminus of this base sequence : 150312
agctatccggattctgaagcccctgacctacttccccacatggccaagactggctggcagatgaggctctgtccttgtgctgaggacaagggttaatcatagcctcagggggaccagggtgggactggggatgctggactaggccctgccatggtctgtgccctggactctggcctcagcctccttggctgaaatgagatacagctcctctcaaacacacacacacacacacacacacacacacacacacatccacacattgtgacaaccccctctcccatcctgggcagtaaatttttccatgaacacctattaggctccccttaagtaccagacaccatcctgggagctaggaatagtcacagccctgaccctgaaggtataccctggcaggtgaaggaggcaggcttgtaactaagtgtaggtggcaca

SEQ ID NO: 23090 - DNA, 257 bp, Homo sapiens
  chr17.fa.O7frz.81422913
  Located on chromosome 17
  Distance between a terminus base of telomere on chromosomal short arm and 5'-terminus of this base sequence : 76678991
  Distance between 3'-terminus of neighbour sequence of sequence listing upward to telomere on chrosomal short arm and 5'-terminus of this base sequence : 195329
aaattcctagaatagtaccaggagcaccagtcaagttgttgtgacctaaatttgtgtgtgtgtgtgtgtgtgtgtgtgtgtgtgtattttgtctcctccactggaacagaagttgcacagaagcagaggtctgtctgtgttaccacacttttatttccagcagcaagcagtttctgggtcctactaggtaaataaaagaattaatggggagagagttgtgcagtgagcagtttgtaccattaacggttaactagaaa

SEQ ID NO: 23091 - DNA, 423 bp, Homo sapiens
  chr17.fa.O7frz.81176633
  Located on chromosome 17
  Distance between a terminus base of telomere on chromosomal short arm and 5'-terminus of this base sequence : 76762793
  Distance between 3'-terminus of neighbour sequence of sequence listing upward to telomere on chrosomal short arm and 5'-terminus of this base sequence : 83545
gcacaagaattgcttgaacctgggaggcggaggttgcagtgagctgagattgtaccacggcactccaacctgggtgacaggcggagactctgtctcaaaaacataaataaataaataaataaataaataaataaataaataataaaaataaagtagagaggaggtcttgctatgttgcccaaactggtctcgaactcctgacctcaagtgatccttcctccttggcctcccaaagtgctgggattacaggcatgagccactgcacccggccaagcatgttacttagaattatggaaggaaataatcaaagaaacaactataagtagtaaaagtagtcgcctctggggatcggaatcagggagcggctgggtattttttaaaattataattcatgaagaactgtctttgtaaccttgatacatc

SEQ ID NO: 23092 - DNA, 208 bp, Homo sapiens
  chr17.fa.O7frz.81719241
  Located on chromosome 17
  Distance between a terminus base of telomere on chromosomal short arm and 5'-terminus of this base sequence : 77083517
  Distance between 3'-terminus of neighbour sequence of sequence listing upward to telomere on chrosomal short arm and 5'-terminus of this base sequence : 320301
atacaatgtaaatggctgtgtaactagttgttagactgtgttgtttagggaataatgacaagcaaaaaagtctgacacgttcaacacagacacaatttaaaacacacacacacacacacacacacacacacaattggaggtgagttctggccatggattcagaaccacagatccagagggccggctgtactcgactcagtatgtctgg

SEQ ID NO: 23093 - DNA, 246 bp, Homo sapiens
  D17S1839
  Located on chromosome 17
  Distance between a terminus base of telomere on chromosomal short arm and 5'-terminus of this base sequence : 77295493
  Distance between 3'-terminus of neighbour sequence of sequence listing upward to telomere on chrosomal short arm and 5'-terminus of this base sequence : 211768
agcgagcccctgccttataaaaagaaaaatgtgtgtgtgtgtgtgtgtgtgtgtgtgtgtgtgtataatatatatgtatgtattatagaatcagaattaacaatgaacatttgtaatccattttgatgaaagggatcccccaactttgcaaattgttatcccctcaaaaagaaatctaaagtccgctgggcgtggtggctcacgcctgtaatcctagcactttgggagactgaggcgcttgaaccc

SEQ ID NO: 23094 - DNA, 226 bp, Homo sapiens
  D17S1603
  Located on chromosome 17
  Distance between a terminus base of telomere on chromosomal short arm and 5'-terminus of this base sequence : 77597526
  Distance between 3'-terminus of neighbour sequence of sequence listing upward to telomere on chrosomal short arm and 5'-terminus of this base sequence : 301787
gcttgaacttggaaggcagaggttgcaatgagccaagacagcgccactgcactccagcctaggtgagagtgagattcagtcacacatgcacatgcacacacacacacacacacacacacacacaaatttgtgaaatatttagtacactggtgagatcttttgtaaccattttcaatatctatcttgtcacaggacagggctaacctacaggaaaactgattgcctg

SEQ ID NO: 23095 - DNA, 411 bp, Homo sapiens
  AC015801.21_117665
  Located on chromosome 17
  Distance between a terminus base of telomere on chromosomal short arm and 5'-terminus of this base sequence : 77719516
  Distance between 3'-terminus of neighbour sequence of sequence listing upward to telomere on chrosomal short arm and 5'-terminus of this base sequence : 121764
gataacctgaggtcaggagtttgagaccagcctggccaaactggtgaaaccccatctctattacaaatacaaaaattagccaggcatggtagtgcacatttgtaatcacagctacttgggaggctgaggcaggagaattgcctgaacccaggaggcagaggttgcagtgagctgagatcgcaccactgtactccagcctgggtgacagaatgagactccgactcaaaataaataaataaataaataaataaataaataaataaataaaatctcaactctggtttgagaaaaataataatagtatgaaatatatcaatggaaatagttaagtttataagccaaacaaacatggaattcaaagccctggcaaggtctggttactctggctaggctatgtatttgcagatacag

SEQ ID NO: 23096 - DNA, 253 bp, Homo sapiens
  AC018665.3_73012
  Located on chromosome 17
  Distance between a terminus base of telomere on chromosomal short arm and 5'-terminus of this base sequence : 77719603
  Distance between 3'-terminus of neighbour sequence of sequence listing upward to telomere on chrosomal short arm and 5'-terminus of this base sequence : -324
ggtagtgcacatttgtaatcacagctacttgggaggctgaggcaggagaattgcctgaacccaggaggcagaggttgcagtgagctgagatcgcaccactgtactccagcctgggtgacagaatgagactccgactcaaaataaataaataaataaataaataaataaataaataaataaaatctcaactctggtttgagaaaaataataatagtatgaaatatatcaatggaaatagttaagtttataagcc

SEQ ID NO: 23097 - DNA, 431 bp, Homo sapiens
  AC015801.21_98885
  Located on chromosome 17
  Distance between a terminus base of telomere on chromosomal short arm and 5'-terminus of this base sequence : 77738306
  Distance between 3'-terminus of neighbour sequence of sequence listing upward to telomere on chrosomal short arm and 5'-terminus of this base sequence : 18450
cacgaggtcaagatattgagaccatcctggccaagatggtgaaaccccgtctctactaaaaatacaaaaactagctgagcgtggtggtgtgtgcctgtagtcccagctacttgggaggctgaagcagaagaattgcttgaacctgggaagcagaggttgcagtgagccaagatcgtgccactgcactctagcctggcgacggagcaagactccatctctaaataaataaataaataaataaataaataaataaataaaataataatgccagctgtgcagctctgattgcagggagcatgaggaagaagaaactgtgtcaatgcggcccagctacagaacacacgagaggatacagactattaggaactaggttaaaactcaactactttccttataaaatgagaggagcggtttgaactcctgcctacaaa

SEQ ID NO: 23098 - DNA, 268 bp, Homo sapiens
  D17S801
  Located on chromosome 17
  Distance between a terminus base of telomere on chromosomal short arm and 5'-terminus of this base sequence : 77860228
  Distance between 3'-terminus of neighbour sequence of sequence listing upward to telomere on chrosomal short arm and 5'-terminus of this base sequence : 121491
cctcaaaccggacaactatttggctgctttgaaatacagtttctactggaaaggcaggatagatgcttgatttttttgcctctctgggcctgatacacacacacacacacacacacacacacacacacacacacatatatatatatacacacacacatatatacacatatatatatatacacatatatatatacacacatatatatacacacatatatatacacatatatatatatatatttttaaagaggtaggatcttgctctctg

SEQ ID NO: 23099 - DNA, 197 bp, Homo sapiens
  D17S785
  Located on chromosome 17
  Distance between a terminus base of telomere on chromosomal short arm and 5'-terminus of this base sequence : 77935586
  Distance between 3'-terminus of neighbour sequence of sequence listing upward to telomere on chrosomal short arm and 5'-terminus of this base sequence : 75090
aaggccaacctgaaaactaaatcttaatctttgtgtgtgtgtgtgtgtgtgtgtgtgtgtgtgtgtgtgtatgtgtgtgtgtgtgtatctgtatatttaaacagataatatatgcaaatatcacaacattcaaaaggtttaaacaaatatgtagtgaaatgtttgtctccctcctaccattttcactctccagggat

SEQ ID NO: 23100 - DNA, 232 bp, Homo sapiens
  AC015802.18_55599
  Located on chromosome 17
  Distance between a terminus base of telomere on chromosomal short arm and 5'-terminus of this base sequence : 78127057
  Distance between 3'-terminus of neighbour sequence of sequence listing upward to telomere on chrosomal short arm and 5'-terminus of this base sequence : 191274
ctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatct

SEQ ID NO: 23101 - DNA, 378 bp, Homo sapiens
  chr17.fa.O7frz.82902559
  Located on chromosome 17
  Distance between a terminus base of telomere on chromosomal short arm and 5'-terminus of this base sequence : 78234632
  Distance between 3'-terminus of neighbour sequence of sequence listing upward to telomere on chrosomal short arm and 5'-terminus of this base sequence : 107343
cactcagcctgcactctacgtgctctggtaaagcccagctgaggtgcctggggcaggacttgaaagggcaagcacaggtgagggaaggtgtgactgtcagcccagtaccagacaccacggtgagatgtgaagctgggtgtgtacggaactgctggttttaccttaggcctgggacaatagggaatgtgaaaagcaagggtgtgtgtgtgtgtgtgtgtgtgtgtcttggcgccagctgcagtaccgccgtctgaaaccccctgaaaccctgggccaccctctgaatctgctgctcgagggcaagcctgggagcgtcagggggaggaaggtggagacacaggtgtcccagagggcagggactggtttcagctcatcttg

SEQ ID NO: 23102 - DNA, 168 bp, Homo sapiens
  DISO7_10004283
  Located on chromosome 17
  Distance between a terminus base of telomere on chromosomal short arm and 5'-terminus of this base sequence : 78537337
  Distance between 3'-terminus of neighbour sequence of sequence listing upward to telomere on chrosomal short arm and 5'-terminus of this base sequence : 302327
aaagaatccgaattcagatctctctctcctctctcccctctctcccctctctcccctctctctcctctctctcctctctctcctctctctcctctctcccctctctcccctctctcccctctctctcctctctcatccacccctaagggctaggagggtggaagataa

SEQ ID NO: 23103 - DNA, 366 bp, Homo sapiens
  chr17.fa.O7frz.83366627
  Located on chromosome 17
  Distance between a terminus base of telomere on chromosomal short arm and 5'-terminus of this base sequence : 78735887
  Distance between 3'-terminus of neighbour sequence of sequence listing upward to telomere on chrosomal short arm and 5'-terminus of this base sequence : 198382
gtcagaaagatagaacctgctccatttgcagaacagcaaggaaggaaggagagagaaagaaagaaagagagagagagaaagaaaggaatgaaggaaggaaggaaagaagaaggaaggaaggaaggaaagaagaaggaaggaaggaaggaaagaagaaggaaggaaggaaggaaagaagaaggaaggaaggaaggaaagaaggaaggagaaaagaaaaaagaaggagaagggaaagaaaggggagagaaggggaagggaagatagaaccactccatcaaggtggatctcaagagccatctgaagaaagcctaacaagaagaggacccagaatctttttttttttctattctgtgagaagtgctttct

SEQ ID NO: 23104 - DNA, 262 bp, Homo sapiens
  DISO7_00029931
  Located on chromosome 17
  Distance between a terminus base of telomere on chromosomal short arm and 5'-terminus of this base sequence : 78872679
  Distance between 3'-terminus of neighbour sequence of sequence listing upward to telomere on chrosomal short arm and 5'-terminus of this base sequence : 136426
cacgtcagacccattagctttctaatcaccacaccagctgtgtgagttgggggttgggtactgccctcccctttcataggagtgggcactgagaattggggaaattacacaactggtcataagcactcaattaggaggaggaggaggaggaggaacagagtgtttgaaagacaatttttaaaaattggatagcacagtagcctggggacatttgcgaaggagtaagatggcggcgtgtgcgttgataaccgttcaaggtgcc

SEQ ID NO: 23105 - DNA, 294 bp, Homo sapiens
  AC034138.3_131504
  Located on chromosome 17
  Distance between a terminus base of telomere on chromosomal short arm and 5'-terminus of this base sequence : 78936339
  Distance between 3'-terminus of neighbour sequence of sequence listing upward to telomere on chrosomal short arm and 5'-terminus of this base sequence : 63398
acatggtgaaactcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctccta

SEQ ID NO: 23106 - DNA, 221 bp, Homo sapiens
  chr17.fa.O7frz.83775077
  Located on chromosome 17
  Distance between a terminus base of telomere on chromosomal short arm and 5'-terminus of this base sequence : 78978401
  Distance between 3'-terminus of neighbour sequence of sequence listing upward to telomere on chrosomal short arm and 5'-terminus of this base sequence : 41768
aatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattga

SEQ ID NO: 23107 - DNA, 154 bp, Homo sapiens
  DISD22_0010983
  Located on chromosome 17
  Distance between a terminus base of telomere on chromosomal short arm and 5'-terminus of this base sequence : 79153786
  Distance between 3'-terminus of neighbour sequence of sequence listing upward to telomere on chrosomal short arm and 5'-terminus of this base sequence : 175164
tttctcacttgccgagtgcgggcagccgctgcgcaccttcacaccgtttccttggaaaccaaattgctttggcagcattccacggacacacacacacacacacactctcatgcacatgtgtgccccacgagaaaatcaagtgctatgggagctg

SEQ ID NO: 23108 - DNA, 165 bp, Homo sapiens
  DISD22_0010989
  Located on chromosome 17
  Distance between a terminus base of telomere on chromosomal short arm and 5'-terminus of this base sequence : 79272266
  Distance between 3'-terminus of neighbour sequence of sequence listing upward to telomere on chrosomal short arm and 5'-terminus of this base sequence : 118326
ggtcaggacaacaatggtagtgacgacgatgatgatgatggtgacgacgatgatgatgatggtgacgacgatgatgatgatgatggtgacgacgatgatgatgatgatgatgacgatgatgacgatgatgatgatgatgatgatggcggcactaagatttattga

SEQ ID NO: 23109 - DNA, 333 bp, Homo sapiens
  chr17.fa.O7frz.84292817
  Located on chromosome 17
  Distance between a terminus base of telomere on chromosomal short arm and 5'-terminus of this base sequence : 79355941
  Distance between 3'-terminus of neighbour sequence of sequence listing upward to telomere on chrosomal short arm and 5'-terminus of this base sequence : 83510
cttaggtcaactgtccaagaggccagagtcagagcaggctcaaaaggagttagaagactaacttctaagtcaggactctacttggatactattaccttctagaagacatccctgatgatgatgatgatgatgatgatgatgatgatgatgatgatgggggcttgtataagcttcatgttgtgcaggttcgtaatagataataaagttggagaggggatgaagaaccaggctaaagaggatcttggttgtcaaggtcagaagtttccacttttctcaggagcagtgggaccccacatgtcttcagcaggaagtatgtagtggattgaataatgg

SEQ ID NO: 23110 - DNA, 376 bp, Homo sapiens
  chr17.fa.O7frz.84200739
  Located on chromosome 17
  Distance between a terminus base of telomere on chromosomal short arm and 5'-terminus of this base sequence : 79383999
  Distance between 3'-terminus of neighbour sequence of sequence listing upward to telomere on chrosomal short arm and 5'-terminus of this base sequence : 27725
aagcctaattacctcttaaatgacccttgtcttgctcacattagcaacacctgaattttggaggaggtgcagtcaagccatagcagcattctttttttcttcctgagcttctctcttttttttttttttttttgagatggagtcttgctttgtctcccaggctggagtgcagtggtgaaatcttggctcactgcaacttccacctcccaggttcaagcgattctcctgtatcagcctcctgagtagctgggattacaggcatgcaccaccacgcccagctaatttgtgtgtgtgtgtgtgtgtgtgtgtgtgtgtttagtagagatggggttgcactatgttggtcagactggtcttgaactcctgacctcgtgat

SEQ ID NO: 23111 - DNA, 375 bp, Homo sapiens
  chr17.fa.O7frz.84919028
  Located on chromosome 17
  Distance between a terminus base of telomere on chromosomal short arm and 5'-terminus of this base sequence : 79495540
  Distance between 3'-terminus of neighbour sequence of sequence listing upward to telomere on chrosomal short arm and 5'-terminus of this base sequence : 111165
tgctttgttctgccactacacggccacatggccttggacagtgctgcaaccttgcaaccccccaacctcctccgcatcgacaacagaaagccaccacacatgtgcacatacacacacacacacacaccagtgcatgcacatatgcacaccaatgtgcacatgcacctgcagacatgaacacacacacgtgcctgcaagcacacacacacacacacacaaacacaaagaggcgcccactctctagtcacaactctcctctctcctctctggagcctgtccctgctgtctggcccatcctctggcaccccactcacctctactgatccatgcatctctttcttcacacacacgaaagcttgtatctgaaatgttcac

SEQ ID NO: 23112 - DNA, 124 bp, Homo sapiens
  HUMUT952
  Located on chromosome 17
  Distance between a terminus base of telomere on chromosomal short arm and 5'-terminus of this base sequence : 79829811
  Distance between 3'-terminus of neighbour sequence of sequence listing upward to telomere on chrosomal short arm and 5'-terminus of this base sequence : 333896
acacagggcgaggctctgtcgaaagaaagaaagagagagagagagagagaaagaaagaaagaaagaaagaaaggctttgtagagtgttcaattcagctcattttttgcccttccatcccttctg

SEQ ID NO: 23113 - DNA, 178 bp, Homo sapiens
  D17S802
  Located on chromosome 17
  Distance between a terminus base of telomere on chromosomal short arm and 5'-terminus of this base sequence : 79885497
  Distance between 3'-terminus of neighbour sequence of sequence listing upward to telomere on chrosomal short arm and 5'-terminus of this base sequence : 55562
gccacctgcccctcaacatggttcccactcacataactgccccccacacactctgtaccctccatggcccccagcacacacatgcacatgcacacctacacgaacacatttgcacacattcacacacacacacacacacacacacacacacacacagagccatggcctctgctggcag

SEQ ID NO: 23114 - DNA, 411 bp, Homo sapiens
  U75285.1_6452
  Located on chromosome 17
  Distance between a terminus base of telomere on chromosomal short arm and 5'-terminus of this base sequence : 79905945
  Distance between 3'-terminus of neighbour sequence of sequence listing upward to telomere on chrosomal short arm and 5'-terminus of this base sequence : 20270
acatttcaacttcagataaatgactaagtttctagtaaatactgacacaaaatgtgggatttacttataccggtatatacttataccggccacactccaggagctttaaaatcacacagacatcctaggggctttaaaaatgattcctagctgggcacggtggctcatgcctgtaatctcagcactttgggaggcccaggcaaaaggatcccttgagctcaggagttcaagaccagcctggacaacacagggaaccctcatctctatgaaaataaataaataaataaataaataaataaataaggtgggcatggtggggtgcgcctgtagtcccaattacttgggaggatgaggtgggaggatcacttgagctcaggagttcgaggctgcagtgagctatggtgtaccact

SEQ ID NO: 23115 - DNA, 281 bp, Homo sapiens
  chr17.fa.O7frz.85228561
  Located on chromosome 17
  Distance between a terminus base of telomere on chromosomal short arm and 5'-terminus of this base sequence : 80089647
  Distance between 3'-terminus of neighbour sequence of sequence listing upward to telomere on chrosomal short arm and 5'-terminus of this base sequence : 183291
aggactggaccatcttaattacagcaggctggagagatcacagatggtgctgcctttcaagttctctttggtttgtgaaacctacttgatgtcttttaagcctaagacaaagaccaaaaggaaagggagggaaggaaggagggagggaaggagggagggaaggagggagggaaggagggagggaaggagggaaagagggagggatatgtccaagtacagggcacacacagcccctcaccttggggttggcctccaggtagttgtagagcacgttgatggag

SEQ ID NO: 23116 - DNA, 101 bp, Homo sapiens
  DISO7_10004291
  Located on chromosome 17
  Distance between a terminus base of telomere on chromosomal short arm and 5'-terminus of this base sequence : 80418169
  Distance between 3'-terminus of neighbour sequence of sequence listing upward to telomere on chrosomal short arm and 5'-terminus of this base sequence : 328241
gctaattcatttattgcgtgggtgtgtgtgtgtgtgtccgtttgtgtgtgtgtgtgtgtgtgtccgtgtgtgtataaccagtttgtatgtgagaattagtg

SEQ ID NO: 23117 - DNA, 143 bp, Homo sapiens
  DISD22_0010998
  Located on chromosome 17
  Distance between a terminus base of telomere on chromosomal short arm and 5'-terminus of this base sequence : 80536794
  Distance between 3'-terminus of neighbour sequence of sequence listing upward to telomere on chrosomal short arm and 5'-terminus of this base sequence : 118524
aggcagagcttaaggttaagagagaaggagcgtgtgtgtgtgtgtgtgtgtgtgtgtgtgtgtgtgtgtgtgtgtgtgtgtattcagtgtttatgaaacttccaggtctgtaaaggggtgtggccgtgattagcaggagggca

SEQ ID NO: 23118 - DNA, 183 bp, Homo sapiens
  DISD22_0011002
  Located on chromosome 17
  Distance between a terminus base of telomere on chromosomal short arm and 5'-terminus of this base sequence : 80655080
  Distance between 3'-terminus of neighbour sequence of sequence listing upward to telomere on chrosomal short arm and 5'-terminus of this base sequence : 118143
gtctgctggaagcagctctgggtgcagagtgagctgggctgcacgtgtcaacagctggccacacacacacacacacacacacacacacacacacagagacacgccacgccgcgcacctccccgccccgccccttccaccccacagcctgagggaggaggctggggcagagcaggcactgtttc

SEQ ID NO: 23119 - DNA, 251 bp, Homo sapiens
  chr17.fa.O7frz.85945550
  Located on chromosome 17
  Distance between a terminus base of telomere on chromosomal short arm and 5'-terminus of this base sequence : 80811092
  Distance between 3'-terminus of neighbour sequence of sequence listing upward to telomere on chrosomal short arm and 5'-terminus of this base sequence : 155829
tagacctggtgctgttgagtgcaggggccacgggccacatgtgggcattcagagctaaaacacggccggttctaattgagacactccctgtgtgtgtgggtgtgtgtgtgtgtgtgtgtgtgtgtgaaatgcacatgggattttgatgacttgggaccataaaaagagtgaaaaaatagtttgtatctagattacatgtcaaaatgatcatattcaggtatattgggttacataaagcgtataattgagtg

SEQ ID NO: 23120 - DNA, 204 bp, Homo sapiens
  D17S836
  Located on chromosome 17
  Distance between a terminus base of telomere on chromosomal short arm and 5'-terminus of this base sequence : 80920194
  Distance between 3'-terminus of neighbour sequence of sequence listing upward to telomere on chrosomal short arm and 5'-terminus of this base sequence : 108851
agcttccacacactaggtgcacgtacgtgtgtgtatgtacctgcgtgtgcggtacacagtgtgcatgtgtttgtatgcatgtgtgcatgtctgcctgtgtgtgtgtgtgtgtgtgtgtgtgtgcatgtgtgtacttggccacacatgcatctggaggacctgggaaagacctccatgagggaaggaacatgaagccagatgcac

SEQ ID NO: 23121 - DNA, 113 bp, Homo sapiens
  D17S1806
  Located on chromosome 17
  Distance between a terminus base of telomere on chromosomal short arm and 5'-terminus of this base sequence : 81303026
  Distance between 3'-terminus of neighbour sequence of sequence listing upward to telomere on chrosomal short arm and 5'-terminus of this base sequence : 382628
tgtaacgtccaccagcagagatgctccattgggtctacgggtggccagactcaaagtgtgtgtgtgtgtgtgtgtgtgtgtgtttatgtgtgcaggtttcaaataagcacatc

SEQ ID NO: 23122 - DNA, 129 bp, Homo sapiens
  D17S1822
  Located on chromosome 17
  Distance between a terminus base of telomere on chromosomal short arm and 5'-terminus of this base sequence : 81378832
  Distance between 3'-terminus of neighbour sequence of sequence listing upward to telomere on chrosomal short arm and 5'-terminus of this base sequence : 75693
aaccgagcctaggactcctttctcatcttggaaaaacagcaagtgtgtgtgtgtgtgtgtgtgtgtgtgtgtgtgtgtagtatggagtcctgctttcctgggatcctgtgggtccattacagatgcctg

SEQ ID NO: 23123 - DNA, 106 bp, Homo sapiens
  D17S1830
  Located on chromosome 17
  Distance between a terminus base of telomere on chromosomal short arm and 5'-terminus of this base sequence : 81408566
  Distance between 3'-terminus of neighbour sequence of sequence listing upward to telomere on chrosomal short arm and 5'-terminus of this base sequence : 29605
atttgcccatctgctttgtcattggtgctctctctattctgtgtgtgtgtgtgtgtgtgtgtgtgtgtgtgtgtgtgtttgtgtttgttttgagatggagtctccc

SEQ ID NO: 23124 - DNA, 230 bp, Homo sapiens
  D17S784
  Located on chromosome 17
  Distance between a terminus base of telomere on chromosomal short arm and 5'-terminus of this base sequence : 81414698
  Distance between 3'-terminus of neighbour sequence of sequence listing upward to telomere on chrosomal short arm and 5'-terminus of this base sequence : 6026
gagtctcctaaatgctggggctcctgggggcagccctgggccctgggtttgtgggtgatgttaacggcttgcagagcaggaactggcttctctgcctgaaagccccagtctctctctctctctctctctctcacacacacacacacacacacacacacacacacacacagttctatacagacacaaggcattggattctgaggtttctatttaagaactgtgcaggagct

SEQ ID NO: 23125 - DNA, 297 bp, Homo sapiens
  chr17.fa.O7frz.86605418
  Located on chromosome 17
  Distance between a terminus base of telomere on chromosomal short arm and 5'-terminus of this base sequence : 81709912
  Distance between 3'-terminus of neighbour sequence of sequence listing upward to telomere on chrosomal short arm and 5'-terminus of this base sequence : 294984
acatttcaatcatgtagaatatgataccatttttataaaatggtgttagtttatctctgggagtccctcaatctatgtgcccatccatccattcatccaatctgccgatcagtctgtcctgtcattccgcgcgcgcgcgcgcgcgtgtgtgtgtgtgtgtgtgtgtgtgtgcatgagagagaaagagagggggagagaaatggagaggcagagagcagagggattctggaacactcctcaccaatgctaatgcttgctgttcatggtggtagattgtaaagaaatctgtttaggcct

SEQ ID NO: 23126 - DNA, 116 bp, Homo sapiens
  DISD22_0011021
  Located on chromosome 17
  Distance between a terminus base of telomere on chromosomal short arm and 5'-terminus of this base sequence : 81832257
  Distance between 3'-terminus of neighbour sequence of sequence listing upward to telomere on chrosomal short arm and 5'-terminus of this base sequence : 122048
ctgactttctcagctcctacagttatatatccctgttctctctctctctgtctctctgtttcttccccacccccatctccctccctccccctgtatgccagaggttggcaaacgtt

SEQ ID NO: 23127 - DNA, 155 bp, Homo sapiens
  DISO7_10000179
  Located on chromosome 17
  Distance between a terminus base of telomere on chromosomal short arm and 5'-terminus of this base sequence : 81923889
  Distance between 3'-terminus of neighbour sequence of sequence listing upward to telomere on chrosomal short arm and 5'-terminus of this base sequence : 91516
aacagagtctgccaaggtgcgcacacccacagacgtgtgtgtgtgtacgtgtgtgtacgtgtgtgtgtacgtgtgtgcgtgtgtgtgtgtgcgcgcgtgtgtgtgtacgtgtgtgtgtgtgtgtgtgtgtgtgtgtagccactcatcccagacat

SEQ ID NO: 23128 - DNA, 101 bp, Homo sapiens
  DISD22_0011023
  Located on chromosome 17
  Distance between a terminus base of telomere on chromosomal short arm and 5'-terminus of this base sequence : 82093745
  Distance between 3'-terminus of neighbour sequence of sequence listing upward to telomere on chrosomal short arm and 5'-terminus of this base sequence : 169701
tgttctgcttccctgtcacgggggtccagggtgtgtgtgtgtgtgtgtgtgtgtgtgcaccatacagacaatcctgcgcctgcatctccttctcctgcatg

SEQ ID NO: 23129 - DNA, 415 bp, Homo sapiens
  chr8.fa.O7frz.32477653
  Located on chromosome 17
  Distance between a terminus base of telomere on chromosomal short arm and 5'-terminus of this base sequence : 82342874
  Distance between 3'-terminus of neighbour sequence of sequence listing upward to telomere on chrosomal short arm and 5'-terminus of this base sequence : 249028
ctgacttgaatttatgaagcacatgcaagatcgctctggagaattaaactgttgggctcatgatcaattagtttttatgcttatttctcacacacacacacacacacacacacacacacacaacgctcataagtgtaatcctttatgactattgattatagttctctcccattgctgagttgctactatttatacaactcctattagtagtaacagtgacaataatgtgatttgtttttagtctagacattatatttgaagacgtttggtttctttctgttctgtggctgtcctaacaagcaggtttgggcaaattctaaaatggtattaaaacaaaggaaaaatatttctgttcatcaatgggagaaaccctaacaacacaaatatttttaaaagagcgattaacgtatgccta

SEQ ID NO: 23130 - DNA, 404 bp, Homo sapiens
  chr8.fa.O7frz.32358613
  Located on chromosome 17
  Distance between a terminus base of telomere on chromosomal short arm and 5'-terminus of this base sequence : 82513823
  Distance between 3'-terminus of neighbour sequence of sequence listing upward to telomere on chrosomal short arm and 5'-terminus of this base sequence : 170534
tttgtacagcctttgagttaagagtggattttacatttcttaaggattgtaaaacacacacacacacacacacacacacacacacacacacacaccgaaaaggaggaggaatggaggagggagaaggagaagagcaagagcaaggtggccagaggccgtatgtggctcatggagcctgatatttactgtttgattttttatttttatttttttttgagacagagtctcactttgtcacccaggctggaatgcagtggtgtgatctcagctcactgcagcctctgcctcccaggttcaagcgattctcctgcctcagcctcctgagtagctggtactacaggcagctgccaccgcgcccagctaatttttttttgtatttttggtagagaaggagtttcaccaag

SEQ ID NO: 23131 - DNA, 363 bp, Homo sapiens
  AC023493.6_155401
  Located on chromosome 17
  Distance between a terminus base of telomere on chromosomal short arm and 5'-terminus of this base sequence : 82601876
  Distance between 3'-terminus of neighbour sequence of sequence listing upward to telomere on chrosomal short arm and 5'-terminus of this base sequence : 87649
gattagtaatttgctcacggttgtcctgtagagctggaatttgaacctatgcagttcaagtccagagactgtttttttttttttttaaattgtggtaaaacatacacaacacaaaataccattctaggaattattattattattattattattatttttcattctaggaattattaagtgtacaattgaacgacatgaaataattcataatgttgtgcaagcatcctcactgtccatctctagaaccttttcaccatcccaaacagaaactctgtctccattacacaactcctcattcctgccttcccctagcccctagtaaccgccattccaccatctgtctctatgaatttgtcattctgg

SEQ ID NO: 23132 - DNA, 465 bp, Homo sapiens
  AC023493.6_58921
  Located on chromosome 17
  Distance between a terminus base of telomere on chromosomal short arm and 5'-terminus of this base sequence : 82667894
  Distance between 3'-terminus of neighbour sequence of sequence listing upward to telomere on chrosomal short arm and 5'-terminus of this base sequence : 65655
ggagtacagtagcagaatcatagttcactgcagcctcaacctcctgggctcaagctatcctcccacctcagcctctcaagtagccaagactataggtgcacgccaccatgtctggctacgttatgttatgttatgttatgttatgttatgttatgttatgttatgttatttttttgagatggagtcttactctgttatccaggctggagcgcagtggcatgatctcggctcaccgcaacctccacctcccaggttcaagcgattctcctgcctcagcctcccaagtagctgggattacaggcgcatgccaccatgcccagctaattttgtattttcagtagagatggggtttctccatgttggtcaggctggtcttgaactcctgacctcaggtgatccacctgccttggcctcccaaagtgctaggattacaggcgtgagccaccgtgcctggcctaatttatt

SEQ ID NO: 23133 - DNA, 149 bp, Homo sapiens
  D17S928
  Located on chromosome 17
  Distance between a terminus base of telomere on chromosomal short arm and 5'-terminus of this base sequence : 82876387
  Distance between 3'-terminus of neighbour sequence of sequence listing upward to telomere on chrosomal short arm and 5'-terminus of this base sequence : 208028
taaaacggctacaacacatacacacacacacacacacacacacacacacacacacacacacacgctggcattaccaagtgctgtgaggatgtggaggaaatggaagactcagactccactactaatatggaagcagccagtggggaaat

SEQ ID NO: 23134 - DNA, 379 bp, Homo sapiens
  chr17.fa.O7frz.88828791
  Located on chromosome 17
  Distance between a terminus base of telomere on chromosomal short arm and 5'-terminus of this base sequence : 83189346
  Distance between 3'-terminus of neighbour sequence of sequence listing upward to telomere on chrosomal short arm and 5'-terminus of this base sequence : 312810
acattgaaacatctggaatctataagccccggggctcactgagagtggacctgtgttctgtgtgtatgtgtggggggtgctcactgagaatggacctgtgtgtgtgtgtgtgtgtgtgtgtgtgtgtggcggggggcggggggcatccctgagggcaaaccacaaagtagcctaacccagccatgaaatgaactcctgggcaaaggaagtcaaccttcgtgaatctccacatacccaaggaaaggtggctctggccacatcactcccaagctgccactttctaagcgtcctgggctgccaggccagacacccaacagggccactccctttgctaacttcacacaacgctgagaccccacttcaggtagcgacaacttta

SEQ ID NO: 23135 - DNA, 129 bp, Homo sapiens
  DISO7_10004298
  Located on chromosome 17
  Distance between a terminus base of telomere on chromosomal short arm and 5'-terminus of this base sequence : 83304755
  Distance between 3'-terminus of neighbour sequence of sequence listing upward to telomere on chrosomal short arm and 5'-terminus of this base sequence : 115030
acatgggtagaagttattatctggttgtgtgtgtgtgtgtgtgtgtgtgtgtgtgtgtgtgtgtgagagagagagagagagagagagagagtgtgtgtgtgtatgtatatagtttgaagcacagcctca

SEQ ID NO: 23136 - DNA, 291 bp, Homo sapiens
  chr17.fa.O7frz.88408600
  Located on chromosome 17
  Distance between a terminus base of telomere on chromosomal short arm and 5'-terminus of this base sequence : 83645095
  Distance between 3'-terminus of neighbour sequence of sequence listing upward to telomere on chrosomal short arm and 5'-terminus of this base sequence : 340211
caaatatgcagctagagctaatagaaaaacagttaaaacaatttgttgtaatggtgagatatttataaggaaacatttataaaagatcttctgtaagacagcttagacttgaaaatacatatcagtcttagagtcattcaggtgtttttacaaccaaaagtagaagcaccttttaatattcatgcttaatatttataaaaactgaattggagggttttttgtttgtttgtttgtttgtttttttgagaagcagcagctgcatttgtaaaaatgtgaaagtgccagttcaga

SEQ ID NO: 23137 - DNA, 252 bp, Homo sapiens
  chr17.fa.O7frz.88520913
  Located on chromosome 17
  Distance between a terminus base of telomere on chromosomal short arm and 5'-terminus of this base sequence : 83763193
  Distance between 3'-terminus of neighbour sequence of sequence listing upward to telomere on chrosomal short arm and 5'-terminus of this base sequence : 117807
tcaataaagtgtcataaggcacggttgaaggagaaaaacttgacccaatggacagttacagaacccaagtgtgtgtgtgtgtgtgtgtgtgtgtgtgtgtgtacacagaaattttaaaaatgtttttaaaaacatctctttaaaagaaataatgaaaattataaaatatataatgaaagataaaagttaatcaaaacagatagaattcacctaaagtggtgcttaagcgattctgaagtcgtgaattataca

SEQ ID NO: 23138 - DNA, 289 bp, Homo sapiens
  AP001005.3_81195
  Located on chromosome 18
  Distance between a terminus base of telomere on chromosomal short arm and 5'-terminus of this base sequence : 52143
  Distance between 3'-terminus of neighbour sequence of sequence listing upward to telomere on chrosomal short arm and 5'-terminus of this base sequence : 0
taattcttaaggtggcagtactacacaaagccacctacagattctttgtggatcctgttacaatccccacgtccttttggcagaaatcaacaggctgatcctgtcatttatatgaaatttcaagggatgcagaatagccaaaatagtgtcaaaacaacaacaacaacaactcaggctcacatttcccaatttcaaatcttactacaaagcaacagtaataaaatcaacatgattctggtacaatcatttgaataaatcaatagaactgaattttgagttcagaaataaa

SEQ ID NO: 23139 - DNA, 423 bp, Homo sapiens
  chr18.fa.O7frz.283977
  Located on chromosome 18
  Distance between a terminus base of telomere on chromosomal short arm and 5'-terminus of this base sequence : 71418
  Distance between 3'-terminus of neighbour sequence of sequence listing upward to telomere on chrosomal short arm and 5'-terminus of this base sequence : 18986
tttagatcactccactttcctaacccctaaacatcccgaagcctcattttcatggaggtggacttgagagctgttctcccacctccttgctcggtgcccttgtgaataaatcttttctcctttgcaaaatccatcttcactgtgattgatttactgtatgcaggcagaatggatctggacttggccaggaacacacacacacacacagacacgcacacacacacacacacacacacacacacacacacttgcagatggactgaaaaatgagataaaaattccccatagaccaaaaatagaagcaggcagaggtgacaagttttgctcttgtaggataacagattaaaatgctcagcatggctgggcacagtggctcacgcctctaatcccagcactttgggaggctgaggtggaaggatcatt

SEQ ID NO: 23140 - DNA, 450 bp, Homo sapiens
  AP000845.3_135538
  Located on chromosome 18
  Distance between a terminus base of telomere on chromosomal short arm and 5'-terminus of this base sequence : 154266
  Distance between 3'-terminus of neighbour sequence of sequence listing upward to telomere on chrosomal short arm and 5'-terminus of this base sequence : 82425
tcttcaataagcaactgaatctggctgggcacagtggctaacccctgtaatcccagcattttgggaggccaaggtgggcagatcacttgaggtgaggagtttgagagcagtctgaccaacatggagaaaccccatctctactaaaaatacaaaattagccaggagtggtgtcacatgcctgtaatcccagctactcaggagactgaggcaggagaatcacttgaacccgggagacagagtttgcggagagccgagatcacaccattgcactccagcctgggcaacaagagcgaaaactctgtctcataaataaataaataaataaataaataaataaataaataaataagcaacttaatcttgaggcacctttgccatagcagcatagcattcacctaatataatttgcatcatctgttgacccaaaactaggttatgaattcatttagg

SEQ ID NO: 23141 - DNA, 440 bp, Homo sapiens
  AC016128.4_83132
  Located on chromosome 18
  Distance between a terminus base of telomere on chromosomal short arm and 5'-terminus of this base sequence : 212865
  Distance between 3'-terminus of neighbour sequence of sequence listing upward to telomere on chrosomal short arm and 5'-terminus of this base sequence : 58149
tcagttgaatgtcacaagaatccctgaagtgattaaaagtcttgagaggtcaggcaatttttgtaaggctagaaggaaaagtgaggttttagacttcatttcttttaaagttggcaaacaaacattttctgtaatggacaagatagatagattagatagatagatagatagatagatgatgattgattgatgattgatagtaaattatttcaggctttgcaggctataaagtgctgcagctccttagctttgctgttgttatagtgtagctggagccatagacagttagttagttagttatgagtgagcacagctgggtgccagtacaattttaatgatcaagactcgtggcaggcagaacaaaccatcatttgttgatcctctgcttgaaagcacgaataagtgagaacagagcagtcatatggtttcagaaagtgtta

SEQ ID NO: 23142 - DNA, 360 bp, Homo sapiens
  AC016128.4_140772
  Located on chromosome 18
  Distance between a terminus base of telomere on chromosomal short arm and 5'-terminus of this base sequence : 321074
  Distance between 3'-terminus of neighbour sequence of sequence listing upward to telomere on chrosomal short arm and 5'-terminus of this base sequence : 107769
taccatgaaccaaactcactaggctggttcatcagaatgcagagggagcgaatcttgctttgggacagttagatgaataactttctaatgtgtactggaatgctgacttctgggcatgagtgtatatatgtgtgtgaatatctattcattataaggacatgatacacacacacacacacacacacacgcacacatgatcttgtgagaacccagagggaccttgtacatttcaatatcttgcctctaacaagtccaagagccaggaagagaaagtgaaagacttttgatatacatttacaagaacctacaattacaaataactggttatgattgtctgggtgagttgtagaaggttgattg

SEQ ID NO: 23143 - DNA, 173 bp, Homo sapiens
  G09214
  Located on chromosome 18
  Distance between a terminus base of telomere on chromosomal short arm and 5'-terminus of this base sequence : 354003
  Distance between 3'-terminus of neighbour sequence of sequence listing upward to telomere on chrosomal short arm and 5'-terminus of this base sequence : 32569
agattggcttagaggtccctgagcatctgctgtttgccttcctggaaggcagccctaatgcacaatccatcaatccatccatgcatccatccatccatccatccatccatccatccatccatccatcctcccattaattcattcagtgaactttcctgggcaatggttaaata

SEQ ID NO: 23144 - DNA, 468 bp, Homo sapiens
  chr18.fa.O7frz.941566
  Located on chromosome 18
  Distance between a terminus base of telomere on chromosomal short arm and 5'-terminus of this base sequence : 613309
  Distance between 3'-terminus of neighbour sequence of sequence listing upward to telomere on chrosomal short arm and 5'-terminus of this base sequence : 259133
gcaatagtttgtggtttatgagtttatatggtccatttcatctgaggtataaaatttatttgtgtagtattgttggtagtattcccttgttatcttttttatgttcacatggtatatggtgacagtcctggtttaattcctagtattagtaactggctctctctctctctctctctctctctctctctggtcagtctttccagaggtttgtcaattttgttgacttttttcccccaaagaatcagctctttgtttcatggattttctgcttttctgttttcaacttcattgatttctgctgtttattatttctctccttctgttggttgtgagtttgttttgcttttctttttctacatattcgatgtgaaatcttacattattcactcgggacttttcttcttttttgatgtatgcatttagtattctaaatttacttcttagtactgcatactgcttgaactatgt

SEQ ID NO: 23145 - DNA, 268 bp, Homo sapiens
  D18S1140
  Located on chromosome 18
  Distance between a terminus base of telomere on chromosomal short arm and 5'-terminus of this base sequence : 646349
  Distance between 3'-terminus of neighbour sequence of sequence listing upward to telomere on chrosomal short arm and 5'-terminus of this base sequence : 32572
gggcagggatcatatcttatttgtcttcacttatgcattggtggcatccagtaaatgtttaccaaattgcatttggaatcatagcattgcagtctctgatttcaatccacattaatttttccttctggaggccaaatatttaaagatactctctgcctcccaaatcttaccttcaacatgcttgcctccttatgcataacacacacacacacacacacacacacacacacacaccccttcatgtccccttttgccctacccatgtatg

SEQ ID NO: 23146 - DNA, 155 bp, Homo sapiens
  D18S59
  Located on chromosome 18
  Distance between a terminus base of telomere on chromosomal short arm and 5'-terminus of this base sequence : 691386
  Distance between 3'-terminus of neighbour sequence of sequence listing upward to telomere on chrosomal short arm and 5'-terminus of this base sequence : 44769
gcttcctatccaacaggggcacaagacagatagatagacacacacacacacacacacacacacacacacacacacactataaagcaaggcaagatttagagagtgcacaggagtgggctctgggagttcaggggagggtcgttcacattctggta

SEQ ID NO: 23147 - DNA, 365 bp, Homo sapiens
  chr18.fa.O7frz.1073448
  Located on chromosome 18
  Distance between a terminus base of telomere on chromosomal short arm and 5'-terminus of this base sequence : 775147
  Distance between 3'-terminus of neighbour sequence of sequence listing upward to telomere on chrosomal short arm and 5'-terminus of this base sequence : 83606
agtcagatcaccatgtacgtctggatgactttttattttgtcctctctcctctccatttttacaaatgttgcccaccagtccaggtgagaccaaggcctctctcaccctggttgtaacagtaatgcagccactgtggaatcactttccttcaagctccctgggcaaatgatgaggttcttatttatttacttatatttcatttatttatttatttatttttttagtgatgaggtcttgctatgttgcccaggctggtctcgaactcctgggcttaagggatcctcctgtcttggcctcccaaagtgttgggattacagctgtgagactctatgccaggcaggaattcatttcgtcatgactaaac

SEQ ID NO: 23148 - DNA, 457 bp, Homo sapiens
  AP000931.3_2675
  Located on chromosome 18
  Distance between a terminus base of telomere on chromosomal short arm and 5'-terminus of this base sequence : 806678
  Distance between 3'-terminus of neighbour sequence of sequence listing upward to telomere on chrosomal short arm and 5'-terminus of this base sequence : 31166
gacttgctgaagttcatgtaagattgccatgtttgacatttattaattgcaagacacatttgattgacaaatattcattgcaggatatgtccttctatatccatttatttatttatttatttatttattttgagacgaagttttgctctttcacccaggctggagtgaagtggcatgatctcagctcactgcaacctctgcccccggggttcaagcaattctcctgcctcagcctcccgagtggctgggattacagacgcatgccaccatgcctggctaatttttgtattttttttttttcagtagagacagggtttcaacatgttggccaggctggtctcaaactcttgacctcaggtgatccacccacctcagcatcccaaagtgctaggattacaagctaagccaccgcgcctggccctcaatatacatttacttaggtcgcttagacagtctt

SEQ ID NO: 23149 - DNA, 133 bp, Homo sapiens
  DISO7_10004299
  Located on chromosome 18
  Distance between a terminus base of telomere on chromosomal short arm and 5'-terminus of this base sequence : 863267
  Distance between 3'-terminus of neighbour sequence of sequence listing upward to telomere on chrosomal short arm and 5'-terminus of this base sequence : 56132
ggtgaattcataaatatggaattcaaaataatgaggagcaactctgtgtgtgtgtgtgtgtgtgtgtgtgtgtgtgtgtgtgtgtatggacttattaatgatgatgtttatagtaatgaatgttgcaaagtgc

SEQ ID NO: 23150 - DNA, 423 bp, Homo sapiens
  chr18.fa.O7frz.1421675
  Located on chromosome 18
  Distance between a terminus base of telomere on chromosomal short arm and 5'-terminus of this base sequence : 1136099
  Distance between 3'-terminus of neighbour sequence of sequence listing upward to telomere on chrosomal short arm and 5'-terminus of this base sequence : 272699
atagcaaactcagtacaccttagtgggtaaattactctcatcaagtcacctcttaagaccaggtttagagaaaagagatatagtgagagtatgaaaaccctgacttcttgaaggggagcagttaaggggaccatactaagggaggtgctaaaaagagcctgagatacactgggagtatttccataaatacgtttattcatattcaaatatagcaatttctaatatgtattctctggttagaaaagtaactgaaaaaattctactgagtaggttgatgtgagtgtgtgtgtgtgtgtgtgtgtgagagagagagagagagagagagagagagatccaggtaggatatctctgtgtaaacaagttaaggaaatgcttctgcagaacaaattctacctcctcttgtaaatgcaggacatatgacat

SEQ ID NO: 23151 - DNA, 454 bp, Homo sapiens
  AC027433.2_51177
  Located on chromosome 18
  Distance between a terminus base of telomere on chromosomal short arm and 5'-terminus of this base sequence : 1234807
  Distance between 3'-terminus of neighbour sequence of sequence listing upward to telomere on chrosomal short arm and 5'-terminus of this base sequence : 98285
cactagtggaatgatatgagctctgctttctcaataattattcagatttgggcatattaagtaagaagggcacttgcaaggaaagcaatgtaattgtgagactaattgcatcccagcctccactttcgttgtctatgggattgagtgaacagaggccaaattagagagaaatcttatagagattaaagttatttaccttaaatttacctcttattgaaggaatctgaaagatcttttatctgcatatgtattaaaaacaggccatgttaccctaatgttaccaaggtcttatgtcttcagaaaccagacatagtctgtggtgtctttctctctctctctctttttttcaactgaatatttattattattattattattattattattattattattattattatactctaacttctgggatacatgtgcagagtatgcaggtttgttacatagg

SEQ ID NO: 23152 - DNA, 407 bp, Homo sapiens
  chr18.fa.O7frz.1501773
  Located on chromosome 18
  Distance between a terminus base of telomere on chromosomal short arm and 5'-terminus of this base sequence : 1296609
  Distance between 3'-terminus of neighbour sequence of sequence listing upward to telomere on chrosomal short arm and 5'-terminus of this base sequence : 61348
ctcctgtatcaacatcactgagttcagtgcctcacaattgctgtgcactccctccctctgcaccgtccccacccccagcagtggcagcttggtaccgagagcatctctgggtgcatcggcaagtcaggactgctttctctatcttttcagtgcctttttcagcaacatggagttaaaactgggtattatgagagctcacctgatttttggttcttatgcaggtgtttttttctgtgtagattgctgttaaattggtgtctgtgcagggggtatgatcagtggagccttctattctaccatcttgctctgcctccaatccttttattattattattattattattattattattatactttaagttctagggtacatgtgcacaacgtgcaggtttgatacataggta

SEQ ID NO: 23153 - DNA, 433 bp, Homo sapiens
  chr18.fa.O7frz.1599588
  Located on chromosome 18
  Distance between a terminus base of telomere on chromosomal short arm and 5'-terminus of this base sequence : 1395035
  Distance between 3'-terminus of neighbour sequence of sequence listing upward to telomere on chrosomal short arm and 5'-terminus of this base sequence : 98019
cagagcttagtcatgtcaagacattccagaatatagacatagacattttaatagcacttaatcaagagcctggaaggtcccatgaagaaatagttgtaaactgaaccttactaaaactgtaacccctcttcagtacagttcagtccctgacgggcttgaagtgatcaatccctaatgctaaatgcctagcgaaggaaagtgagataactctctgatgaatatcgaggtcatctgaaatatttgtaactcacaatgtctgtgatatatatatatccaacaatatatatatatatatatatatagtccagatatatatatccaacaatatccagatacatatatatatacatatatatctccaaccatgaaaataaaaatagacaatagaagtcgactcattgataagccaagcaagaacttcagaataactaat

SEQ ID NO: 23154 - DNA, 386 bp, Homo sapiens
  AC008109.6_150735
  Located on chromosome 18
  Distance between a terminus base of telomere on chromosomal short arm and 5'-terminus of this base sequence : 1673982
  Distance between 3'-terminus of neighbour sequence of sequence listing upward to telomere on chrosomal short arm and 5'-terminus of this base sequence : 278514
caagcaataaatcacaactgtcttcaaaaagaaagaaggaaagcagtcacaagaaaaacttgttgctcccattttccttttgtgactcaccttctccttctcctttcttcttcttctcctttcttcttcttcttcttcttcttcttcttcttcttcttcttcttcttcttcttcttcttcttcttcttctcctcctcctcctcctcctccttcttctcctccttcttcttctccttctccttctctttctcctccttctccttctcctccttcttcttgttctttgagacagagtccccctgtgtctcccaggctggagtgcagtggcacaatcacaactcactgcagccttgacctcctgggctcaaatgatcctaccatcttag

SEQ ID NO: 23155 - DNA, 326 bp, Homo sapiens
  AC008109.6_43885
  Located on chromosome 18
  Distance between a terminus base of telomere on chromosomal short arm and 5'-terminus of this base sequence : 1780775
  Distance between 3'-terminus of neighbour sequence of sequence listing upward to telomere on chrosomal short arm and 5'-terminus of this base sequence : 106407
gttcagaaagtctagttaggcataaaatgagttggtttgctttgttaatttaaaaaaaatttggcttgaaaaaaatgtaattagataaaaagtttcgagaaaagtacacagaactcccacattcttttcacccagatttatcaattgttaatattttgtaaactttgttcttatccttaatctatctttatatctgtctattatgtatttgtgtgtctattctatctatctatctatctatctatctgtctatctgcctacctatctatcatctgtctttctgtgccaatgtatagtaggagcttggaatgctagaataccttatt

SEQ ID NO: 23156 - DNA, 394 bp, Homo sapiens
  chr18.fa.O7frz.2013909
  Located on chromosome 18
  Distance between a terminus base of telomere on chromosomal short arm and 5'-terminus of this base sequence : 1855337
  Distance between 3'-terminus of neighbour sequence of sequence listing upward to telomere on chrosomal short arm and 5'-terminus of this base sequence : 74236
caacatggcacatgtatagatatgtaacaaacctgcacgttgtacacatgtaccctaaaacttaaagtataataataataataataataataataaaagaaagtttctaattatcttcccagctctgctcaggcaactcttcctctgaggatccttccagtgacaattcaagaattagcgactcaattcccagggtcccttagaccttcgacctgcttgtgggcaatttggaaacaaggattgtgcctgaatcacctttgcattcctagcatcgtttttcctggataataatttgttcaatatatgttcaataattgttcaattattcaataacaaatgttcaataaatgtgtgttaaatgaatgaccacagctcctatagcaggtagctgact

SEQ ID NO: 23157 - DNA, 103 bp, Homo sapiens
  D18S1105
  Located on chromosome 18
  Distance between a terminus base of telomere on chromosomal short arm and 5'-terminus of this base sequence : 2043181
  Distance between 3'-terminus of neighbour sequence of sequence listing upward to telomere on chrosomal short arm and 5'-terminus of this base sequence : 187450
ccaaagcacagatttcaaacacacacacacacacacacacacacacacacacacacacacacacacacacgaaatgccctaggcatattatatccaaactgca

SEQ ID NO: 23158 - DNA, 472 bp, Homo sapiens
  AC068381.2_10182
  Located on chromosome 18
  Distance between a terminus base of telomere on chromosomal short arm and 5'-terminus of this base sequence : 2260001
  Distance between 3'-terminus of neighbour sequence of sequence listing upward to telomere on chrosomal short arm and 5'-terminus of this base sequence : 216717
taggacgtgtacagtgagaaagaaagaagcaacatggaggagccgcctacctgcataaccaaaattggggtgggggctgccagagattttgcaccctatgtagatcagacaccgcctccccactagctcatctataaaaacccctgcatttcaccatggatcggcaacccatttttccaggacccctctctgtagcagaaagctattctctttcgcctattaaaattctgccgtaaacctcaccctttgtgtgtgtccacgtccttgatctcagtggccatgagaccaagaacctctggtgtcaacccagacaacgaggacgcttcaaaattacatcacaattttaaaaagtgtgtgtgtgtgtgtgtgtgtgtgtgtgtgtaaggagacagaaagggaaagaattaaaaagcaagaaaattaacaaaaatatgggagggtaaatgaagtgaaagtgttctaaggtcatatg

SEQ ID NO: 23159 - DNA, 271 bp, Homo sapiens
  D18S476
  Located on chromosome 18
  Distance between a terminus base of telomere on chromosomal short arm and 5'-terminus of this base sequence : 2435227
  Distance between 3'-terminus of neighbour sequence of sequence listing upward to telomere on chrosomal short arm and 5'-terminus of this base sequence : 174754
tagataatcaaatcatgccttggccaaggttattagtgtttttacttctcagattatcaatcagataccttagttcctctctacagaagcaacttaggaaaataaccagtatcattattcaagatcagcatataagtgtaagttgacaatagcacacatacagtcctctcacatctacacacacacacacacacacacacacacacacacaaacagtgataatgatggtgtgggtggtggtggtgatgatgatgatggtggtagttgtgac

SEQ ID NO: 23160 - DNA, 457 bp, Homo sapiens
  AC009699.6_182048
  Located on chromosome 18
  Distance between a terminus base of telomere on chromosomal short arm and 5'-terminus of this base sequence : 2497309
  Distance between 3'-terminus of neighbour sequence of sequence listing upward to telomere on chrosomal short arm and 5'-terminus of this base sequence : 61811
aagacatcgtttctacatgaataggattttttttccaaggcagagataggagggctggagggaaaaatttaaaaacacattggcctgtttttactgtatatattgtttcctggatgctggaaattaccctgattattcatctgcaaaatagctacaaagaaaacccaaactatgattcagccattgcagctgtggtagacagaattgccaatggtgaaggaagggcagaaaacccactgttgcaattcgttttctctcttgttttgtttaactgtttaacttctggacctaattatttaaaacacacacacacacacacacacacacacacacacacacacagagcaaaaaagaagagaaatgagagctggtctgcttttcccatccctcattccctgcatgccatttcccaccaaatcaaactcagtattttataacagtgatcctacaattgtct

SEQ ID NO: 23161 - DNA, 443 bp, Homo sapiens
  chr18.fa.O7frz.2935369
  Located on chromosome 18
  Distance between a terminus base of telomere on chromosomal short arm and 5'-terminus of this base sequence : 2641750
  Distance between 3'-terminus of neighbour sequence of sequence listing upward to telomere on chrosomal short arm and 5'-terminus of this base sequence : 143984
gatccaatagttgaattgataagaccatatagaaaagattatctcaaacctaaagagaaataagttcttgagaagacaaaatttctctagtaaatatttggaaataatataaaatattttcccatcaatccaattgaaaattagatgcatttctaaaagtaaaaaatcactgcccagattactagagctaaaatgtttcttacttaaaaattagacatataataatatgagatagtaagtgatatttaggttcagaaaaataaataattattgggctacccattggataccatcaagttctcaattaagcctctacaaaagttactcaaattatgatgtttttattaatctattgaggataaaaagaaaaattccatctcccacaatgaatgtgtgtgtgtgtgtgtgtgtgtgtgtgtgtgtgacaattgcctcattattta

SEQ ID NO: 23162 - DNA, 261 bp, Homo sapiens
  AC068523.2_19619
  Located on chromosome 18
  Distance between a terminus base of telomere on chromosomal short arm and 5'-terminus of this base sequence : 2710483
  Distance between 3'-terminus of neighbour sequence of sequence listing upward to telomere on chrosomal short arm and 5'-terminus of this base sequence : 68290
tagaatggtacttggcacatagtaagcatttagcaagaattcgctgttattattgaaaccaagtttacccgtgtgtgtgtgtgtgtgtgtgtgtgtgtgtgtatatacacatatatatatatgaatataatattgttttgttaaattcacagccatcttattcaataaagatatgatgctaatcagatacttggaaaatttataacaccactggaaaaaatatatatacaaatgattaagtcctaaggtctagaacaaagg

SEQ ID NO: 23163 - DNA, 445 bp, Homo sapiens
  chr18.fa.O7frz.3228720
  Located on chromosome 18
  Distance between a terminus base of telomere on chromosomal short arm and 5'-terminus of this base sequence : 2878610
  Distance between 3'-terminus of neighbour sequence of sequence listing upward to telomere on chrosomal short arm and 5'-terminus of this base sequence : 167866
ccagtttggtatggttatcactgaaaatgtcagtaaaatatgaataaactctggtgtgtgtgtgtgtgtgtgtgtgtgtgtgtgtgtgtgtcttttttttttttttttgagtcagactcttactctgtcacccagcctggagtgcaatggcacgatctcagttcactgcaacttctgtctcctgggttcaagcgattttcctgcctcagcctcccaagtagctgggaccacagatgtgtgccaccacgcctggctaattttgtatttttagtagagacagggtttcaccatgttggccagactggtttcgaactcctgacctcaggtgatccacccgcctctgccataataagtcttatctcattttttcacatagtataaattatattcttatgcaggactgcgttaagatccagtagttcttaaacaatgttaccaaataacc

SEQ ID NO: 23164 - DNA, 351 bp, Homo sapiens
  AC007941.3_114052
  Located on chromosome 18
  Distance between a terminus base of telomere on chromosomal short arm and 5'-terminus of this base sequence : 2906786
  Distance between 3'-terminus of neighbour sequence of sequence listing upward to telomere on chrosomal short arm and 5'-terminus of this base sequence : 27731
tacagatcaaactccttgttctactctttccctcttctcactactacacttgatgagtggaaagaaggaaggaaggaaggagagaaagaaaaagaaagaaagagaaaaagaagaaagaaagaaagaaagaaagaaagaaagaaagaaagaaagaaagaaagaaagaaagaaagaaaactcacaaaatatttgttttccaagtggttgtactatattatgttcctacctgcagtgagggttcctgttggtccaaatccttactgacgctttgtatgataggacttcttccaaactgctcattactttaaaacatttgatgtttgagcatgctgcttgtcataaagttctgtc

SEQ ID NO: 23165 - DNA, 405 bp, Homo sapiens
  AC007941.3_155886
  Located on chromosome 18
  Distance between a terminus base of telomere on chromosomal short arm and 5'-terminus of this base sequence : 2979837
  Distance between 3'-terminus of neighbour sequence of sequence listing upward to telomere on chrosomal short arm and 5'-terminus of this base sequence : 72700
tccaacctcttaacctattgtctctttatatttaaagagggtttcttttacgctatagatatttgtgtcttaatatttaacaatctctgccttttaattggagtgtttagatcagttgcttttaattggattattgatatgtttagatttaagtttaccatctttgttaattttttatttttcctgcctattttttgttcccattttcttttttttcctgccttattgcagattcagtgtgtgtgtgtgtgtgtgtgtgtgtgtgtgtgtgtgtgtgtgtgattccattttatttcctttttggcttattaactatagctgttactttactggaaactctaggattcatagtataaatctttaatttatcacagtctgtattaagtaatactaaaccacttcgca

SEQ ID NO: 23166 - DNA, 362 bp, Homo sapiens
  AP000919.4_43243
  Located on chromosome 18
  Distance between a terminus base of telomere on chromosomal short arm and 5'-terminus of this base sequence : 3165498
  Distance between 3'-terminus of neighbour sequence of sequence listing upward to telomere on chrosomal short arm and 5'-terminus of this base sequence : 185256
ttctttcattgaacagaaagattttgagattcattcatgttgtagtatgtatcagtagctgatttttttttttgagatgggatctcactatattgcccagactggtttttgaactcctgggcttaagtgatcctcccacctcagcctcctgagtggctaggactccaggtgtgtgccactgcacctggctgtagttgattactttttgttgttggatagattcctctgtgtgtgtgtgtgtgtttgtgtgtgtgtgtgtgtgtgtgtgtgtaccatcatttgtatagttgctgaagacgtggtgaaatacagagtgggcaaaataacttttactgatagtaaggatacttctcggagtttct

SEQ ID NO: 23167 - DNA, 172 bp, Homo sapiens
  D18S1098
  Located on chromosome 18
  Distance between a terminus base of telomere on chromosomal short arm and 5'-terminus of this base sequence : 3165656
  Distance between 3'-terminus of neighbour sequence of sequence listing upward to telomere on chrosomal short arm and 5'-terminus of this base sequence : -204
aggactccaggtgtgtgccactgcacctggctgtagttgattactttttgttgttggatagattcctctgtgtgtgtgtgtgtgtttgtgtgtgtgtgtgtgtgtgtgtgtgtaccatcatttgtatagttgctgaagacgtggtgaaatacagagtgggcaaaataacttt

SEQ ID NO: 23168 - DNA, 457 bp, Homo sapiens
  AP001026.3_189364
  Located on chromosome 18
  Distance between a terminus base of telomere on chromosomal short arm and 5'-terminus of this base sequence : 3235812
  Distance between 3'-terminus of neighbour sequence of sequence listing upward to telomere on chrosomal short arm and 5'-terminus of this base sequence : 69984
agctatcttcctgatttggtttcctgaagtgctgggattacagttgtgagccactgcgtctggccaatgcattcaaaattttcagatttgttaagacttgctttatttattttatttatttatttatttagtttttgagatgaagtctagctctgttgctcaggctggagtgcagtggccccatcttggctcactgcctctgtgtcttgggttcaagtgattctcctacctcagcctcctgagtagctgggactacagttgtgcgccaccacacctggctaatttttgtgtttttagtagagacgggtttcaccatgttggccaggctagcctcgaactcctgacctcaagtgatcggcctgtctcggcctcccaaagtgctgggattacaggtgtgagccactgcacccggcctatatgtgttttatatgttcatatgttaccagctttagtgagg

SEQ ID NO: 23169 - DNA, 266 bp, Homo sapiens
  chr18.fa.O7frz.3664014
  Located on chromosome 18
  Distance between a terminus base of telomere on chromosomal short arm and 5'-terminus of this base sequence : 3385695
  Distance between 3'-terminus of neighbour sequence of sequence listing upward to telomere on chrosomal short arm and 5'-terminus of this base sequence : 149426
agaagtttcagatcttcctcagctgatatagcaagacccttatgtctattaaaaccaaaattaaccggggatggtggcacatgcctgtggtcccagctactcaggaggcacaggcaagaggattgcttgatcccagcaggtccaggctgcagtgagctgaaatcgtgccactgtactccagcctggacaacagagcaagacactatcttacacacacacacacacacacacacacacacagcttatccagttctacctaataaacg

SEQ ID NO: 23170 - DNA, 133 bp, Homo sapiens
  DISO7_00000868
  Located on chromosome 18
  Distance between a terminus base of telomere on chromosomal short arm and 5'-terminus of this base sequence : 3610353
  Distance between 3'-terminus of neighbour sequence of sequence listing upward to telomere on chrosomal short arm and 5'-terminus of this base sequence : 224392
gacaggtgactcattcttgccttctccagccagggaatgcaggctgggtggggggatatctgggatgcagagtcgtgtgtgtgtgtgtgtgtgtgtgtgtgtgtgtgtgtggtgcctcgatgctgagttgctc

SEQ ID NO: 23171 - DNA, 206 bp, Homo sapiens
  chr18.fa.O7frz.4947157
  Located on chromosome 18
  Distance between a terminus base of telomere on chromosomal short arm and 5'-terminus of this base sequence : 3806236
  Distance between 3'-terminus of neighbour sequence of sequence listing upward to telomere on chrosomal short arm and 5'-terminus of this base sequence : 195750
atggtgtgacaaatctggtatttttaaaaaatgtcacatatagcagtacacattttcatatagcaagtgtttattccctaagacacacacacacacacacacacacacacacacacacacagagtagaatatttttattgaaacctggggagatgtttcttcgacaataccttatggggacaactattgtatcttccagctcctta

SEQ ID NO: 23172 - DNA, 418 bp, Homo sapiens
  AC006211.1_151493
  Located on chromosome 18
  Distance between a terminus base of telomere on chromosomal short arm and 5'-terminus of this base sequence : 3820145
  Distance between 3'-terminus of neighbour sequence of sequence listing upward to telomere on chrosomal short arm and 5'-terminus of this base sequence : 13703
cagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgtt

SEQ ID NO: 23173 - DNA, 147 bp, Homo sapiens
  D18S459
  Located on chromosome 18
  Distance between a terminus base of telomere on chromosomal short arm and 5'-terminus of this base sequence : 3847980
  Distance between 3'-terminus of neighbour sequence of sequence listing upward to telomere on chrosomal short arm and 5'-terminus of this base sequence : 27417
aggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtaga

SEQ ID NO: 23174 - DNA, 288 bp, Homo sapiens
  AC006211.1_123745
  Located on chromosome 18
  Distance between a terminus base of telomere on chromosomal short arm and 5'-terminus of this base sequence : 3848010
  Distance between 3'-terminus of neighbour sequence of sequence listing upward to telomere on chrosomal short arm and 5'-terminus of this base sequence : -117
actttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtc

SEQ ID NO: 23175 - DNA, 298 bp, Homo sapiens
  chr18.fa.O7frz.4479528
  Located on chromosome 18
  Distance between a terminus base of telomere on chromosomal short arm and 5'-terminus of this base sequence : 3896024
  Distance between 3'-terminus of neighbour sequence of sequence listing upward to telomere on chrosomal short arm and 5'-terminus of this base sequence : 47726
ctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatcctt

SEQ ID NO: 23176 - DNA, 269 bp, Homo sapiens
  D18S1138
  Located on chromosome 18
  Distance between a terminus base of telomere on chromosomal short arm and 5'-terminus of this base sequence : 4175964
  Distance between 3'-terminus of neighbour sequence of sequence listing upward to telomere on chrosomal short arm and 5'-terminus of this base sequence : 279642
gagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatc

SEQ ID NO: 23177 - DNA, 139 bp, Homo sapiens
  chr15.fa.O7frz.58403147
  Located on chromosome 18
  Distance between a terminus base of telomere on chromosomal short arm and 5'-terminus of this base sequence : 4253954
  Distance between 3'-terminus of neighbour sequence of sequence listing upward to telomere on chrosomal short arm and 5'-terminus of this base sequence : 77721
aactcctgacctcgtgatctgcctgccttggcctcccaaagtgctgggattacaggtgtgagccattgtgcccggacttcttcttcttcttcttcttctttttttttttttttaatgagatgcagtcttactctgtcac

SEQ ID NO: 23178 - DNA, 356 bp, Homo sapiens
  chr18.fa.O7frz.4772613
  Located on chromosome 18
  Distance between a terminus base of telomere on chromosomal short arm and 5'-terminus of this base sequence : 4335768
  Distance between 3'-terminus of neighbour sequence of sequence listing upward to telomere on chrosomal short arm and 5'-terminus of this base sequence : 81675
caaatagctttctaaaggagaatctcataaataacagtagcttttgttgtgccctattacattggtggtgtaattttcttttttctttaattttctatgaattataagattccttccttccttccttccttccttccttccttccttccttccttccttccttccttccttccttccttccttccttccttccttccttccttccttccttccttcctccttgtttttttttgacagggtctcactttctcccccaggctggagtgcagtggtgcaatcacagctcactgcagcctcgatctttcaggctcaagcaatccttccacttcagcctcctgagtagctagaaccacagg

SEQ ID NO: 23179 - DNA, 274 bp, Homo sapiens
  D18S1154
  Located on chromosome 18
  Distance between a terminus base of telomere on chromosomal short arm and 5'-terminus of this base sequence : 4388087
  Distance between 3'-terminus of neighbour sequence of sequence listing upward to telomere on chrosomal short arm and 5'-terminus of this base sequence : 51963
cccaccttgagtcacattcaaaggcttagattatattgaaaaagtgtagagggtctgagaagaatttaaagtgaaagaatggcataatcaggtaacaaagatcatattacaaataatactcttagcagtatgaaagactgtgtgtgtgtgtgtgtgtgtgtgtgtgtgtgtgtgtgtgtgtgtgtgtgttttagaggtgataagaacagtcattatggcctagtgattaagaacatgctgtgttcaaaatttagtaacaatggctggatacggt

SEQ ID NO: 23180 - DNA, 451 bp, Homo sapiens
  chr18.fa.O7frz.5308634
  Located on chromosome 18
  Distance between a terminus base of telomere on chromosomal short arm and 5'-terminus of this base sequence : 4461422
  Distance between 3'-terminus of neighbour sequence of sequence listing upward to telomere on chrosomal short arm and 5'-terminus of this base sequence : 73061
ggcaagacagaagtataggaacttggcattgcacccacccacttaggccaatgcatgagacagcgacttatcacactttgttgtaaatgtttctttaacttctgtctcccttgctagaggaggaatgatatctgtcttagaaaccattgtttctctaccactaagcacagaggctggcaaagagtaagttcctaataaatgagagaaagaataaatgaattaaagtatggatggatggatggatggatggatggatggatggatggatggaccgttggatggatacataggtagatacgtgaatagacagatggataaatgagtaggtaggtgtttgggtaggtgagcggatggatggatggatggaaagatggaagggtggaaaatcccagaggcaattatgatgatagtcaagggtaaagtaaaaacctagtctaagcgcatgattaca

SEQ ID NO: 23181 - DNA, 459 bp, Homo sapiens
  AC015571.4_4777
  Located on chromosome 18
  Distance between a terminus base of telomere on chromosomal short arm and 5'-terminus of this base sequence : 4553679
  Distance between 3'-terminus of neighbour sequence of sequence listing upward to telomere on chrosomal short arm and 5'-terminus of this base sequence : 91806
ttggaatcagtcactaacaaatcctgctgggctgtttcctctgtctggactcctcacccactgggatttttccactgaactttatgacatacagtagcccccaccttatccatgggggatacattccaagatcctcagtggatgcctgatgccccaaacagaaccaaaccctatatgtaaataaataaatatatatatatacacacacacacacacacacacactcacacacacatatacaccaagtaacaacaacaaagttattatgtccagctcttccgtaaaataaacatcaacttgtcatctctttgtaaaactgcacatctagttatattttttcaggtatagttaaacaaaaaatacctattttcgcaaggtatttgtaggccatatagttattatctttgaatccaagcaggaaggcttagcaaaggctctgtacagaaagctgtcgtgtct

SEQ ID NO: 23182 - DNA, 316 bp, Homo sapiens
  chr18.fa.O7frz.5441653
  Located on chromosome 18
  Distance between a terminus base of telomere on chromosomal short arm and 5'-terminus of this base sequence : 4630941
  Distance between 3'-terminus of neighbour sequence of sequence listing upward to telomere on chrosomal short arm and 5'-terminus of this base sequence : 76803
ttaagtttcatgttgaaaccagttcttggttgctaaacctgttcatccattcttccatccatccatccatccatccatccatccatccatccatcctttatccatccaacagatatttatgggtttccaaagtctgtgacacagtaaaggatataaaaatgcatcaaaaatcttactgttgggaattttatgatattaagatggtaactgaccagaagactcagagcttgttattaaactaacacacctacccacaatggtgatgttggcaaggaagacctttcattgtgatcagtctttgactcaaactgtaacg

SEQ ID NO: 23183 - DNA, 477 bp, Homo sapiens
  AC068999.12_53313
  Located on chromosome 18
  Distance between a terminus base of telomere on chromosomal short arm and 5'-terminus of this base sequence : 4660450
  Distance between 3'-terminus of neighbour sequence of sequence listing upward to telomere on chrosomal short arm and 5'-terminus of this base sequence : 29193
ctttctgaacttgtcactgaaggcatagaggtgggtcgagctcctctttaacagacacatgccagtggcagattgtgcaaggctccctgggttccttgcaggctacaccctaatgtggtctagctagtgactgtttgattcttcagtatatgccccttgcaaatcttccctttctcactttgtcccacaattgtgcagagtggatggaattctcatattaaatacttgatttacgcaatacttagagtggctgttttcatgattaaaacttgactaatacatatgccttgactttctttgaacacacacacacacacacacacacacacacacacacttccttggcttgctgctgcttccaagtttggtttcaactctttagttagagactctggttctttttttgttttaacttttattttaggttcagggatgcatttgcaggtttgttatataggtaagttgcatgtcataagt

SEQ ID NO: 23184 - DNA, 431 bp, Homo sapiens
  chr18.fa.O7frz.5745394
  Located on chromosome 18
  Distance between a terminus base of telomere on chromosomal short arm and 5'-terminus of this base sequence : 4856682
  Distance between 3'-terminus of neighbour sequence of sequence listing upward to telomere on chrosomal short arm and 5'-terminus of this base sequence : 195755
tacttgaccttgcagatttagacttgccagcctccaaattcatatgaaccaattctttaaaatctctctctctctctctcatacacacacacacacacacacacacacacacacacacatcctattggttctgtttctctagagaaccatgactactatagatttatatttttttctaattttcaagatagtataatattactaaaggttttaaataaagtaagtattaataatgcccaatataatattgaaatacaaaaattattaaaattcatggttctctctatgtagataaaaagagatgctggatggatagatggacagacagacaggagagtagagcaagcaatatttctcccattccttctatttttctatggcaaatatcgatgagcagtaactgtggagcaaagtaggttaaagactgcagg

SEQ ID NO: 23185 - DNA, 358 bp, Homo sapiens
  chr18.fa.O7frz.6409248
  Located on chromosome 18
  Distance between a terminus base of telomere on chromosomal short arm and 5'-terminus of this base sequence : 4927423
  Distance between 3'-terminus of neighbour sequence of sequence listing upward to telomere on chrosomal short arm and 5'-terminus of this base sequence : 70310
ttattcactggcagtatctgatacttgttaatgttttccccacctctgatattaaattttaaattacaaaaagaactgtccaatagctctaattttaaaaggaaactagatattgaaataaatttttttatttaaaaattatatatatttacagtgcacaagttgatgttttgatatatgtgtccactgtaaaatgatacagtcaagctaacacatccatcacctcacatagtgtgtgtgtgtatgtgtgtgtgtgtgtgtgtgtgtgtgtgtgtgtggtgagaatatttaagatctactttcttaaagtatacattattattaactatagtcacagtgctgtacaatagatctccag

SEQ ID NO: 23186 - DNA, 120 bp, Homo sapiens
  D18S1132
  Located on chromosome 18
  Distance between a terminus base of telomere on chromosomal short arm and 5'-terminus of this base sequence : 5177517
  Distance between 3'-terminus of neighbour sequence of sequence listing upward to telomere on chrosomal short arm and 5'-terminus of this base sequence : 249736
agccacaacgaccagccttttccaaattttacatctctctctctctctctctctcacacacacacacacacacacacacacacacacacacacacataaaattggtctggtagggcagca

SEQ ID NO: 23187 - DNA, 436 bp, Homo sapiens
  chr18.fa.O7frz.6830729
  Located on chromosome 18
  Distance between a terminus base of telomere on chromosomal short arm and 5'-terminus of this base sequence : 5425566
  Distance between 3'-terminus of neighbour sequence of sequence listing upward to telomere on chrosomal short arm and 5'-terminus of this base sequence : 247929
ctccataatcatgtgagctaattcccaaaataaatctctgtgtgtgtgtgtgtgtgtgtgtgtgtgtgtgtgtatgtgtgtgtgtatttttccattggttctgtttctctggagaaccctgactgatacagacagtcttggtaaaatctgaacgtgactgattatagtaatatgtcaatgttaaaatttctgaatttcatcattttaacatggctatgtaagatatagtaattcttttgtgtttagcagatacatgctgaaatatttagggagtgttaggggtaaaggattatggtaactgcaatttgctctcaggtagtttagtaataataattattctatatctatgagaaataaagtaaacgtagcaagatagtagcaattggtgagtttaagcaaaagatatatagtagtacttgcaactgtcttgtaagtt

SEQ ID NO: 23188 - DNA, 212 bp, Homo sapiens
  Z67670
  Located on chromosome 18
  Distance between a terminus base of telomere on chromosomal short arm and 5'-terminus of this base sequence : 5467440
  Distance between 3'-terminus of neighbour sequence of sequence listing upward to telomere on chrosomal short arm and 5'-terminus of this base sequence : 41438
  misc_feature (1)...(212): n = A,T,G or C
tgtgtagtatccaatgtgttctctttaacttggagctcagaagttttactagggtgtgtgtgtgtgtgtgtgtgtgtgtgaccattaatcctgatgggattcattctgtcctttcattatattctcaattttttcccttcaaattagaaaaaagnaattcttcctgttaattattcttctctgtgtattactttttcatctttgaacatcct

SEQ ID NO: 23189 - DNA, 384 bp, Homo sapiens
  AP001496.3_24231
  Located on chromosome 18
  Distance between a terminus base of telomere on chromosomal short arm and 5'-terminus of this base sequence : 5559855
  Distance between 3'-terminus of neighbour sequence of sequence listing upward to telomere on chrosomal short arm and 5'-terminus of this base sequence : 92203
ggaactatgagcaggtcttaactccctagcctagtttaactcatctttgaatctcaatagaaatgcctaggatgaatataaggataaaaatatgtagtaaatattcaaactctatgaagagttcaatgtgatgcgtgtgtgtgtgtgtgtgtgtgtgtgtgtgtgtgtgtgtgtagctgctgggctgatttcaaaagctactgtgagttacaaattctcattttgcatatttctctttataaaaaataaatcatcaatgacagaagtgtgaagaggaaagggctcactcagccctgggataggcattggaaagcagagaacaaagggaaaagtgataaagagggtgaccagttacaggaaaggtcaggtctaagtgatagcctc

SEQ ID NO: 23190 - DNA, 180 bp, Homo sapiens
  G08010
  Located on chromosome 18
  Distance between a terminus base of telomere on chromosomal short arm and 5'-terminus of this base sequence : 5684628
  Distance between 3'-terminus of neighbour sequence of sequence listing upward to telomere on chrosomal short arm and 5'-terminus of this base sequence : 124389
ctccctgatttttagctgggcatataatcacttttcattagggttctctagagagacagaaataataagatagatagatagatgatagatagatagatagatagatagatagataatagatagatgacagggcatttattaggggaattggttcatatgattatggcagcagagaagtcc

SEQ ID NO: 23191 - DNA, 276 bp, Homo sapiens
  D18S873
  Located on chromosome 18
  Distance between a terminus base of telomere on chromosomal short arm and 5'-terminus of this base sequence : 5711423
  Distance between 3'-terminus of neighbour sequence of sequence listing upward to telomere on chrosomal short arm and 5'-terminus of this base sequence : 26615
tggaaccacttcattcttggtatcaaaatatgttccaggttctccagaaagatagaacaaatagacagtgtgtatgtgcacatatatctatgcatctgtatttatgtctatctatctatctatctatctatctatctatctatctatctatcatctatctatctatttttctctctatcatctgcctatcttggtctgaaatctgcaggacatgatggcagactaaagagcagggaaaagtcgatgttgcattcttgagtccaaaggcagtttgaa

SEQ ID NO: 23192 - DNA, 424 bp, Homo sapiens
  AP001032.4_147099
  Located on chromosome 18
  Distance between a terminus base of telomere on chromosomal short arm and 5'-terminus of this base sequence : 5881533
  Distance between 3'-terminus of neighbour sequence of sequence listing upward to telomere on chrosomal short arm and 5'-terminus of this base sequence : 169834
tctctagtgacctcagcttctatggctttcattaccttcctatctggaggattctgagtcttgatctttgagctggacctctctggcttgctggctgatgcatgaaggctactagacatgggttctgaaatgtcccacaggaacttcaggacaaactcctgaccatgccatcaccaaccccaccatcaactcatatatgtgtgtgtgtgtgtgtgtgtgtgtgtgtgtgtgtgtgtgtatctcagggaacagcaagtggggccattcccctctccctcacctcccaccatacccaacatgtcactaagtctcaaaattctacctcctaaacatttttcaaagtattcatttttctccatctcttctaccacttccttagttcagatcatcctcaattcttccctggatagtaacattagcacca

SEQ ID NO: 23193 - DNA, 179 bp, Homo sapiens
  chr18.fa.O7frz.7799334
  Located on chromosome 18
  Distance between a terminus base of telomere on chromosomal short arm and 5'-terminus of this base sequence : 5897636
  Distance between 3'-terminus of neighbour sequence of sequence listing upward to telomere on chrosomal short arm and 5'-terminus of this base sequence : 15679
aagtgttgcgtatgagtattagagacatatatgcacatatcacatacgcacctgtatgactctgtgtgtgtgtgtgtgtgtgtgtgtgtgtgtgtgtgtgtgtgtgtagcacataaggtctgtgaatgaagaaagaattcattttccttttttgcatgtacactaaagcactccattga

SEQ ID NO: 23194 - DNA, 467 bp, Homo sapiens
  chr18.fa.O7frz.7947335
  Located on chromosome 18
  Distance between a terminus base of telomere on chromosomal short arm and 5'-terminus of this base sequence : 6062110
  Distance between 3'-terminus of neighbour sequence of sequence listing upward to telomere on chrosomal short arm and 5'-terminus of this base sequence : 164295
acaatgttgacattctggttttaaatgtatatatatacacacacatatatatttctatatatatttatattcatatataagtaataaataaatatacatattatatataatatacttacatatataaatataaatatatatgactccctgtgtccatatctatatatatatacacacacatatgcatttatatatatatatagagagagagagagagagagagagagagagataaaatatatatatgagggcagagtggtttagctgattataaactgggattactgacatgatggcatccaaccctccagtatctgttttcatgagctgatatgattggagacaagttgtgatcacagggtactggggcagaagcagaaaagtaggaaatggagacctgaatgtgtttgttcgaggtttgaacttctctaagaagtccttccctgtccttaggtcacaaagacagt

SEQ ID NO: 23195 - DNA, 184 bp, Homo sapiens
  chr18.fa.O7frz.8130569
  Located on chromosome 18
  Distance between a terminus base of telomere on chromosomal short arm and 5'-terminus of this base sequence : 6204516
  Distance between 3'-terminus of neighbour sequence of sequence listing upward to telomere on chrosomal short arm and 5'-terminus of this base sequence : 141939
gctgcataatgtgagatgtaacttccttccttgtctcctggtattcacccttcagaaacctttaatcagaatcttcaataggttctgtgtgtgtgtgtgtgtgtgtgtattttgatgcgatgatgtgctgagactgaagttaagggaaaaacatgacagcctggatacaatcaaattctacact

SEQ ID NO: 23196 - DNA, 218 bp, Homo sapiens
  D18S458
  Located on chromosome 18
  Distance between a terminus base of telomere on chromosomal short arm and 5'-terminus of this base sequence : 6258207
  Distance between 3'-terminus of neighbour sequence of sequence listing upward to telomere on chrosomal short arm and 5'-terminus of this base sequence : 53507
atgattgcaccaccgcacttcggcctaggcaacagcgtgagaccttgtcacacacacacacacacacacacacacacacaatagtttcagacaatagcctggcctggccttcccatctcttctgctgtgaaaacacaacatgcatccctttttgcctcttcagcacatgaggatatagcaaaaaggcccaggccctcaacaggcactgaatctgctgg

SEQ ID NO: 23197 - DNA, 251 bp, Homo sapiens
  D18S471
  Located on chromosome 18
  Distance between a terminus base of telomere on chromosomal short arm and 5'-terminus of this base sequence : 6299078
  Distance between 3'-terminus of neighbour sequence of sequence listing upward to telomere on chrosomal short arm and 5'-terminus of this base sequence : 40653
tgcaacatgcacagacactgtatctttttcctatttatcaacagtcaaaggaacaaaaaggtttcaatattctgtgtgtgtgtgtgtgtgtgtgtgtgtgtgtgtgttttgggaaaaaaaaggaagaacgaaagcaaaacacttgaaatgtttaaatggcaggaacaagtaacttgcataagttaaagaacaaattatgaagcaaagggataatgaaggaatagaattagcccctctatgttgcgtttcaa

SEQ ID NO: 23198 - DNA, 155 bp, Homo sapiens
  Z24025.1_180
  Located on chromosome 18
  Distance between a terminus base of telomere on chromosomal short arm and 5'-terminus of this base sequence : 6299107
  Distance between 3'-terminus of neighbour sequence of sequence listing upward to telomere on chrosomal short arm and 5'-terminus of this base sequence : -222
cctatttatcaacagtcaaaggaacaaaaaggtttcaatattctgtgtgtgtgtgtgtgtgtgtgtgtgtgtgtgtgttttgggaaaaaaaaggaagaacgaaagcaaaacacttgaaatgtttaaatggcaggaacaagtaacttgcataagtt

SEQ ID NO: 23199 - DNA, 469 bp, Homo sapiens
  AC019313.3_171788
  Located on chromosome 18
  Distance between a terminus base of telomere on chromosomal short arm and 5'-terminus of this base sequence : 6472972
  Distance between 3'-terminus of neighbour sequence of sequence listing upward to telomere on chrosomal short arm and 5'-terminus of this base sequence : 173710
gctctatcctcgtatttcaaagcccttttcaaaaatgcatcccaggccaggtgcgacgtctcacacctataatcccagaactttgggagccgaggcaggtggatcacttcagctcaggagttcaagaccagcctgggcaacactgcaaacccccatctccgcaaagaaaaaaaaaattaacaaaaattagctaggtgtggtggcgcacactgtagtctcagctactcaggaggctgaggtgtgagaattgtgtgagcccatggaggtcaaggctgcggcaggccatgattgtgccactgcactttagcctaggcgacaaaacaagaccctgtctaaaaaataaataaataaataaataaataaataaataaataaataaataatgcattccagttagatagaggtcaggtggctttctggaagcacaggcaacccttagtaaagtgaacatcactaactcatatctgga

SEQ ID NO: 23200 - DNA, 269 bp, Homo sapiens
  chr18.fa.O7frz.8518807
  Located on chromosome 18
  Distance between a terminus base of telomere on chromosomal short arm and 5'-terminus of this base sequence : 6488030
  Distance between 3'-terminus of neighbour sequence of sequence listing upward to telomere on chrosomal short arm and 5'-terminus of this base sequence : 14589
gaaactagcacagttccatttaaaatacagtaatcttttgtttggctaaaaaaaagttaatggctaaggttgcaactaaaggaaggatttctttggactgtaaatttttctattataatataatataatataatataatataatataagctttgcaaggaaattatgaggtaaagtggtcattgggtatcaaaatattaatttgcaaagctaaatatttctatgtgttcatgaaacatctagaatatctactaagtaggtccagccaat

SEQ ID NO: 23201 - DNA, 335 bp, Homo sapiens
  chr18.fa.O7frz.8746395
  Located on chromosome 18
  Distance between a terminus base of telomere on chromosomal short arm and 5'-terminus of this base sequence : 6804478
  Distance between 3'-terminus of neighbour sequence of sequence listing upward to telomere on chrosomal short arm and 5'-terminus of this base sequence : 316179
ctgtctgccacattaagactataaaatctgtgaaggctggacccacaatgggcagcatgcacagaaactggcaaatggtaagaacttagagagagagagagagagacagagagagagagggggaggggtagagagagaaagagggagagagagaataaattaactgctaaggctgcacagaaaacactgtgaactactcatttgtccaaatctttgacagaatgacacattaaccatctggaatatatgccctcttctctaaatctcatgaattccccatgtccctttgcaggttttccagtggttctcccataactgtcagtaagcactacctt

SEQ ID NO: 23202 - DNA, 473 bp, Homo sapiens
  AC019313.3_3486
  Located on chromosome 18
  Distance between a terminus base of telomere on chromosomal short arm and 5'-terminus of this base sequence : 6824677
  Distance between 3'-terminus of neighbour sequence of sequence listing upward to telomere on chrosomal short arm and 5'-terminus of this base sequence : 19864
tcttataaataggcgatgcacctcttccatctggccccacataaagataggcaaatgaatattaaatctgacatatgcaggcactgaattataacaacagaaattggaatatgatgctataattatcatatcatcaaaatgagaatgagatgaagggataattaaaatcatcatgcccagcttaatattttcataactaaagcttttattccagattgctgatttgcaagtttcttattgatatttcatgtcttacaaggagcactttcacagccctacacaccaaaggggaagcagacattcaagtagattctttttctttattttttaaataaatcataacaactagcattgtttccccgtgtgtgtgtgtgtgtgtgtgtgtgtgtgtgtgtatgtgtgtgtgcatgtttgtattttggagttgggaatcaaaagttcatggtttgaaaagaattctgaggatcatttcg

SEQ ID NO: 23203 - DNA, 472 bp, Homo sapiens
  AC019313.3_144426
  Located on chromosome 18
  Distance between a terminus base of telomere on chromosomal short arm and 5'-terminus of this base sequence : 6824750
  Distance between 3'-terminus of neighbour sequence of sequence listing upward to telomere on chrosomal short arm and 5'-terminus of this base sequence : -400
tatgcaggcactgaattataacaacagaaattggaatatgatgctataattatcatatcatcaaaatgagaatgagatgaagggataattaaaatcatcatgcccagcttaatattttcataactaaagcttttattccagattgctgatttgcaagtttcttattgatatttcatgtcttacaaggagcactttcacagccctacacaccaaaggggaagcagacattcaagtagattctttttctttattttttaaataaatcataacaactagcattgtttccccgtgtgtgtgtgtgtgtgtgtgtgtgtgtgtgtgtatgtgtgtgtgcatgtttgtattttggagttgggaatcaaaagttcatggtttgaaaagaattctgaggatcatttcgtcttggccttgtctcaagtgagaaaactgttcttaacagtctccttaacaactgattatccagatgtagcag

SEQ ID NO: 23204 - DNA, 470 bp, Homo sapiens
  AP001166.2_35437
  Located on chromosome 18
  Distance between a terminus base of telomere on chromosomal short arm and 5'-terminus of this base sequence : 6945165
  Distance between 3'-terminus of neighbour sequence of sequence listing upward to telomere on chrosomal short arm and 5'-terminus of this base sequence : 119943
tattctcatcctggtcttatgtaggttgagacagaaaagagagtttcagtgagttgtgtgttcacatggcttgtgggcagtagaagcaggattttaagctggcagcctggtttcaagcctggacatttaaagactgcaccctattgtctcttcaggaaaagattaatttgatatgagatttagggtgagaaagttgccggccttttgccttcgttcttttctcctgtcccttcctctacctgtctccttctttctcccttctctctttcttgctttctaaatcccaaactacattcctccaaatcccaggattctcagaggtaggggcgtgtgtgtgtgtgtgtgtgtgtgtgtgtgtgtgtgtgtatatatgtacacgagcgacgctgttggtcggggaggttcagagtccagggaagtctcttcagctctttgatcctcacttcccagtttatgaagtcaggtggaaa

SEQ ID NO: 23205 - DNA, 447 bp, Homo sapiens
  AP001166.2_11909
  Located on chromosome 18
  Distance between a terminus base of telomere on chromosomal short arm and 5'-terminus of this base sequence : 7096409
  Distance between 3'-terminus of neighbour sequence of sequence listing upward to telomere on chrosomal short arm and 5'-terminus of this base sequence : 150774
gtttattggaaacctaggaaagcacatgaacagcggagtacttgtcacgtggagaatgtgagggtcgaggtaatgttgtaaaatgttaagaacttttaccaacttttgtgaacgttttagagaaatggcagaaactaagccttagtgttctgcttagcttttctttccttcttttgtccaccctctccagccttggagaaaagcactctctctctctctctcacacacacacacacacactctctctctctcacacacacacacacacacactctctctctctccacatgtgtaggaagtcccattttgtatctccagcccacaagtctctcctcagctcatattcaaccctgccctccgcatcacctcaaatcttacacaatcagaacagaccaatctgcttttgtcacagtcctgcccattgttaacaaatgacaacttcattct

SEQ ID NO: 23206 - DNA, 476 bp, Homo sapiens
  chr18.fa.O7frz.9501866
  Located on chromosome 18
  Distance between a terminus base of telomere on chromosomal short arm and 5'-terminus of this base sequence : 7268143
  Distance between 3'-terminus of neighbour sequence of sequence listing upward to telomere on chrosomal short arm and 5'-terminus of this base sequence : 171287
tattcactgacagattaacgaataagcaaaatgtggcatgtatgtacaatggaatattattcagccttaaaaaggagggaaattctgacacatgctacaacatggatgagccttgaggacattatgctaagtgaaacaagccattcgcaaaaagacaagttctgtattactccacttttatttatttatttatttatttatttatttatttttgagacggagtatctctctgtcactcaggctggagtgcaatggcacgatctcggctcactgcagccttcacctcccaggttcaagtgattctcctgcctcagcctcctgagtagctgggattacaggcatgtgccatgcatatatatatatcatataagagggccatagagtggtcaaatacatagagaccaaaaggagaatggtggttttggggcactggggagagaggaaatggggagctagtgtttaatgagtgcagagtt

SEQ ID NO: 23207 - DNA, 463 bp, Homo sapiens
  chr18.fa.O7frz.9600743
  Located on chromosome 18
  Distance between a terminus base of telomere on chromosomal short arm and 5'-terminus of this base sequence : 7366814
  Distance between 3'-terminus of neighbour sequence of sequence listing upward to telomere on chrosomal short arm and 5'-terminus of this base sequence : 98195
tcatgcttctgaaagttcttacagtattctctttgttttgcagagtctccagagagactttccaacttcaaatcacactgaaaagaccgaagccagccaggcgcagtggctcacacctgtaatcccagcaccttgggaggccgaggcgggtggatcacttgaggtcaggagttcgagaccagcctggccaacatggtgaaaccccgtctctactaaaaatataaaaattgtctgggcgtggtggcgggcatctgcaatcccagctactagggaggctgaggcaggagaatcacttgaacccgggaggcggaggttgcagtgagccaagatcactccactgcactccaacctgggcaacagagcaagattctgtctcaaaaaaaaaagaaaagaaaagaaaagaaaagaaaagcaaagaaaagaaaagaaaagaaaagacccaagcctactccatatcaacatt

SEQ ID NO: 23208 - DNA, 475 bp, Homo sapiens
  AC011085.5_14818
  Located on chromosome 18
  Distance between a terminus base of telomere on chromosomal short arm and 5'-terminus of this base sequence : 7503147
  Distance between 3'-terminus of neighbour sequence of sequence listing upward to telomere on chrosomal short arm and 5'-terminus of this base sequence : 135870
acttgacatactgaagagtcagagctcaagagcaattagcccaaagatttgcgaggctgggcgtggtggctcacacctgcaatcccagcactttggagggcagaggtgggaagttcacttgagctcaggagttcaggatcagcctgggcaacatagtgagaccacatgtctacgaaaagtttttaaaaattagcaggtcttggtggcattcgcctgtagttccagttgcttggaaagctgcggtgggagaatcacttgatatcaggaggtcaaggctgcagtgatctatgattgcaccactgcattccagcctgggcaacagagcaagaccctgtctcaatgaatgaatgaatgaatgaatgagtgaatgaatgaatgaatgaataaaacagttgtgaaccctcagcctgtaagtgagaagaatggacaaggttgtggggagaggctggggctgcttcaagtagaaagatattga

SEQ ID NO: 23209 - DNA, 101 bp, Homo sapiens
  Z67032
  Located on chromosome 18
  Distance between a terminus base of telomere on chromosomal short arm and 5'-terminus of this base sequence : 7863001
  Distance between 3'-terminus of neighbour sequence of sequence listing upward to telomere on chrosomal short arm and 5'-terminus of this base sequence : 359379
tgtcaatcttgtttcatctaagtcccttccccagcacacacacacacacacacacacacacacacacacacctttttttttcccctggagtatttgaaagg

SEQ ID NO: 23210 - DNA, 202 bp, Homo sapiens
  D18S1163
  Located on chromosome 18
  Distance between a terminus base of telomere on chromosomal short arm and 5'-terminus of this base sequence : 7993841
  Distance between 3'-terminus of neighbour sequence of sequence listing upward to telomere on chrosomal short arm and 5'-terminus of this base sequence : 130739
cgccacacactctcacacactctctcacacacacacactctctcacacacacacactctctctctctctctctctcacacacacacacacacacacacacacacacacagtcatatgttgaagccctaagcccctatgtgactatatttggagataggaactttaggaggtaattaaggttaaatgaactcataagggtggg

SEQ ID NO: 23211 - DNA, 433 bp, Homo sapiens
  chr18.fa.O7frz.10268002
  Located on chromosome 18
  Distance between a terminus base of telomere on chromosomal short arm and 5'-terminus of this base sequence : 8198043
  Distance between 3'-terminus of neighbour sequence of sequence listing upward to telomere on chrosomal short arm and 5'-terminus of this base sequence : 204000
atgtctcagacagtttgtcaaggacaaatgtttggtccatgtcccaccagggcaggttttctgtcagccaggagattctagctgtgtgtgtgtgtgtgtgtgtgtgtgtgtgtgtgtatgtgtgtgtgtgtgtgtgtgtgtgtgcgcgtgcacgcgcacgcgcatggattaggtgttaggacacccaagtctaaagatttaattgtacaaatcttactgacaaatgttttactgatttgaatgtgccagattatttaaaaactggaacaatataacagatgttttttaagttctgtgaatatgaaaatattttaaaaaggtgagtatgtttttagttctttgacaggggcttatatgtctctgaactgatattaattatctatgctttgctgttttgccagtgaagtcactgataagccaagactaggtccag

SEQ ID NO: 23212 - DNA, 443 bp, Homo sapiens
  AC016664.4_116358
  Located on chromosome 18
  Distance between a terminus base of telomere on chromosomal short arm and 5'-terminus of this base sequence : 8315525
  Distance between 3'-terminus of neighbour sequence of sequence listing upward to telomere on chrosomal short arm and 5'-terminus of this base sequence : 117049
ctgtggaatagctgttattgtatcctaccagataaagaatatcttgggctgggcacagtggctcacacctgtaatcccagcattttggaaagccaaggcaggaggattgcttgagcccagaagttcagtacctgtctgggcaacatagcaagacctgtctctacaaaaataaaaatacaaaattagtcaggcatgttggcacatgtctgtagttccagctgcttgggaggctgaggcaggaggattgcttgagccaaggaggttgaggctgcagcaagccgtgattgtgccactgcactccagcctgggtgatggagtgagaccctgtctttaaatgatgatgatgatgattattattaatattgtcttggaggatctatgtacaaggtttctgaggtcacagatttctgaggttagcaaagttgatcaatgctttacttgac

SEQ ID NO: 23213 - DNA, 301 bp, Homo sapiens
  chr18.fa.O7frz.10495339
  Located on chromosome 18
  Distance between a terminus base of telomere on chromosomal short arm and 5'-terminus of this base sequence : 8361692
  Distance between 3'-terminus of neighbour sequence of sequence listing upward to telomere on chrosomal short arm and 5'-terminus of this base sequence : 45724
taactgtaggcaactggaatactatggtaagtatttgtgtgtctaaacatggcaaaggtgcagtaaaattagagtattacaatcttatgggactgcagttgtgtatatggtccatctttcgccaaaatgtccttaagtgatgcatgactgtgtgtgtgtgtgtgtgtgtgcatgtgtgtgtgtgagaaattcaaaacgtctgtattgatataaactcattaggtgatttaaaaaaattggtttagtcaaattaaattttcaaattggttatccttttttaaatcacatgtccaatcaagta

SEQ ID NO: 23214 - DNA, 357 bp, Homo sapiens
  chr18.fa.O7frz.10613493
  Located on chromosome 18
  Distance between a terminus base of telomere on chromosomal short arm and 5'-terminus of this base sequence : 8479734
  Distance between 3'-terminus of neighbour sequence of sequence listing upward to telomere on chrosomal short arm and 5'-terminus of this base sequence : 117741
atatggactcactgaatggataaaaatatataatatagcaagacccaaccatattctgcccacaagaaactgacctcacctataaagacatatagattgaaagtgaagagatgggaaaaaataatttatgcaaaaagaaaccaaaagtcttcagtagttactatacttagacaaactagaactttaagtcaaaaaacataaaaagagacaagatcagtacataattataaagggatcaattcagcaagaggatataaataacacacacacacacacacacacacacacacacctaacactggtgcacaagatatataaagcaaatatcattagcgctaatggaagagatagactccg

SEQ ID NO: 23215 - DNA, 461 bp, Homo sapiens
  chr18.fa.O7frz.10717989
  Located on chromosome 18
  Distance between a terminus base of telomere on chromosomal short arm and 5'-terminus of this base sequence : 8612192
  Distance between 3'-terminus of neighbour sequence of sequence listing upward to telomere on chrosomal short arm and 5'-terminus of this base sequence : 132101
tctcaagaacttactaaacttgctctttaaagttcattgcagccaattggtacacaaatagttttagagtgttctattgttcttcctgagaattagactaagtaatgtgagaggagtcttaaaatgttaaatgaaaaggctcagttttaggcaatttttgagagctcatcattttcaagcacaggaaaacttttttaaaaaccttatagaagccaactggaattgaacattttaaaaattgctatggataatatacaatgtaaataataattctttgccaatttaaatggtaaattatcagaagacacacacacacacacacacacacacacacacacacacacgcacacccctcctatgaatgaaccattttctggctttggatttattctgtctttaatgagtcattttgaaatatgtgttttaatcaacagaaggagtgctaattactcacgtaactg

SEQ ID NO: 23216 - DNA, 114 bp, Homo sapiens
  DISD22_0011037
  Located on chromosome 18
  Distance between a terminus base of telomere on chromosomal short arm and 5'-terminus of this base sequence : 8714612
  Distance between 3'-terminus of neighbour sequence of sequence listing upward to telomere on chrosomal short arm and 5'-terminus of this base sequence : 101959
acatgctgtggagaatgctatatgtgtgtgtatacatatatatatatatatatatatatatatatatatatatatatatatatatattttaaatcagtagacctttccattgca

SEQ ID NO: 23217 - DNA, 428 bp, Homo sapiens
  AC021310.3_23772
  Located on chromosome 18
  Distance between a terminus base of telomere on chromosomal short arm and 5'-terminus of this base sequence : 9046315
  Distance between 3'-terminus of neighbour sequence of sequence listing upward to telomere on chrosomal short arm and 5'-terminus of this base sequence : 331589
tgaggaatctagctttaggtattaaataataagccacatcctattacagactcatggtcaactttctgataccaaaaagctcagagtgcaaactgtgccattgacacacacatcacacacacacacacacacacacacacacgcacacacactacagcattgggaagaagaaatggaagtttctgcttttcttgattaaacaaaggtatgttattcacctatgttcccaaagttcaccttgtcctcctctttcccttgccccttcccctctctcctcttcccccattccctccacctgtagagcaaagccattccccccttcccctccacggcttcataaacagatcttacccctggactctagattatacactgtcaataatgagatacgtggagtgccagccactagttaatcacttgacaggaac

SEQ ID NO: 23218 - DNA, 405 bp, Homo sapiens
  chr18.fa.O7frz.11255428
  Located on chromosome 18
  Distance between a terminus base of telomere on chromosomal short arm and 5'-terminus of this base sequence : 9132393
  Distance between 3'-terminus of neighbour sequence of sequence listing upward to telomere on chrosomal short arm and 5'-terminus of this base sequence : 85650
ctctttgagtatttgtcattaggtatttgttatacacacacacacacacacacacacacatatatatatatacatatatatatacatatatatatttttttaagatggagtgctgctctgtcacccaggctggagtgcagtggcgcaatctcagcttaccgcaagctccacctcctgggttcaagtgattctcctgcctcagcctcccgggtagctgggattacagtcgcccaccaccacacctggctaatttttgtattttagtagagatggggtttcaccatgttggccaggctggtcttgaactcctgatctcaagtgattccccagcctcagcctcccaaagagctgggattacaggtgggagccactgctcctggctggtatttgttacattaatcaaga

SEQ ID NO: 23219 - DNA, 184 bp, Homo sapiens
  D18S843
  Located on chromosome 18
  Distance between a terminus base of telomere on chromosomal short arm and 5'-terminus of this base sequence : 9185304
  Distance between 3'-terminus of neighbour sequence of sequence listing upward to telomere on chrosomal short arm and 5'-terminus of this base sequence : 52506
ccactaactagtttgtgactttggataagtaatgtagttgtctgtgcctataaatagaagtagtagtagtagtagtagtagtagtagtagtagtagtggtcactgctatatggtgagcacttactacaccagcagaaggcctcatcacagccctgaaagttatccccgttttacagatgaggac

SEQ ID NO: 23220 - DNA, 286 bp, Homo sapiens
  HUMUT1625
  Located on chromosome 18
  Distance between a terminus base of telomere on chromosomal short arm and 5'-terminus of this base sequence : 9224440
  Distance between 3'-terminus of neighbour sequence of sequence listing upward to telomere on chrosomal short arm and 5'-terminus of this base sequence : 38952
tgcgtgcatgtagtcccagctactcaggaggttgaggcagaaggatggcctggagttcaagaccagtctgagcaacacagtgagaccctgtctcaaaaaaaaaaaaagaaagaaagaaagaaagaaagaaagaaagaaagaaagaaagaaagaaagaaagaaaagaaaaaaaatagtggagaagaaaggatagacatacagatgactggaacagaatagagtcatacatatatggtgaattgactttcaacaagtttggaaagaggcaattcaatggagaaaggat

SEQ ID NO: 23221 - DNA, 385 bp, Homo sapiens
  AC008052.2_121048
  Located on chromosome 18
  Distance between a terminus base of telomere on chromosomal short arm and 5'-terminus of this base sequence : 9399364
  Distance between 3'-terminus of neighbour sequence of sequence listing upward to telomere on chrosomal short arm and 5'-terminus of this base sequence : 174638
aacagtttgtcactagtgctctactccgccctcgcagtggagagcagccatagacagtgataaatgaagctgtattctaattaaagtttgtttacaaaacaggctgtgggttgatttgtcctgagggccatggttcgccaacttctgttcttgatgagtttttgaattactttgtccattcttaccacactcacaaacacatacacacactcttttcgaatgtgtgtgtgtgtgtgtgtgtgtgtgtgtgtgtatttttttttaaggaatttggttaaaatgacatcatgcttacaaaatggtttggaagaaacatggcgtctttattacaaggtcttcccattaggcagcattaagcattattttatgctgatcttcaatgttc

SEQ ID NO: 23222 - DNA, 224 bp, Homo sapiens
  AP001531.3_92977
  Located on chromosome 18
  Distance between a terminus base of telomere on chromosomal short arm and 5'-terminus of this base sequence : 9511891
  Distance between 3'-terminus of neighbour sequence of sequence listing upward to telomere on chrosomal short arm and 5'-terminus of this base sequence : 112142
gcgataagagtgaaacttcatctcaaaaaataaataaataagatggaaagataggataaggcaggcattttgacacatgaagcctgatgcatatcttctttattattattattatcatcatcattatactttaagttctagggcatgtgtgcacaacgtgcaggtttgttacatatgtatacatgtgccatgtttgtgtgctttacctgttaactcgtcattta

SEQ ID NO: 23223 - DNA, 425 bp, Homo sapiens
  AP000921.4_47383
  Located on chromosome 18
  Distance between a terminus base of telomere on chromosomal short arm and 5'-terminus of this base sequence : 9687596
  Distance between 3'-terminus of neighbour sequence of sequence listing upward to telomere on chrosomal short arm and 5'-terminus of this base sequence : 175481
aatacaactccagtctgtacaaagcacccttcctccttggaaggtggaggctgagaactgcagatacttataaattgcccccccgccccgccacacacacacacacacacacacacacaaatacattgctatgccaatggcagtgccaaagccaggactataatccagattacccaattttctgatagaatgaatgtgtttcttatgccagctgcagcttaacatgcaaaattccttttttgtcttccagttcaatatacactatttgaagagatgttaggtaaatcccgtattttcttcagagacagaagctgaggaggctgggttgggagtgagggtttaatttgcaaccacgttagatgtcatggcccccaggctcactgctttgcagaagaacttaggtaattatcataaggaacaagtgc

SEQ ID NO: 23224 - DNA, 276 bp, Homo sapiens
  AP001088.1_57673
  Located on chromosome 18
  Distance between a terminus base of telomere on chromosomal short arm and 5'-terminus of this base sequence : 9772667
  Distance between 3'-terminus of neighbour sequence of sequence listing upward to telomere on chrosomal short arm and 5'-terminus of this base sequence : 84646
ctgcttcagtctttactttctcacaccattctcaattcagcagccacagggtcctttccaaatggaaaaccacatcatatctcttcctactcaaaacctcccattgactcctaactcattcagaatagaaggccagccaggtgtggtggtgaacacttgtagtcccagctactcaagaggctgaggggaggacagctttagccaaagaaagaagaaggaggaggaggaggaggaggaggaagaagagaagaaagctaactccttgtagtgacgtgc

SEQ ID NO: 23225 - DNA, 289 bp, Homo sapiens
  D18S464
  Located on chromosome 18
  Distance between a terminus base of telomere on chromosomal short arm and 5'-terminus of this base sequence : 9966639
  Distance between 3'-terminus of neighbour sequence of sequence listing upward to telomere on chrosomal short arm and 5'-terminus of this base sequence : 193696
gccagactttgtgccatttctccatttacacacacacacacacacacacacacacactctgcagcgcatgcagaaacagtgtggatgtgcaagcagcctgaagattccacatatgtgcttaaagcacctcatctctcttcccctagactcgttttccttctaaaattatgtgttactatgtacagtcacatgtagcaagtggcttttagggcaacatttgtctcaacaactgtcttctggccagacttgatgtctgagtcctagaacaaaccacaagagattcaggaaa

SEQ ID NO: 23226 - DNA, 311 bp, Homo sapiens
  AC006238.1_103883
  Located on chromosome 18
  Distance between a terminus base of telomere on chromosomal short arm and 5'-terminus of this base sequence : 10032732
  Distance between 3'-terminus of neighbour sequence of sequence listing upward to telomere on chrosomal short arm and 5'-terminus of this base sequence : 65804
gcatagccacaattcatactagtggagagacctcaacagagatggacccacccaagcctagcttggaacttggactcggatggaacttggactgcacagactgtgtggccccacccactggggttgaggcttcaatatatgaatttcagggggacacatttcaacccataactgcttaagatgaggctcacaggctggactgaggactcctctcagggtgcagcacataggaaaccattttattattattattattattattattattattactactattattattattagagtcagagtcttgcctgtca

SEQ ID NO: 23227 - DNA, 378 bp, Homo sapiens
  AP000876.2_49814
  Located on chromosome 18
  Distance between a terminus base of telomere on chromosomal short arm and 5'-terminus of this base sequence : 10070406
  Distance between 3'-terminus of neighbour sequence of sequence listing upward to telomere on chrosomal short arm and 5'-terminus of this base sequence : 37363
ctaaagtgctgagattacaggtatgagccaccaggcctaggctaaaatgaatatctatatctatctatctatctatctatctatctatctatctatctatcatctatctatctatctatctatctatctatctatctatctatctatattattggctagttagtgtattcatttgctaaggaaccagtaattagaagtggaagggaaattggttctaaagacaaagtcttttttttttttggttgtggtattgatttatttttccccagcacatcttaaaaatcacacatgggcatttgcttagaaaacagtacagtctaagaaaaccagtaagaggagaatctgaacacacactgatagcacggaatactgactatg

SEQ ID NO: 23228 - DNA, 242 bp, Homo sapiens
  chr18.fa.O7frz.12320190
  Located on chromosome 18
  Distance between a terminus base of telomere on chromosomal short arm and 5'-terminus of this base sequence : 10171845
  Distance between 3'-terminus of neighbour sequence of sequence listing upward to telomere on chrosomal short arm and 5'-terminus of this base sequence : 101061
tgaatgtttaaggaaatcagtaagttattttgctactgaggcaagtgaaaaaaattatagcaattttacttttgtaaatttttaaaaaagtatgcctctgtgtgtgtgtgtgtgtgtgtgtgtgtctgtgtgtctgtgtctgtgtgtgtttcagatactactagctgcctaactgatatatacttcccactagtcctatactaacagagcctgattttgagtgaggtacctaggctatacat

SEQ ID NO: 23229 - DNA, 368 bp, Homo sapiens
  AC027795.2_53754
  Located on chromosome 18
  Distance between a terminus base of telomere on chromosomal short arm and 5'-terminus of this base sequence : 10399078
  Distance between 3'-terminus of neighbour sequence of sequence listing upward to telomere on chrosomal short arm and 5'-terminus of this base sequence : 226991
gaaatgctagtttaagccagacatggtggcatgtgccttatagccttagctactcggaggctgaggcaggaggattgcttgagctcaggaggttgaggctgaagtaagctgttgattgagccattgcacttcagcctgggtggcagagtgagaccctatatctccccccccccaaaaaaaaaaaaaaaaaaaaggaagaagaagaagaagaaagaaagagagagagagaaagaaggaaagaaatgctagtttaggtgagagattcaattatatattataattagacaagaatcaacaaagtaatgactacttaatttgttcttaattaagctttttttcattcttagtcttcctagagcatgactatt

SEQ ID NO: 23230 - DNA, 215 bp, Homo sapiens
  HUMUT7520
  Located on chromosome 18
  Distance between a terminus base of telomere on chromosomal short arm and 5'-terminus of this base sequence : 10553897
  Distance between 3'-terminus of neighbour sequence of sequence listing upward to telomere on chrosomal short arm and 5'-terminus of this base sequence : 154451
tgccaacctccataatagcatgagccaattccctaaaatcaatcaatcaatctatctatctatctatctatctatctgtctatccgtctatctatctattcatctcccattagttcatgcttctctagagaaccccaattaatacaatattcagctaatattttttgccctgaatcccccactcaggatgcacacatatgggttctgactctgct

SEQ ID NO: 23231 - DNA, 337 bp, Homo sapiens
  chr18.fa.O7frz.12764897
  Located on chromosome 18
  Distance between a terminus base of telomere on chromosomal short arm and 5'-terminus of this base sequence : 10643383
  Distance between 3'-terminus of neighbour sequence of sequence listing upward to telomere on chrosomal short arm and 5'-terminus of this base sequence : 89271
aaagaaactctagattccaaagacacacatcatctctcaaaatgatgcatggattactcagggttgttcagggaaacagaacttataggagataatagatagatagatagatagatagatagatagatagatagatagatagatagaaagatagatagaaagatagaaagatagatagatagatagatagatagatagatagatagatagatagatggatagatagatagatgatagatagatagatgatagatagaaagatagaaagaaagatagatagatgatagatagaaagaaagaaagatagatagatagataggaactgattttaaggaat

SEQ ID NO: 23232 - DNA, 462 bp, Homo sapiens
  chr18.fa.O7frz.12519753
  Located on chromosome 18
  Distance between a terminus base of telomere on chromosomal short arm and 5'-terminus of this base sequence : 10781897
  Distance between 3'-terminus of neighbour sequence of sequence listing upward to telomere on chrosomal short arm and 5'-terminus of this base sequence : 138177
aacttacgctaaggcctaatcaaacatgatcagagagatgaggagacagggcaactcaaatgaaaacctttcaacagacaatagaagcagacccacagagaatctaaggaatgagattatcagacatggactttaaaagatgaatgtttaatatgttcaaggaaataaaaatcaagatttaaaaattcatcaaggaatcgaaaactaggaaaggaataaaacgaaacatttataactgaaaactataataattgatattaggaaatgaataaatagggttatcatatatgatacatctgtagaaagaactggaagaaaatctccaaattcagagaaactcagagagatagaaaataaagaaaaaaattatatatatatatatatatatatggtgaaaaagtttaacgtaggcataattggagttccagtaggatagaagagacttaatggagcagaaacaat

SEQ ID NO: 23233 - DNA, 402 bp, Homo sapiens
  chr18.fa.O7frz.13166989
  Located on chromosome 18
  Distance between a terminus base of telomere on chromosomal short arm and 5'-terminus of this base sequence : 10915719
  Distance between 3'-terminus of neighbour sequence of sequence listing upward to telomere on chrosomal short arm and 5'-terminus of this base sequence : 133360
cctgtaagtccttagaatggaggccacagccttggaaagccagaatgtaaagcctcattcttattttctcacatggtcccaggagatgacggctggatgagcactcttcagaggggagcagggaggcagcggtttatgcaagggaagggcaaatgatgcagcaacaggcgagaaataaaaattgcctgcctgcctgcctgcctgcctgcctgcctgcctgccttccttccttccttccttccttccttccttccttccttccttccttcctacctccctccctctctcccttccttctctgcttcctgtcttcctcttctctttcttctttcctctttccctcctctctctctccctctgtttttccttccatccttcctcctacatttaatgagtaactgc

SEQ ID NO: 23234 - DNA, 273 bp, Homo sapiens
  G09288
  Located on chromosome 18
  Distance between a terminus base of telomere on chromosomal short arm and 5'-terminus of this base sequence : 10915819
  Distance between 3'-terminus of neighbour sequence of sequence listing upward to telomere on chrosomal short arm and 5'-terminus of this base sequence : -302
gcactcttcagaggggagcagggaggcagcggtttatgcaagggaagggcaaatgatgcagcaacaggcgagaaataaaaattgcctgcctgcctgcctgcctgcctgcctgcctgcctgccttccttccttccttccttccttccttccttccttccttccttccttcctacctccctccctctctcccttccttctctgcttcctgtcttcctcttctctttcttctttcctctttccctcctctctctctccctctgtttttccttccat

SEQ ID NO: 23235 - DNA, 363 bp, Homo sapiens
  AC007156.2_80048
  Located on chromosome 18
  Distance between a terminus base of telomere on chromosomal short arm and 5'-terminus of this base sequence : 10986179
  Distance between 3'-terminus of neighbour sequence of sequence listing upward to telomere on chrosomal short arm and 5'-terminus of this base sequence : 70087
gttctattgctgaccttgtcactcgaagtaaaaacctttttaaaaactcacaaactccttggtaggctcttgcctgatgcctgaaatagaagacacagcaataggtcaggaagccatacaattcacggtgagcaggagaaacccatggcagatggcagcagtgatttctgtgtgtgtgtgtgtgtgtgtgtgtgtgtgtgttataaagagtacagatgaatggccaaagagatgcatagggcaaggattggggaagggtctcagagcctccatgccctgtgggtatgccacccccacagcgcctgaagacgttcaccaacctaaaagctcatcaaatctccattgctcaagaggttgatagaa

SEQ ID NO: 23236 - DNA, 205 bp, Homo sapiens
  D18S1153
  Located on chromosome 18
  Distance between a terminus base of telomere on chromosomal short arm and 5'-terminus of this base sequence : 10986247
  Distance between 3'-terminus of neighbour sequence of sequence listing upward to telomere on chrosomal short arm and 5'-terminus of this base sequence : -295
cttgcctgatgcctgaaatagaagacacagcaataggtcaggaagccatacaattcacggtgagcaggagaaacccatggcagatggcagcagtgatttctgtgtgtgtgtgtgtgtgtgtgtgtgtgtgtgttataaagagtacagatgaatggccaaagagatgcatagggcaaggattggggaagggtctcagagcctccat

SEQ ID NO: 23237 - DNA, 384 bp, Homo sapiens
  AC009890.12_141910
  Located on chromosome 18
  Distance between a terminus base of telomere on chromosomal short arm and 5'-terminus of this base sequence : 11173639
  Distance between 3'-terminus of neighbour sequence of sequence listing upward to telomere on chrosomal short arm and 5'-terminus of this base sequence : 187187
caattagaccactgtccttagaacacggaaaatattgaaaattaggtgaatgatcagtttagtggactgtgtcagactttgagtaagagatgttgactactttctttctcatcactgccatcctctacatgtgcacaaacaggccaacacacacacacacacacacacacacacacacacacggtgatgacagctcttgtgccttggggttcaatgcagctacatgtactgaacactcaccatgtccttgggtttttgctaaggatgttgtgttcatgatttcacttaatcctcataacaaccacttgatctaggtaccatcctgcatactataaagggacccactaaacagggattttactatggataaataccatgctcagt

SEQ ID NO: 23238 - DNA, 457 bp, Homo sapiens
  chr18.fa.O7frz.13732893
  Located on chromosome 18
  Distance between a terminus base of telomere on chromosomal short arm and 5'-terminus of this base sequence : 11654293
  Distance between 3'-terminus of neighbour sequence of sequence listing upward to telomere on chrosomal short arm and 5'-terminus of this base sequence : 480270
gtttaatttactcgtcaggtgacaataattattgaaaatattcctaaaatgaattttctgccattattatgaatagtgaagaaaatcgaagcctttttgggagatcaacaaaatgctgacttggtttctatgtatgcctcatgggtcatagcacccagccactagccagtgcttgcaccctctgctggccccaggactaggaggtcagggtagcctctctgatgagcctctgacctccagcctcagtagtggcagcaccccttctccatggacttccacaccaaggtccagaagcaggtgtcagagagagagagagagagagaccgagctcctcctcacagggggttgccgagggccccctgggctctgcctagaatgctcttggagaagtgcggatggagaagcagattagaggctccagtggttggttccagtgaaactaatcagagtgctagag

SEQ ID NO: 23239 - DNA, 370 bp, Homo sapiens
  AP002414.1_109301
  Located on chromosome 18
  Distance between a terminus base of telomere on chromosomal short arm and 5'-terminus of this base sequence : 11696360
  Distance between 3'-terminus of neighbour sequence of sequence listing upward to telomere on chrosomal short arm and 5'-terminus of this base sequence : 41610
ttctatttagtgcgaatcttgtgtttctgaattagggggaacgctgtgggaaaagaatgaaatatacttgtatcttttttaaggctggcttgtttgcttggtttccatgggagacatatacatacaacactatcatttgagttttgcaattcagttaaattgacctactagtgaaaattcctttacgattctatttaagattcctaaagggatttttactagtagctcaacttactctgtgtgtgtgtgtgtgtgtgtgtctactttccagtgtgtctacatctactttagtgggaattggtagaggaagcgttatagactgccaatcagaaccaatcttaaaccagaaatcctgtagtcaaggattatc

SEQ ID NO: 23240 - DNA, 339 bp, Homo sapiens
  chr18.fa.O7frz.14016556
  Located on chromosome 18
  Distance between a terminus base of telomere on chromosomal short arm and 5'-terminus of this base sequence : 11813921
  Distance between 3'-terminus of neighbour sequence of sequence listing upward to telomere on chrosomal short arm and 5'-terminus of this base sequence : 117191
acatagatctgtttcttgtgaaaccctatttatgtttctctaaaagcagatatgctcccatctttgatttgggattttgattctgcccatacacagagcttccttccctaccttatatcacctttatctcatcccgtaatagggcaaaatttctagagttcctggcatggatcaagtactctaacaagccttcctttccttcctctttctcctgactcaccatatctcacacccagctgtgtgtgtgtgtgtgtgtgtgtgtgtgtgtgtgtgtgtgtgtgagaaacatcttttttgttctaagttttgctctaaatcagtagataacatcttccatgt

SEQ ID NO: 23241 - DNA, 102 bp, Homo sapiens
  D18S1158
  Located on chromosome 18
  Distance between a terminus base of telomere on chromosomal short arm and 5'-terminus of this base sequence : 12033844
  Distance between 3'-terminus of neighbour sequence of sequence listing upward to telomere on chrosomal short arm and 5'-terminus of this base sequence : 219584
tcattagcaacaaggatctcctttcttttatatacatatttgtgtgtgtgtgtgtgtgtgtgtgtgtgtgtattcccatgttatttggcactgcatagatgc

SEQ ID NO: 23242 - DNA, 334 bp, Homo sapiens
  AC073948.2_101555
  Located on chromosome 18
  Distance between a terminus base of telomere on chromosomal short arm and 5'-terminus of this base sequence : 12056865
  Distance between 3'-terminus of neighbour sequence of sequence listing upward to telomere on chrosomal short arm and 5'-terminus of this base sequence : 22919
caactgctactttaaactgcagcaaatctctcattctgagctcacaggagtataccatttttttttctctctaagccagataagtttggtcttttctttaaagcaatagagctgaataaaataaaataaaataaaataaaataaaataaaataaaataaaataaaataaaataataaaataaaataaaataaaataaaataaaataaaatatttgaatacacattttgctacttaactgaaaaaagtctattgtaaaaacaacacaatccttcattaaaaatgtgcccttgtccggtaccattctgctgtgttaatggagctacaatgttaaag

SEQ ID NO: 23243 - DNA, 480 bp, Homo sapiens
  AC026034.3_57110
  Located on chromosome 18
  Distance between a terminus base of telomere on chromosomal short arm and 5'-terminus of this base sequence : 12239241
  Distance between 3'-terminus of neighbour sequence of sequence listing upward to telomere on chrosomal short arm and 5'-terminus of this base sequence : 182042
ttcaggtggtaatgctcactcactggctgcccacctcctgctgtgtgtgtgtgtgtgtgtgtgtgtgtgtgtgtgtgtgtgtgtgtgtatgtgtgtgtgtgtgtgtgtgtgatcaattctggtttcctcgaagatatgtttggcataaatataggaacagaggaggaggagattatgccaagaaaggtatataaaagaaaagtacaagaaagtaaagatgaaagatagtaaatatgtatatatatacacacatatattatatattgcaatataatatattgcatatatatgcaataatatatgtatattattgcatttgtgtatatatgcaatatattatattgcatatatatgcaataacatatatgtatattattgcatttgtgaataataaactcttgtgtatgactttataacattctgagttttcacactttcttcacgaaatttgttttatattgaattcctcaaacattttat

SEQ ID NO: 23244 - DNA, 233 bp, Homo sapiens
  chr18.fa.O7frz.14434145
  Located on chromosome 18
  Distance between a terminus base of telomere on chromosomal short arm and 5'-terminus of this base sequence : 12253569
  Distance between 3'-terminus of neighbour sequence of sequence listing upward to telomere on chrosomal short arm and 5'-terminus of this base sequence : 13848
gtactgtatctgcagttttagcactatgtctcagagaagtttttaaaaatacagacatccaagcctagcccagacccttaaatcagcatctctgaaggtttacatggttacctatgtttttcaaagctccatgggtgattctgatgcatggatggatggatggatggatggatagagggatagatggacggatggatgaatagatggttctccaaattcatttacctacaata

SEQ ID NO: 23245 - DNA, 196 bp, Homo sapiens
  G07986
  Located on chromosome 18
  Distance between a terminus base of telomere on chromosomal short arm and 5'-terminus of this base sequence : 12541928
  Distance between 3'-terminus of neighbour sequence of sequence listing upward to telomere on chrosomal short arm and 5'-terminus of this base sequence : 288126
tccagcaacaacaagagacagctatatttgtccaatctaggtcacctacaactttggatgtctttctttcttctatcatatatctctatctatctatctatctatctatctatctatctatctatctatctatctatccacacacacacacacacacacacacacacacacgttgtagtttggtttccactggaaa

SEQ ID NO: 23246 - DNA, 198 bp, Homo sapiens
  Z16461.1_108
  Located on chromosome 18
  Distance between a terminus base of telomere on chromosomal short arm and 5'-terminus of this base sequence : 12541955
  Distance between 3'-terminus of neighbour sequence of sequence listing upward to telomere on chrosomal short arm and 5'-terminus of this base sequence : -169
ttgtccaatctaggtcacctacaactttggatgtctttctttcttctatcatatatctctatctatctatctatctatctatctatctatctatctatctatctatctatccacacacacacacacacacacacacacacacacgttgtagtttggtttccactggaaacagactctgatatttacatgcagatagct

SEQ ID NO: 23247 - DNA, 179 bp, Homo sapiens
  D18S53
  Located on chromosome 18
  Distance between a terminus base of telomere on chromosomal short arm and 5'-terminus of this base sequence : 12541967
  Distance between 3'-terminus of neighbour sequence of sequence listing upward to telomere on chrosomal short arm and 5'-terminus of this base sequence : -186
ggtcacctacaactttggatgtctttctttcttctatcatatatctctatctatctatctatctatctatctatctatctatctatctatctatctatccacacacacacacacacacacacacacacacacgttgtagtttggtttccactggaaacagactctgatatttacatgca

SEQ ID NO: 23248 - DNA, 462 bp, Homo sapiens
  chr18.fa.O7frz.15202033
  Located on chromosome 18
  Distance between a terminus base of telomere on chromosomal short arm and 5'-terminus of this base sequence : 12776621
  Distance between 3'-terminus of neighbour sequence of sequence listing upward to telomere on chrosomal short arm and 5'-terminus of this base sequence : 234475
caggagtttgagaacagctagggcaacaaactgagaccctgtctctacaaaaattcaaaaatattagccgggcatggtacacgcctgtagtcccagttacactggaggctgaggcaggaggattgcttgagcccaggaggttgaggctgcagtgagttgtgatcacaccactgcactccagcctgggcaacagagtgagaccctgtctcaaaaaattaaataaataaattaaataaataaataaataaataaataaaatggaattcatggcagctatcaaaaacactcatattttcatcaaggcaacataacttttaaaaatctgatctgaacttaaaaatagaaaatgctgtgtgtgtgtgtctgtgtggaggacaggagagagagagcagaaatttgccacatatctttcagaaatatatagctgattgaagaaagctggtgaatacagaatctcattac

SEQ ID NO: 23249 - DNA, 299 bp, Homo sapiens
  D18S482
  Located on chromosome 18
  Distance between a terminus base of telomere on chromosomal short arm and 5'-terminus of this base sequence : 12798521
  Distance between 3'-terminus of neighbour sequence of sequence listing upward to telomere on chrosomal short arm and 5'-terminus of this base sequence : 21438
atgagtgaatgccaacttcgactaacatggaagttaggtttctcataacagtattaactcaccacatcaccaagaggaataataaaccgtgcatttaaactgcagatggaggaatgcagaattctgtttacatgctgctgttctatttctttctctttcttatttttatttttaaatcgacatcatttttttatatataaatatataaatacatatataaatatataaatataaatatatatataaatatacacacacacacacacacacacacacacagactcactctgtcagccagg

SEQ ID NO: 23250 - DNA, 339 bp, Homo sapiens
  chr18.fa.O7frz.14894790
  Located on chromosome 18
  Distance between a terminus base of telomere on chromosomal short arm and 5'-terminus of this base sequence : 12835927
  Distance between 3'-terminus of neighbour sequence of sequence listing upward to telomere on chrosomal short arm and 5'-terminus of this base sequence : 37107
cttcggtagacatcagttgtcgacaaaagacatgtgattcagtaaaaataaagttcagtggcgaaatgaatcctgaaaataatttagagaaagagaaactagagtgctgtgtttggtagcaacaagtttgtcagcggggtctgagagagagagagagagagagagagctgtcagtatggaaaagattaggctaaagagccagaaatgccaggagcccccaaaatctgactggccactgtagtttcagcatataaaagtcaaagtcgccaaaacttttaagccagagtctgctaaccaaatgtgactgaggcaggagtctcaatcgatagaggtttattt

SEQ ID NO: 23251 - DNA, 341 bp, Homo sapiens
  AP001120.3_31147
  Located on chromosome 18
  Distance between a terminus base of telomere on chromosomal short arm and 5'-terminus of this base sequence : 12889158
  Distance between 3'-terminus of neighbour sequence of sequence listing upward to telomere on chrosomal short arm and 5'-terminus of this base sequence : 52892
gcctggctaattagagtctaacatgcctggctagttagagtcaggttttcaccatgttggctaggctggtctcaaactcccgacatcaggtgatctgcccaccttggccttgaaccctggaggtgcaggttgtggcgagccaagatcatgccattgcactccagcctgggagacaagagtgaaactctgtctcaaaaaataaataaataaataaataaataaataaataaataaataaataataaaatagtctcaccatagctgattcactaagacagttcacagaggctaaattttcagttcctttgaactcagcattgactccttgaataaacagtaac

SEQ ID NO: 23252 - DNA, 398 bp, Homo sapiens
  chr18.fa.O7frz.14981185
  Located on chromosome 18
  Distance between a terminus base of telomere on chromosomal short arm and 5'-terminus of this base sequence : 12922147
  Distance between 3'-terminus of neighbour sequence of sequence listing upward to telomere on chrosomal short arm and 5'-terminus of this base sequence : 32648
tcagtttactttgaagatgcacagccttcagatcaattgagaaaagaatgcattgtataaaaaatgatagcatggatcacttctgaatgtttatcatattaaaatgcagtttggttcacatttgcattatttagggctgcttttcctaatcacttggatggcagtattgcttatgcaaaagagtgacatcaatcttagttttctctcatttttcagaatatacatttctttaaaatatttggtcatttcataaagcatgtttcaaaggaaaagtatttgttaagcttctcagaaagtcattttcatttttgttacagtgcaccagaagtgagtgtgtatgtgtgtgtgtgtgtgtgtgtgtgtgtgtgtatgtgtattcatcaataacagtctttcaa

SEQ ID NO: 23253 - DNA, 368 bp, Homo sapiens
  AP001542.2_22445
  Located on chromosome 18
  Distance between a terminus base of telomere on chromosomal short arm and 5'-terminus of this base sequence : 13056996
  Distance between 3'-terminus of neighbour sequence of sequence listing upward to telomere on chrosomal short arm and 5'-terminus of this base sequence : 134451
cattgatgccaaatcttagaccacatggttcgtgcggggaaagtggcttccaggaggctgatgaccacagtggataatacaccaaacaccagaacatgggacgcttctttctttctttccttcttttctttcttttcttttctttctttctttctctttctttctttctttttctttcttctttctttctttctttctttctttctttctttctttctttctttctttcctttctttcctttctttcctttcttccctccttcccttctttatttctctctctctccttccttccttcccttccttctttcttttctttttcttttctttcttttcttttttttgagatggaatctcactcttgtcac

SEQ ID NO: 23254 - DNA, 97 bp, Homo sapiens
  DISO7_10004340
  Located on chromosome 18
  Distance between a terminus base of telomere on chromosomal short arm and 5'-terminus of this base sequence : 13478594
  Distance between 3'-terminus of neighbour sequence of sequence listing upward to telomere on chrosomal short arm and 5'-terminus of this base sequence : 421230
gcagtacagcagtctagggtcagaatactgaagatacacacacacacacacacacacacacacacacacacagagatgtatctgatgcctgcagaaa

SEQ ID NO: 23255 - DNA, 297 bp, Homo sapiens
  HUMUT5231B
  Located on chromosome 18
  Distance between a terminus base of telomere on chromosomal short arm and 5'-terminus of this base sequence : 13802196
  Distance between 3'-terminus of neighbour sequence of sequence listing upward to telomere on chrosomal short arm and 5'-terminus of this base sequence : 323505
ttacaggtgtgattactggcgcccagcctttggtattatatttattcaataaagtatttaattagtgctaaaaaaaaaaaaaagaaaattgaatttgtttccttaaatatccttaggttaagatgttagttttcataaaacattgagaagcctctgccaatttcaataaagacctgacttggaaaaaatatatatgtatacacacacacacacacacacacacacacacacacacacatataattcctatataatttatatttttgttgctgtgttgagtgggatgattcccctttg

SEQ ID NO: 23256 - DNA, 147 bp, Homo sapiens
  D18S453
  Located on chromosome 18
  Distance between a terminus base of telomere on chromosomal short arm and 5'-terminus of this base sequence : 13802340
  Distance between 3'-terminus of neighbour sequence of sequence listing upward to telomere on chrosomal short arm and 5'-terminus of this base sequence : -153
gagaagcctctgccaatttcaataaagacctgacttggaaaaaatatatatgtatacacacacacacacacacacacacacacacacacacacatataattcctatataatttatatttttgttgctgtgttgagtgggatgattcc

SEQ ID NO: 23257 - DNA, 88 bp, Homo sapiens
  D18S1114
  Located on chromosome 18
  Distance between a terminus base of telomere on chromosomal short arm and 5'-terminus of this base sequence : 13811604
  Distance between 3'-terminus of neighbour sequence of sequence listing upward to telomere on chrosomal short arm and 5'-terminus of this base sequence : 9117
atcagtataatgatggatgaatcacaaatacacacacacacacacacacacacacacacacacacacacacgtgaccctcttgcctca

SEQ ID NO: 23258 - DNA, 394 bp, Homo sapiens
  chr18.fa.O7frz.16363530
  Located on chromosome 18
  Distance between a terminus base of telomere on chromosomal short arm and 5'-terminus of this base sequence : 13825574
  Distance between 3'-terminus of neighbour sequence of sequence listing upward to telomere on chrosomal short arm and 5'-terminus of this base sequence : 13882
acaaatgacgcttgttcacactgagactgacttactttttctttcttcctttctttctttctttctttcttttctttctttctttctctctttctttctctctctctctctctctctctctgtctctctctctctctctctgtctgtctgtctctctctctctttttctttttaagacagagactcactctgtcacccaggctggagtgcaatggcacgatcttggctcactgcaaccttcgcctcctgggttcaagagattcttctgcctcagcctcctaagtagctgggattacaggtgcctgacaccacacccagctaatttttgtatttttagtagagatggggtttcaccatgttggtcaagctggcctcaaagtcctgatcttaggtg

SEQ ID NO: 23259 - DNA, 322 bp, Homo sapiens
  AP001198.3_30345
  Located on chromosome 18
  Distance between a terminus base of telomere on chromosomal short arm and 5'-terminus of this base sequence : 14257600
  Distance between 3'-terminus of neighbour sequence of sequence listing upward to telomere on chrosomal short arm and 5'-terminus of this base sequence : 431632
tggatcacgaggtcagtagtttaagaccagcctggccaaaatggtgaaaccctgtctctactaaaaatacaaaaaaattagctgggcatggtggtgggcacctgtaatcccagttactggggaggctgaggcagataattgcttgaacctgggaggcagaggttgcagtgagtcgagatctcaccactgatctccagcctgggcgacagagcagactctgtctcaaacaaacaaacaaacaaacaaacaaaaacaccaaccaaacaaaaaaacctctgggatatggcaaaggcagaataagaggaaagttcatagccttaaa

SEQ ID NO: 23260 - DNA, 136 bp, Homo sapiens
  D18S73
  Located on chromosome 18
  Distance between a terminus base of telomere on chromosomal short arm and 5'-terminus of this base sequence : 14279923
  Distance between 3'-terminus of neighbour sequence of sequence listing upward to telomere on chrosomal short arm and 5'-terminus of this base sequence : 22001
cccagcaatcaacctttaagagtctatcctataaaaatgagagaatcagtggcgtgtgtgtgtgtgtgcgtgtgtgcgggtgtgtgtgtgtgtgtgtgtgtgtatgaaagtttattgcagcattgttgcagtggca

SEQ ID NO: 23261 - DNA, 128 bp, Homo sapiens
  DISO7_10006960
  Located on chromosome 18
  Distance between a terminus base of telomere on chromosomal short arm and 5'-terminus of this base sequence : 14358426
  Distance between 3'-terminus of neighbour sequence of sequence listing upward to telomere on chrosomal short arm and 5'-terminus of this base sequence : 78367
gccctgaacctacctgagtagaatttaattctattttattttattttattttattttattttattttattttattttattcaaattttaaaaagcacaaaggtcttaccccacctactgagatcatcc

SEQ ID NO: 23262 - DNA, 456 bp, Homo sapiens
  AP001010.3_140993
  Located on chromosome 18
  Distance between a terminus base of telomere on chromosomal short arm and 5'-terminus of this base sequence : 14710062
  Distance between 3'-terminus of neighbour sequence of sequence listing upward to telomere on chrosomal short arm and 5'-terminus of this base sequence : 351508
tgttatttggaggtcctagaaccaatcccctgagggtaccaagggacagctgggccttgctgtttgtcattctcctgtgagtgtagtcactgtcagacaatcactcctgtttgaacatctctgagtaggatgagaacatttttctttggggtctataaggctgtgggcagggttttgacagcagtaaacacgccaaaggcagaggctttcctgagacagtccctagccgatatccacagaaggcacaatcacacacacacacacacacacacacacacacacacacagcatagctgtcttctctgctgcgtacacttggaactctaacgttagtctagagctctggcctctctggcttggccctggaagttgcccccaagggcagctccggagagcatggctgcccagacccagggaccaccctgaggggctggctggtcaaatgactctactgaa

SEQ ID NO: 23263 - DNA, 371 bp, Homo sapiens
  AP001525.2_156535
  Located on chromosome 18
  Distance between a terminus base of telomere on chromosomal short arm and 5'-terminus of this base sequence : 14927069
  Distance between 3'-terminus of neighbour sequence of sequence listing upward to telomere on chrosomal short arm and 5'-terminus of this base sequence : 216551
aattagtggttatggttgcacaactctgtgaatatactaagaaaacactgtattataaactttaaaagggtgaatttttattatgtggagtatatctcaaataactgttgttaaaaagaatcaagatgtgaaaagtttttgattttatattagctacaactataaaagggagaatgaaataaacattgagaatccactatatgtttttaacttggcctatacatagagatgatgatgatagatagatagatagatagatagatagatagatagatagatagatagacagatacatacatacatacatacatacacccatatatgcatacacacataatcatttactccttacaccagtcctatgaagtagg

SEQ ID NO: 23264 - DNA, 89 bp, Homo sapiens
  Z67649
  Located on chromosome 18
  Distance between a terminus base of telomere on chromosomal short arm and 5'-terminus of this base sequence : 14963456
  Distance between 3'-terminus of neighbour sequence of sequence listing upward to telomere on chrosomal short arm and 5'-terminus of this base sequence : 36016
ggaggttcatattcaagaagtgcatgaaaagtgtgtgtgtgtgtgtgtgtgtgcatatattgggggaagggtagataggtatcttcaga

SEQ ID NO: 23265 - DNA, 220 bp, Homo sapiens
  Z67345
  Located on chromosome 18
  Distance between a terminus base of telomere on chromosomal short arm and 5'-terminus of this base sequence : 15047379
  Distance between 3'-terminus of neighbour sequence of sequence listing upward to telomere on chrosomal short arm and 5'-terminus of this base sequence : 83834
ataaatctctgtgtctcacctctgctcactcatctttctccttaaaaagattctgatatttcctggaaatttttcaatagttttggaagagaaatgagaaatagaagcatgtgtgtttgtgtgtgtgtgtgtgtgtgtgtgcgtgcatgtgtgtgtgagagagagagaggatgtatcaatatcaaactaaagtttgattagtgacaggtgaccttttgtt

SEQ ID NO: 23266 - DNA, 398 bp, Homo sapiens
  AC006557.2_80051
  Located on chromosome 18
  Distance between a terminus base of telomere on chromosomal short arm and 5'-terminus of this base sequence : 15226554
  Distance between 3'-terminus of neighbour sequence of sequence listing upward to telomere on chrosomal short arm and 5'-terminus of this base sequence : 178955
tgccagcaatgataaatattacatgatgatcaaactgctgataaattcaggtttgtctattacaacagctaattttacgttaactgtaacaaaaatatattgaagaaaagtttgcatggaaatttttatttttatatttatttatttatttatttatttatttatttatttatttattttgagatggagtctcactctgtcgcccaggctggagtgcagtggcacaatctcggctcactgcaacctccgcctcctgggttcaagcaattctcctatctcagcctctcaagtagctgggactacaggcacttgccatcacgcccagctaatgtttgcatttttagtagaggcaaggtttcaccatattggtcaggctggtcttgaacttctgacctcag

SEQ ID NO: 23267 - DNA, 404 bp, Homo sapiens
  AC006557.2_24613
  Located on chromosome 18
  Distance between a terminus base of telomere on chromosomal short arm and 5'-terminus of this base sequence : 15281974
  Distance between 3'-terminus of neighbour sequence of sequence listing upward to telomere on chrosomal short arm and 5'-terminus of this base sequence : 55022
tcatcttcatgacaggaggtagtgttgcaatgtggagttagacacctgctgaaggcagccttctactctcctacagaaactgtgggaaagggtgtataaacttgctaattacatttcaaagcaatagttcccaggtcctagattaagacaattctgagtcaaacacacacacacacacacacacacacacacacacaaaaccaaatgacctatttaactgataaaaatgatttacatatatttcaaagaagtagagaaaggttttcaaactaaatgctttaagaaaagaagagcaaaaattcttccctcattttaaagagaaagcattaagccttttctttctaatttgtatttgctcctacaacagccgggtctaaaggcttggtcttgaactcattaacatc

SEQ ID NO: 23268 - DNA, 458 bp, Homo sapiens
  chr18.fa.O7frz.17693378
  Located on chromosome 18
  Distance between a terminus base of telomere on chromosomal short arm and 5'-terminus of this base sequence : 15354631
  Distance between 3'-terminus of neighbour sequence of sequence listing upward to telomere on chrosomal short arm and 5'-terminus of this base sequence : 72253
aactttagaggctttctgctagtgttactacactgatgatctgaagccaatcagacgttctagtgagcaagactgtgtgtgcatgtgtatgtatgggtgtgtgtatgtgtgtgtatgtgtgtttgtggcatctttgactattaaaaatgaggaaagtaattattcatttataactgttagacacagtcttttaaaacggtgattttgagactttttggtgttaaggtttttaaaacatgattgcatagtggctaccaacatcataagttggtcgtttttcatttcaatgcccttttgaaatctttaactatattgtgatgctcagaaataatatgcagaattttttgtgtcctaaaatggtatgtgagtggttatacactttacatactattctgccactttctttggtgtattttgtattatattttccagatgtatccacattgacatgattatct

SEQ ID NO: 23269 - DNA, 324 bp, Homo sapiens
  M18_15477387
  Located on chromosome 18
  Distance between a terminus base of telomere on chromosomal short arm and 5'-terminus of this base sequence : 15477230
  Distance between 3'-terminus of neighbour sequence of sequence listing upward to telomere on chrosomal short arm and 5'-terminus of this base sequence : 122141
catccttgatgctcacctccatggatgcctcaccaactgtgacacttggagagctggcagccatcactcaagaaatcagaacacagtggcctctaccgcagcatcagggaacaaaaactaagcctgtcagctctcaagaaacatacttatgtgtatgtatatatatatatatatatatatgacataaatttattcagttactttgagatatctcattgctaaacagataaaatgaattaaaactagtgcaaatttctggcaacagtatttcatctccccattatttatccagggcattgaaaattggcacacatcacagatcct

SEQ ID NO: 23270 - DNA, 317 bp, Homo sapiens
  chr18.fa.O7frz.17984591
  Located on chromosome 18
  Distance between a terminus base of telomere on chromosomal short arm and 5'-terminus of this base sequence : 18681432
  Distance between 3'-terminus of neighbour sequence of sequence listing upward to telomere on chrosomal short arm and 5'-terminus of this base sequence : 3203878
atttattggccatttgtaattccctgtatattttaccttatgtgtacaagatattattctgagaagggtccagacttcaccaaacttccaaagggatatatgatgtatttgtatatgcacacacacacacacacacaaacacacacacagagctaagaatccctggagtggggatcaagagcaccgtaattgaaactggattgcctgatttgaatctagcttttcaccattttccaggtttgtggcttggggaatgttaattagcttctctattctaattttctcatcatcttgtaagcagagtttgtaagttacca

SEQ ID NO: 23271 - DNA, 126 bp, Homo sapiens
  DISD22_0011077
  Located on chromosome 18
  Distance between a terminus base of telomere on chromosomal short arm and 5'-terminus of this base sequence : 18864831
  Distance between 3'-terminus of neighbour sequence of sequence listing upward to telomere on chrosomal short arm and 5'-terminus of this base sequence : 183082
ctacttgggtcagcctgcctgggcctgtttgtgtgtgtgtgtgtgtgttgtgtgtgtgtgtgtttgcatgtttgttactttttttttcctcattacttttctatttcttacccactcaatgagctg

SEQ ID NO: 23272 - DNA, 473 bp, Homo sapiens
  chr18.fa.O7frz.18402797
  Located on chromosome 18
  Distance between a terminus base of telomere on chromosomal short arm and 5'-terminus of this base sequence : 18999795
  Distance between 3'-terminus of neighbour sequence of sequence listing upward to telomere on chrosomal short arm and 5'-terminus of this base sequence : 134838
caggtgacaatttatagctgattcatatgaccctgttgactcaagccagtaccccaaagctatttcccatttaatgagacaaaaatctcacctgagagtgccatactagctgtgaattttcatcagattcttagagatgactgcgactttccgccttctcctcccatcaatatttagaactcttgaatcatagttcaattatcaatcaagttctctagagaaacagggatataacttgttcagtgattttggcttatgctaagggctaagccagtcagaaaagaaaacagaggaaccaaagtaatatattcaagcaatatactcaaaaccagtcgaagaagaagctgaaggaggaagtctgtggggtttatttttatttatttatttatttatttatttatttatttgagacagagtctcacccttcacccaggctggagtgcagtggcgcaatctcagctgactgtaagctc

SEQ ID NO: 23273 - DNA, 123 bp, Homo sapiens
  DISO7_10006972
  Located on chromosome 18
  Distance between a terminus base of telomere on chromosomal short arm and 5'-terminus of this base sequence : 19517029
  Distance between 3'-terminus of neighbour sequence of sequence listing upward to telomere on chrosomal short arm and 5'-terminus of this base sequence : 516761
agctattgctaatcatctgcacctttctgttgtagttattttaaagcccgcccgcgcgcgcgcgcgcacacacacacacacacacacacacacacacactcttgagtcagggtctctgtcacc

SEQ ID NO: 23274 - DNA, 101 bp, Homo sapiens
  DID22N_0014101
  Located on chromosome 18
  Distance between a terminus base of telomere on chromosomal short arm and 5'-terminus of this base sequence : 19728868
  Distance between 3'-terminus of neighbour sequence of sequence listing upward to telomere on chrosomal short arm and 5'-terminus of this base sequence : 211716
tcagagaatgaccacaatcaggaaataataataataataataataataataatatgggcttaactagtgaagatttgaaagtaagtcaaggcagtactcta

SEQ ID NO: 23275 - DNA, 101 bp, Homo sapiens
  DISO7_10006978
  Located on chromosome 18
  Distance between a terminus base of telomere on chromosomal short arm and 5'-terminus of this base sequence : 19842093
  Distance between 3'-terminus of neighbour sequence of sequence listing upward to telomere on chrosomal short arm and 5'-terminus of this base sequence : 113124
aatggcttagtacctggcacaaaatgtttcctagaatgaatgaatgaatgaatggcttttctaaacagttaacagcaagcattgtatgctgagggctcctc

SEQ ID NO: 23276 - DNA, 480 bp, Homo sapiens
  AP001352.3_110697
  Located on chromosome 18
  Distance between a terminus base of telomere on chromosomal short arm and 5'-terminus of this base sequence : 20213144
  Distance between 3'-terminus of neighbour sequence of sequence listing upward to telomere on chrosomal short arm and 5'-terminus of this base sequence : 370950
gagtttacttgcattgacatctctgacaccatcttaaccatttaaagcatctgcagacgctatctctgcgtgcccacattcatcccctcccttgctaacccagaggattgcattggctctgcttgctaagccctaacactcaagctgcccggggtggactgtccacagaggccatcctcactccccctacgcaatgatgaattgtcccccaagtgtgatggaccaatttcaggagccaaagaaccaaaacccgaagaacttagtaatcctgcaacaacaacaacaacaagaagcaaactccaagtattatccagggtcaggtcgaggcatggagatactccaggctcatgtgtgtgttggaattcccgctgagcccttcagccgtcctcgctgagttttcagtctgtaatgtcttacagatttcggggctggcctctgacagctctgacatatctgaactaaggctaacctcagctagtt

SEQ ID NO: 23277 - DNA, 352 bp, Homo sapiens
  chr18.fa.O7frz.22516130
  Located on chromosome 18
  Distance between a terminus base of telomere on chromosomal short arm and 5'-terminus of this base sequence : 20280985
  Distance between 3'-terminus of neighbour sequence of sequence listing upward to telomere on chrosomal short arm and 5'-terminus of this base sequence : 67361
ggtcttgaactcctaacttcaggtgatccgcccgccttggcctcccaaagtgctgggattacaggtgtgagccactgcgcctggcctaggaccctgattctttaaaaacaacaacaacaacaacaacaaaaatggtctttgtaaaaatttttaaatgtcaaaaaaaattggcttaccatcatggctgataaatgaggaatgctgaaagttcaagctgttggttttatatatatatatatatataaaattatatataaatgtatatatataaataaataaatacatatatataaaatgatctaagtttatcatttatctttgggagttagtcactgttcaagtcagtttctag

SEQ ID NO: 23278 - DNA, 278 bp, Homo sapiens
  AP001352.3_50475
  Located on chromosome 18
  Distance between a terminus base of telomere on chromosomal short arm and 5'-terminus of this base sequence : 20346477
  Distance between 3'-terminus of neighbour sequence of sequence listing upward to telomere on chrosomal short arm and 5'-terminus of this base sequence : 65140
tatgcctgcagttctagctacttgggaggctgaggcaggaggatacattgagctcaggagtttgagggtgcagtgagcaataattgcatcactgtaccctagcctgggtgacacagtgagcccccatctcttaaaaaacaaacaaacaaacaaacaaacaaacaaacaaaaaactaaaaagaaatcatgttggttgctgtgttgagaatgaattgtacttgagaaaaatggaaactggaagatcaaatggaagactattgaatcattccaagtaagaa

SEQ ID NO: 23279 - DNA, 438 bp, Homo sapiens
  chr18.fa.O7frz.22420315
  Located on chromosome 18
  Distance between a terminus base of telomere on chromosomal short arm and 5'-terminus of this base sequence : 20372302
  Distance between 3'-terminus of neighbour sequence of sequence listing upward to telomere on chrosomal short arm and 5'-terminus of this base sequence : 25547
gccacgtaaaggtaagataaacactaaatttaagagagtgggacatccttatggtgaagggagtggagagcacgattggtggaagtacaccaggggcatttaagtattttggtaatgttctgtgattaaacctaccccatggtgagtgcataggtgttaaacacacacacacacacacacacacacacacacacaaaattttattttttttgagacagtctccctctgtggtccaggctggaatgcagtggtgtgacctcggctcactgcaacctccgtcccccaggttcaagcaattctcctgtctcatcctcctgagtagctggaattacaggcatgcaccaccacacctgactaacttttgtatttttggtagagacggggtttcaccatgttggccaggctggtctcgaacacctgacctcaagtgatccatag

SEQ ID NO: 23280 - DNA, 306 bp, Homo sapiens
  chr18.fa.O7frz.22799377
  Located on chromosome 18
  Distance between a terminus base of telomere on chromosomal short arm and 5'-terminus of this base sequence : 20445286
  Distance between 3'-terminus of neighbour sequence of sequence listing upward to telomere on chrosomal short arm and 5'-terminus of this base sequence : 72546
gatcttcatgagtctgcttataaggaaaggaagaggcctcccaagcaacaggtcccagacattcctactccacatacggattgaatgtttattaagttctgacaacatgcaggactgaaaatttctctaggcatttatgagggtcatgctgttaaaatgagataaagaatgaaatatgtttgatatcattatacagacgtatacataactctgtgtgtgtgtgtgtgtgtgtgtgtgtgtgtgtgtgtatactcttttttgttttattttattttcttttttgttgtatggagtcagaaagatcta

SEQ ID NO: 23281 - DNA, 297 bp, Homo sapiens
  AC022487.4_92297
  Located on chromosome 18
  Distance between a terminus base of telomere on chromosomal short arm and 5'-terminus of this base sequence : 20488914
  Distance between 3'-terminus of neighbour sequence of sequence listing upward to telomere on chrosomal short arm and 5'-terminus of this base sequence : 43322
agtgcaagtatagctaatgcatacaaacaaattcttaaatttattgtgaaatattttgtacatataaaatgaataacataatatatgtggcataaaaattggcatgcatctgtagtcccagctactcgagggactgaagtaggaggatcacttgagtccaggatttcaaggccagctggacaacatagtgagaccccgtatcacacacacacacacacacacacacacacacacatacaaatttaatatgatgactgcaagtgatttttatgtgttaaaaacgatttcaaggcctag

SEQ ID NO: 23282 - DNA, 265 bp, Homo sapiens
  AC022487.4_124381
  Located on chromosome 18
  Distance between a terminus base of telomere on chromosomal short arm and 5'-terminus of this base sequence : 20558258
  Distance between 3'-terminus of neighbour sequence of sequence listing upward to telomere on chrosomal short arm and 5'-terminus of this base sequence : 69047
gtcaggtttaaaggcctagtcaatgattacatatttttattatttacctagtaaaaattcccttgagagggagagagaaagaggagagaaagaaagagagagagagagagagagagagagagacaggtgcttgattctccacctccaaattttagggtctattcagagcttttgtggccatgtggggacatctgtgatctctggcttctgggctgggctcactcagagcagggcaatccaatggtaggcctaagacttgtagacc

SEQ ID NO: 23283 - DNA, 107 bp, Homo sapiens
  DISD22_0011111
  Located on chromosome 18
  Distance between a terminus base of telomere on chromosomal short arm and 5'-terminus of this base sequence : 20839138
  Distance between 3'-terminus of neighbour sequence of sequence listing upward to telomere on chrosomal short arm and 5'-terminus of this base sequence : 280615
tggacttctccatctcccttcccccaacacacacacacacacacacacacgcacgcacgcacacacacacacacacaaagcgacacgtgccagggagcagaggatac

SEQ ID NO: 23284 - DNA, 397 bp, Homo sapiens
  chr18.fa.O7frz.23517432
  Located on chromosome 18
  Distance between a terminus base of telomere on chromosomal short arm and 5'-terminus of this base sequence : 21006457
  Distance between 3'-terminus of neighbour sequence of sequence listing upward to telomere on chrosomal short arm and 5'-terminus of this base sequence : 167212
attccttctaagaaccagaaatagacaaggatgcccactctcaccactcctagttaacatagtactggaaatcctagccagagctatcaggcaagagaaataaataaaatgcatctaaattggaaaagaggaagttaaattatctctgttcactcatgacattatcttacacccagaaaaccctaaagactctcaaaaagattcctaggcttgagaaatgagtttggtaaggtttcagggttcaaaatgaatatgcaaacatctgtaacatttctatacatgaataatgttcaagctgaaagacaaattaagaactcaatcccatttacaatagccacacacacacacacacacacacacacacacacacaaatacctaggagtacatctaaccaag

SEQ ID NO: 23285 - DNA, 397 bp, Homo sapiens
  AC017066.3_49270
  Located on chromosome 18
  Distance between a terminus base of telomere on chromosomal short arm and 5'-terminus of this base sequence : 21189831
  Distance between 3'-terminus of neighbour sequence of sequence listing upward to telomere on chrosomal short arm and 5'-terminus of this base sequence : 182977
ggtagaaatcagttcaggaaacacaaatagtggctcatgaggtaggaaaattaggaaagccaaatgatgaaagtgttttaaggaaaacatatcaattctactaaaggctgctctgtcattttctctcaggtctggtgtgggacattctctcgcctcataattgatgttttctcctcagatggttgtttgttattcaacctaggggcttgtatataagaaacagtcataatgggttactcatggttctaattgtgtgtgtgtgtgtgtgtgtgtgtgtgtgtgtgtgtgtgtgtgtgtgtaattatagcccgatagagatagaatgggaaaatcatagactatggaaccagtcctagctctaccatttccagctctaccatttccatacagctatatg

SEQ ID NO: 23286 - DNA, 469 bp, Homo sapiens
  chr18.fa.O7frz.23646114
  Located on chromosome 18
  Distance between a terminus base of telomere on chromosomal short arm and 5'-terminus of this base sequence : 21204621
  Distance between 3'-terminus of neighbour sequence of sequence listing upward to telomere on chrosomal short arm and 5'-terminus of this base sequence : 14393
ggttacttgagcatttgttagtattctattttagtttcttattatttcactttgggctgtgtgtgtgtgtgtgtgtgtgtgtgtgtgtatgtgtgtggtgatgactgttacagtaaacaaacttaaactttctcagcatgctttgaatcaatatttgccactttaaatgtgatgtagaaattcttccaagatccctttaccttccatccttcatgttgtatttgccttatatattacttctatatgcattgaaaacccatcagataatgttatagttttggttttcaatgatcaaatatacttcaaacaccttaaaaggagaagaacagtctattatatttgcccaaatatttgctatttatattgctcttccttcattcctcatgctccatatttccttctggtgtcatttcctatctgaaaattttcatttcgtaattcttttagatcaggactgtttgtagtgaac

SEQ ID NO: 23287 - DNA, 446 bp, Homo sapiens
  AC021145.4_29298
  Located on chromosome 18
  Distance between a terminus base of telomere on chromosomal short arm and 5'-terminus of this base sequence : 21292403
  Distance between 3'-terminus of neighbour sequence of sequence listing upward to telomere on chrosomal short arm and 5'-terminus of this base sequence : 87313
caagacaattgagctccacaagtgtgatcttcctaaacttgcttttttctttctcaaccctacgaattaggcaaaaccatttgcagttaaaaatacaacctgaggccagatagggtggctcatatctgtaacctcaacgctgtgggaggcccgcgggaggctcacttgagatttgagaaactgcagtataggctgaatgacagccagaacctgtctcttaaacacacacacatacacacacacacacacacacacacacacccgcctgtctcttcacacacacacacacacacacacacacacacacacacacacacacctgcccaaacaatccagttgcttctcacctttgtgtccaccctggttcaagctaccatcaacctcttctacggcaatatcctcctttaaaaaaaaaaaaaaatctgttatccactctgttctccatt

SEQ ID NO: 23288 - DNA, 188 bp, Homo sapiens
  D18S869
  Located on chromosome 18
  Distance between a terminus base of telomere on chromosomal short arm and 5'-terminus of this base sequence : 21491749
  Distance between 3'-terminus of neighbour sequence of sequence listing upward to telomere on chrosomal short arm and 5'-terminus of this base sequence : 198900
gagtgaatgctgtacaaacagcaaactttacagggaaaaagttgatatttatagatactcatttataccccagggcaagacagacagacagacagatagatagatagatagatagatagatagatagatagatagatagatagcaatatattgatatctgtttatccattgagtcaaacaaataaaca

SEQ ID NO: 23289 - DNA, 434 bp, Homo sapiens
  AP001126.3_15694
  Located on chromosome 18
  Distance between a terminus base of telomere on chromosomal short arm and 5'-terminus of this base sequence : 21579284
  Distance between 3'-terminus of neighbour sequence of sequence listing upward to telomere on chrosomal short arm and 5'-terminus of this base sequence : 87347
gaacagcaatttataggattgtagtgagatttaggagtaatgtctgtaatacacatagtacactagcctggcaaatagtgggcgctcaataatggagatgttataatctcttttcagcttttatacctttaagtttctaaaaatgttgcattcagacattcatacacacacacacacacacacacacgttaaaatatgaacaggaagaaaagcaaaaggaaaatatcaacatattaataatgactagtttcagatgaaccactgtacaaacaaaaaataaaataaactttaaaaaataactgcagggtcataataatttttagcatccaggtaataactaataaatgtattcatctcatgttcccctcttctcctgaccagatgtgagcatggttaggcttttgtttgaagtatttacacctttgatcttgaca

SEQ ID NO: 23290 - DNA, 430 bp, Homo sapiens
  chr18.fa.O7frz.24231523
  Located on chromosome 18
  Distance between a terminus base of telomere on chromosomal short arm and 5'-terminus of this base sequence : 21725037
  Distance between 3'-terminus of neighbour sequence of sequence listing upward to telomere on chrosomal short arm and 5'-terminus of this base sequence : 145319
gtagaagcaaggtttctgaaactttcgagaattgctatgtttatgaatatagtgctcacgttctctctctctctctgtctctctctctatatatatctatatatagatatatatagattagatatatagatatatataattagatatatagatatatacacagatatagatatagatatagatatatattgccccaacaaaggacagccggactgcttcagcagaagcaagtgcatctctcagggtccctcagcctggcacctcatccttgagggcacctccataaaaggatggagttggatggttggccataaggaaggcccagaaggtgctaacacggatgagctgacatggacctcagggtcctgcttctctccaagtgactctgtcccacccacagtgaaagtcaaagttgctaagcctgaagtga

SEQ ID NO: 23291 - DNA, 384 bp, Homo sapiens
  chr18.fa.O7frz.24354741
  Located on chromosome 18
  Distance between a terminus base of telomere on chromosomal short arm and 5'-terminus of this base sequence : 21937099
  Distance between 3'-terminus of neighbour sequence of sequence listing upward to telomere on chrosomal short arm and 5'-terminus of this base sequence : 211632
aagaatagagtggtttcctcagggaagtagaaacagttgatttttgggtttttagagtcagggtctcactgttgctcaggctgaggtgcagtggcacaatcatggctcactgcagcctcgaactcctggcctcaagtgatcctcctgccttggcctcccaaagctttttgattacaggcatgagcaactgtgcccggcctccatctgtattttctacaacatcttaaatcttcttagatttataaaggaaagaaaggtttgttttaataacaacaacaacaacaacaacaacaaattacccactcactttttttctagtttgccctgacaagaaatgatgttttgtgttagtgatgaaatggagtcgaagatgcaaacacttat

SEQ ID NO: 23292 - DNA, 323 bp, Homo sapiens
  chr18.fa.O7frz.24452500
  Located on chromosome 18
  Distance between a terminus base of telomere on chromosomal short arm and 5'-terminus of this base sequence : 22040973
  Distance between 3'-terminus of neighbour sequence of sequence listing upward to telomere on chrosomal short arm and 5'-terminus of this base sequence : 103490
attgctagctggataaagatagtaaatattgacccttgcaatcaagttaaaaaaaatacatgtatgtatgactatttgtgtatacttggatgcacgcacacacacacacacacacacacacacacacacacatagtaatttcaactcaaaggcagaatcattaggaataacctagtttttaagcgagtaaaaattactggctcagccaggcatggcagctcactcctgttatatctgttatcccaacactttgggaggccaaggagggaggatctcttgagcccaggagtttgagaccagcctgagcaacataaactccatta

SEQ ID NO: 23293 - DNA, 361 bp, Homo sapiens
  chr18.fa.O7frz.24683425
  Located on chromosome 18
  Distance between a terminus base of telomere on chromosomal short arm and 5'-terminus of this base sequence : 22240623
  Distance between 3'-terminus of neighbour sequence of sequence listing upward to telomere on chrosomal short arm and 5'-terminus of this base sequence : 199327
atagttaggaagttccactgaatatattttctgtattttatttatttttttcattgaaacatactcagagagatgttttctgtattttaaattaaattaaaattttttttagagacagggttttattatgttgcccaggttggtctcaaactcctgggctcaagctcaagcgatcctttcagcttgctccctgcttcccagagtgctaggattataggtatgagccagcgtgtccagccctggtctctctctctctctctctctctctcccttatttatttattttttttttagacagagttttgttcttgccacccaggctggagtgcaatggtgtgatctctgctcactgcaacttctc

SEQ ID NO: 23294 - DNA, 386 bp, Homo sapiens
  chr18.fa.O7frz.24787761
  Located on chromosome 18
  Distance between a terminus base of telomere on chromosomal short arm and 5'-terminus of this base sequence : 22305765
  Distance between 3'-terminus of neighbour sequence of sequence listing upward to telomere on chrosomal short arm and 5'-terminus of this base sequence : 64781
tcaaacgttacctagaaacaagatgaaacttgtggattaaaggggacaaaagagacctgacgactcactgccatatgtaatccttgattaaattccgaaatgggaaaataatacaatggggattattgagaggatcagggaaatttgaatatggacaatgtattaaatacaattttgaatatatggtaaaatttcttacacatgaaaatgttgaatttatgtagaagaaatatccatgttcttggaagataacatgctgaagtatttaggaggaaagtattatgatgtctgtaacttcctttcaaagaatcaaaaatgtgtgtgtgtgtgtgtgtgtgtgtagagaacaaaaaaatatggtatattgttaacagttggtgaatcta

SEQ ID NO: 23295 - DNA, 276 bp, Homo sapiens
  chr18.fa.O7frz.24898032
  Located on chromosome 18
  Distance between a terminus base of telomere on chromosomal short arm and 5'-terminus of this base sequence : 22485469
  Distance between 3'-terminus of neighbour sequence of sequence listing upward to telomere on chrosomal short arm and 5'-terminus of this base sequence : 179318
  misc_feature (1)...(276): n = A,T,G or C
gaacagagtaagactgtcaagaaagaaaagaaagaaagaaagaaaagagagaaataaagaaagaaagaaaaaggaaaggaaaggaaaaaagaaaagaagagaagaggaagggaagggaggagggaggggggagggnnaggaaggaaggaaggaaggaagggagggaggaagggaggaaggaaggaagaaaggaaggaaaggaaggaagaaataatgcaataggaaatattaagaaactcctccctcattcaaaaaattggaaattacatggatctt

SEQ ID NO: 23296 - DNA, 143 bp, Homo sapiens
  DISO7_10004347
  Located on chromosome 18
  Distance between a terminus base of telomere on chromosomal short arm and 5'-terminus of this base sequence : 22639956
  Distance between 3'-terminus of neighbour sequence of sequence listing upward to telomere on chrosomal short arm and 5'-terminus of this base sequence : 154211
gcagttggctgaaagagcatttgtgtatgtttgtgtgtgtgtgtgtgtgtgtgtgtgtgtgtgtgtgtgtttaataaccagttttgttagagccgtagtgcaaacccaggaacattggtttctttctctgtacacagcacggg

SEQ ID NO: 23297 - DNA, 391 bp, Homo sapiens
  AC016185.4_139689
  Located on chromosome 18
  Distance between a terminus base of telomere on chromosomal short arm and 5'-terminus of this base sequence : 22897480
  Distance between 3'-terminus of neighbour sequence of sequence listing upward to telomere on chrosomal short arm and 5'-terminus of this base sequence : 257381
cttctagactttggcagaagtaggccaggcatggtggctcacacctgcaatcccagcactttgggaggccaaggcaggcagatcacctgagatcaggagttccagaccaacctggccaacatggtgaaaccctgtctctactaaaaatacaaaaattagctgggcgaggtggtacttgcctgtaatcccagctacccgggaggctgaggcaggagaatcgcttgaaccaggaggcagaggttgtagtgagccgagatcgtgccactgcactccagcctgggcaacagagagagactctgtctcaaaaataaaataaaataaaataaaataaaataaaataaaataaaatagactttggcagaagtaaaagtgagcaataaatcacgtagtc

SEQ ID NO: 23298 - DNA, 124 bp, Homo sapiens
  D18S480
  Located on chromosome 18
  Distance between a terminus base of telomere on chromosomal short arm and 5'-terminus of this base sequence : 23158958
  Distance between 3'-terminus of neighbour sequence of sequence listing upward to telomere on chrosomal short arm and 5'-terminus of this base sequence : 261087
tgggcgagccaattccttgtaataaatctctttattggagatgtatatatatatgtgtgtgtgtgtgtgtgtgtgtgtgtgtgtgttagatttctctggggaacccctcagactttgtaataaa

SEQ ID NO: 23299 - DNA, 235 bp, Homo sapiens
  D18S1108
  Located on chromosome 18
  Distance between a terminus base of telomere on chromosomal short arm and 5'-terminus of this base sequence : 23163045
  Distance between 3'-terminus of neighbour sequence of sequence listing upward to telomere on chrosomal short arm and 5'-terminus of this base sequence : 3963
ctgtcacatggtcctctgtgtgtgtgtgtgtgtgtgtgtgtgtgtgtgtgtgtgcgcgcgcgcgcttgcgcgcacatgcatctattctcttcttagaaggaccctggtcatcttcgattagggttcatccaaatccagtatgattacatccacaaaaactctatttccggatagggtcacatacacaggtactggagattagggactcaacatatctttttggaggacacagttc

SEQ ID NO: 23300 - DNA, 118 bp, Homo sapiens
  D18S1107
  Located on chromosome 18
  Distance between a terminus base of telomere on chromosomal short arm and 5'-terminus of this base sequence : 23194027
  Distance between 3'-terminus of neighbour sequence of sequence listing upward to telomere on chrosomal short arm and 5'-terminus of this base sequence : 30747
caaaaaatgacaaaggtacttgtattacaaaaggttctccagagaaatacaactcaataggatgtgtgtgtgtgtgtgtgtgtgtgtgtgtgtttgtgtttgtattctattgggttct

SEQ ID NO: 23301 - DNA, 157 bp, Homo sapiens
  G08009
  Located on chromosome 18
  Distance between a terminus base of telomere on chromosomal short arm and 5'-terminus of this base sequence : 23568237
  Distance between 3'-terminus of neighbour sequence of sequence listing upward to telomere on chrosomal short arm and 5'-terminus of this base sequence : 374092
gttgtatgcctagcactgcatttgtaacaataatactaaccagtgcctatatagcacatctatctatctatctatctatctatctatctatctatctatccatctatctacctatcatcatatatctatgctaggtgccaggcttattttatgaggt

SEQ ID NO: 23302 - DNA, 204 bp, Homo sapiens
  DISO7_10007044
  Located on chromosome 18
  Distance between a terminus base of telomere on chromosomal short arm and 5'-terminus of this base sequence : 23702334
  Distance between 3'-terminus of neighbour sequence of sequence listing upward to telomere on chrosomal short arm and 5'-terminus of this base sequence : 133940
tgtttccattgatacactattggggatgattgggatcatatttaaattatatattgatttaaagaaaatttacatttctatgtttagctctcttgcccagaacaaagtacaaagatccattttcaaggtctgtgtgtgtgtgtgagtgtatgtgtgtgtgtgtgtgtgtgtgtgtgttttagttatggtaacactaattgccaa

SEQ ID NO: 23303 - DNA, 448 bp, Homo sapiens
  AC027229.2_8262
  Located on chromosome 18
  Distance between a terminus base of telomere on chromosomal short arm and 5'-terminus of this base sequence : 23938468
  Distance between 3'-terminus of neighbour sequence of sequence listing upward to telomere on chrosomal short arm and 5'-terminus of this base sequence : 235930
ttgaatcaggtaaatcactaagtctttttgctttttttctttccttccttccttcctccttccttccttctttcctccttccttccttcctccctccttccttctttcctccttccttccttcctccttccttccttcctccctcccttcctcttcctttcctttcctttctttttctttcttttcttttctttctccttccttccttccttcctttctttctctctctctttctctttctctctttccttctttctttccctatgcatcctagtttgctaagggcagctgggatttccacctagaattccattcaattggtaccctctttcactcccaatgtgtcctgtgagatgttgagttgctaggttcaattttgtgatatcttctaactggtctctcatctcaaagctttccctgagtgtatgctactggaaaggattaatct

SEQ ID NO: 23304 - DNA, 126 bp, Homo sapiens
  Z67716
  Located on chromosome 18
  Distance between a terminus base of telomere on chromosomal short arm and 5'-terminus of this base sequence : 23970356
  Distance between 3'-terminus of neighbour sequence of sequence listing upward to telomere on chrosomal short arm and 5'-terminus of this base sequence : 31440
actgactaaggtgtcactaactagcaagtcattttatcactgaaggcttgttttcctttcttgtgaagtgtgtgtgtgtgtgtgtgtgtgtgtgtgtttgtgtatgtgtatgtgtgtgctttggga

SEQ ID NO: 23305 - DNA, 303 bp, Homo sapiens
  AC007768.2_25950
  Located on chromosome 18
  Distance between a terminus base of telomere on chromosomal short arm and 5'-terminus of this base sequence : 24326214
  Distance between 3'-terminus of neighbour sequence of sequence listing upward to telomere on chrosomal short arm and 5'-terminus of this base sequence : 355732
actcttaactgtcatgctactcagttgtatatatctcttttttgtatttcaaggacacactcaggtttaagggtagtacacatagtccctaaccctcgatcagaggagtgtccaaggatatgcagatttgcagccacccttaactattaccctagttgattaaagatgtgtgtgtgtgtgtgtgtgtgtgtgtgtgtgtgtaaatttagctcatccagccaactgcctagctagtgcttataaggagaatctgggtattttattacatgacaatctctgatcttgactcagagtcaaacttac

SEQ ID NO: 23306 - DNA, 464 bp, Homo sapiens
  AC007768.2_13109
  Located on chromosome 18
  Distance between a terminus base of telomere on chromosomal short arm and 5'-terminus of this base sequence : 24410039
  Distance between 3'-terminus of neighbour sequence of sequence listing upward to telomere on chrosomal short arm and 5'-terminus of this base sequence : 83522
tgaagttgtctaattgaaaggaaggggtttatttgttggcgaagaagaaaagtcgtcagtgaaattttcaaacttaccactgtaacatcttttatttatttatttatttatttatttagagacagagtctcactctgtcgtccaggctggagtgcaatggcaccatctcaacttaccgcaacctctgcctcctgggttcaagagattctcctgtctcagcctcctgagtagctgggattacaggcgcctgccaccacgtctggctactttttgtatttttagtagagatggggttttgccatgttggccaggctggtcacgaactcctgactcagtgatccacctgccttgacctcccaaagtgctgggattacaggcatgagccagcacacccagcctgtaatatcttttgtttgtaaaatgccaaataaagagaaataaactctagaactatcttgaaaggc

SEQ ID NO: 23307 - DNA, 112 bp, Homo sapiens
  DISD22_0011129
  Located on chromosome 18
  Distance between a terminus base of telomere on chromosomal short arm and 5'-terminus of this base sequence : 24581482
  Distance between 3'-terminus of neighbour sequence of sequence listing upward to telomere on chrosomal short arm and 5'-terminus of this base sequence : 170979
ttcatggtagctacagacgcaaaactagggtgtgtgtgtgggtgtgtgtgtgtgtgtgtgtgtgtctctgtgtgtgtgtgtgtgtgtgtagggacgttaatgatgtgattga

SEQ ID NO: 23308 - DNA, 252 bp, Homo sapiens
  D18S66
  Located on chromosome 18
  Distance between a terminus base of telomere on chromosomal short arm and 5'-terminus of this base sequence : 24982958
  Distance between 3'-terminus of neighbour sequence of sequence listing upward to telomere on chrosomal short arm and 5'-terminus of this base sequence : 401364
agagcaagtccctgcctcgcgggccgcctccggctccttagggaaacacaagacacacagacacacacacacacacacacacacacacacacacacacaccacgctctcatccgcccggctctccgcggagaaccgtccgggaatcgtccccgaggtgcggcgcgggaggtggccggctttgttcacaatgcactgcccgccgcacccgccctggacacgtgcagaaaggcgtgctcgtttctccgaggctg

SEQ ID NO: 23309 - DNA, 333 bp, Homo sapiens
  DISO7_00030387
  Located on chromosome 18
  Distance between a terminus base of telomere on chromosomal short arm and 5'-terminus of this base sequence : 25089223
  Distance between 3'-terminus of neighbour sequence of sequence listing upward to telomere on chrosomal short arm and 5'-terminus of this base sequence : 106013
ctcccagtaccactcaggatacacacacacacacacagacacacacacgcacacataccgcatagtcaaggatttgcttgaaagcagccagttctattatctaaaaggtaatacatttgtaccaaattactcctgcctactgcggtgcaccttttagcgaagaagccagtgccactgggatcctggacagttctggtgtgccattctccacgtacaaagccaacggccccatttgcgactttgctaacttagttggcttccgcccagccgaaccccgaagcacagtcactgaaaacgttttgataccagaaaatcatttccacgacagtgcaa

SEQ ID NO: 23310 - DNA, 437 bp, Homo sapiens
  AP001275.3_31188
  Located on chromosome 18
  Distance between a terminus base of telomere on chromosomal short arm and 5'-terminus of this base sequence : 25211687
  Distance between 3'-terminus of neighbour sequence of sequence listing upward to telomere on chrosomal short arm and 5'-terminus of this base sequence : 122131
tagaatcttgcagccaactctggaagggttggccagggtttcatatgggagtttgcattcttcaggcggggccaagtagttggcacctatacaacaaaagcattccctaatgggaagctacatctttggcttctttgatgtatgcctttctgtctcggttatcccaagattttattagctaaggcaattttgtaaaaaaacaaaacaaaaagaaaacaaacaaagaacaataagaacaccaaggaaacatactatggtgttaaacacacagacacacagacacacacacacacacacacacacacaccccactacttaccttgtaaccagaacccaacaactaacatcttagtaccttcttcagatggctcttgcattcagaaataattttacctttgactaatcacattttgaagttactcttcatgtaaaccagt

SEQ ID NO: 23311 - DNA, 347 bp, Homo sapiens
  AC010854.3_65957
  Located on chromosome 18
  Distance between a terminus base of telomere on chromosomal short arm and 5'-terminus of this base sequence : 25277154
  Distance between 3'-terminus of neighbour sequence of sequence listing upward to telomere on chrosomal short arm and 5'-terminus of this base sequence : 65030
aaattaataggccaggcatggtggctcatgcctgtaatcccagcactttgtcaggctgaggcgggcagatcacctgaggtcaggagttcaagattggcctggccaacatggagaaaccctgtctctactaagaatacaaaaattagccaggcatggtggcacacacctgtagtcccagctactcggggggctgaggaagaagaatcacttgagcctgggaggcagaggttgcagtgagctgagattgcaccactgcactccagcctgggtgacagagtgagtcttggtctaaataaataaataaataaataaataataaataaatgtctggaggtaggattgttaat

SEQ ID NO: 23312 - DNA, 291 bp, Homo sapiens
  AC010854.3_69829
  Located on chromosome 18
  Distance between a terminus base of telomere on chromosomal short arm and 5'-terminus of this base sequence : 25281165
  Distance between 3'-terminus of neighbour sequence of sequence listing upward to telomere on chrosomal short arm and 5'-terminus of this base sequence : 3664
caggaaggtgatagttatgatcagtcctatttttataaatgcaaatcttggtcctcttattgaaagaaagagaaagtactgaaaatagtcattctatccaatcattccccgaagctgttggcagtgtaacaatgttacagtttggcccaaacacacacacacacacacacacacacacacacacacacacacaccacttttattttgttttatttttaaaaagcccatctttcaactctataggctgatttagggtaagtgatcaaacactagctcaagtgattgctgaac

SEQ ID NO: 23313 - DNA, 164 bp, Homo sapiens
  DISO7_10004348
  Located on chromosome 18
  Distance between a terminus base of telomere on chromosomal short arm and 5'-terminus of this base sequence : 25434362
  Distance between 3'-terminus of neighbour sequence of sequence listing upward to telomere on chrosomal short arm and 5'-terminus of this base sequence : 152906
tccacagcctacagaaacagtcttaaagcctttttcattgtacagcactttctctccatcatttatttgttttgtctatctatctatctatctatctatctatctatctctctatctatctattattctatctatccaaccatcctttatcatataccaccatg

SEQ ID NO: 23314 - DNA, 110 bp, Homo sapiens
  DISO7_10007085
  Located on chromosome 18
  Distance between a terminus base of telomere on chromosomal short arm and 5'-terminus of this base sequence : 25481162
  Distance between 3'-terminus of neighbour sequence of sequence listing upward to telomere on chrosomal short arm and 5'-terminus of this base sequence : 46636
atacctgtgagggactcagacactttcttgccttcataattgtgtgtgtgtgtgtgtgtgtgtgtgtgtgtgttcatgatcaggctttaaaaggttcccagagaatgcaa

SEQ ID NO: 23315 - DNA, 426 bp, Homo sapiens
  AC009872.4_105724
  Located on chromosome 18
  Distance between a terminus base of telomere on chromosomal short arm and 5'-terminus of this base sequence : 25718394
  Distance between 3'-terminus of neighbour sequence of sequence listing upward to telomere on chrosomal short arm and 5'-terminus of this base sequence : 237122
ataatgatggaccgtttcttaccaaatattttattaattaactcacgaagcttggcctgttcagtcagtatagacactatgttccggtgccttggatgtgattagcaagatgtgattcctttaaataatgagctcaaaacacatattaaatttagaagtggtaagcttacaggaaaaagaaagatctgctgggagtgaataaaaggaaaaagaaaaaatggctttgtgatttctatcaatggtgtgcatgtgcgtgtgtgtgtgtgtgtgtgtgtgtgtgtgtgtacgtgtacttgaaagagagagagaatgcaggcaacaggcaagctggtaagaaatttgatgaaatagagaatatgtcaatgatgtatcctaagaaaaaatatagaatttgagggcacagagtaattctaaatccacctccaa

SEQ ID NO: 23316 - DNA, 466 bp, Homo sapiens
  AC068408.3_71869
  Located on chromosome 18
  Distance between a terminus base of telomere on chromosomal short arm and 5'-terminus of this base sequence : 25927608
  Distance between 3'-terminus of neighbour sequence of sequence listing upward to telomere on chrosomal short arm and 5'-terminus of this base sequence : 208788
tctcaccatagcttgttaaataactattttcctgctgaaaatatgtttaacttttaccaacttagcaaaagtggatctgatagcaattctcagagcaggtctctaatttggtaaatagcccacagaggtattttatttacatgtttcaaatcctttttcaaaaagtaaggtctacgtcaataaaatggagggataatttttacacacacacacacacacacacacacacacacacacacacactctcagactttatctctaagaagaatatggtggccatgagaatgcatttcacaaatcacagagcataattttctgatggctttcacttctgtattctgaagtttatctccacattctgactgaggctatggcttccaccggctgcacccagcctgtgcctgatcgcatcagggatgctaaagcaggcccattcctgatacatgtagaactcctttgacgatga

SEQ ID NO: 23317 - DNA, 419 bp, Homo sapiens
  AP001030.3_26073
  Located on chromosome 18
  Distance between a terminus base of telomere on chromosomal short arm and 5'-terminus of this base sequence : 26069461
  Distance between 3'-terminus of neighbour sequence of sequence listing upward to telomere on chrosomal short arm and 5'-terminus of this base sequence : 141387
tgaccattatactgattccaacttaatcttccctgaacttctgctctcctatcagcataccatatatttcctctaaaaaagcacatacattttctgacttttcccttccttcaatatactaataaagttgattttctcttccctctttcttctctcctcctctccctctctttctccattctctttcaatacacacacacacacacacacacacacacacacacactacatataatatagttcatatatatgctactgacagcttttagctttctttcttgcaatcttatttaacttcatagatccatcatagttaatgaccttcaaaattgtgatgcccaaccattggtttaatgttcaaaggtcaagagcacacaagcatatcctgcaagatagtgattgaaatgacctttaataga

SEQ ID NO: 23318 - DNA, 390 bp, Homo sapiens
  AP001030.3_57801
  Located on chromosome 18
  Distance between a terminus base of telomere on chromosomal short arm and 5'-terminus of this base sequence : 26089499
  Distance between 3'-terminus of neighbour sequence of sequence listing upward to telomere on chrosomal short arm and 5'-terminus of this base sequence : 19619
gaatccttgaggaattaaatctagaatgaaaaaaatcacactcaatcaatgcccagactagtctgagtttatcttacatgttccacttcataggtgtgtgtgtgtgtgtgtgtgtgtgtgtgtgtgtgtttggaaagtttcaggttgatcagctttacatgtcactgaaagatgcattcaaaataatcaagagctttaagtgtaatgcaaacgcaagtgtcattggaatgacaatgatctcagcatgctatctctgtgggatatctatagtcatttcctcctaagtacacatgcatccgttccagggtcttgaatgatacaaagtcagtgcttcctcaggtaagcaaatgtttccacagtgtttccgtttctatagaattgtcatgctgg

SEQ ID NO: 23319 - DNA, 247 bp, Homo sapiens
  D18S478
  Located on chromosome 18
  Distance between a terminus base of telomere on chromosomal short arm and 5'-terminus of this base sequence : 26095348
  Distance between 3'-terminus of neighbour sequence of sequence listing upward to telomere on chrosomal short arm and 5'-terminus of this base sequence : 5459
ggaccaactcagtgttccacagtaactcatatgtgtgtatatatgtgtgtgtgtgtgtgtgtgtgtgtgtgtgtgtacttattatggttcttagtgatgttcttctcttctgtcaccatggaaattgacatcaaattattttcaatgtatttctgaaaggagaatgagtgcttctagcacataatagaggtattcataccatttaataaaactgaccacagtgctaatggaaatctacttgatgatg

SEQ ID NO: 23320 - DNA, 157 bp, Homo sapiens
  Z67226
  Located on chromosome 18
  Distance between a terminus base of telomere on chromosomal short arm and 5'-terminus of this base sequence : 26127447
  Distance between 3'-terminus of neighbour sequence of sequence listing upward to telomere on chrosomal short arm and 5'-terminus of this base sequence : 31852
tgtgcatcagaaagacatcatcctttgtattgtgacacacacacacacacacacacacacagagatgttactttagcaatgatcttcataattaattatttaggaaatttttgtctcttcctattgactcttttatatttgaatagtctgcgttcca

SEQ ID NO: 23321 - DNA, 215 bp, Homo sapiens
  D18S1151
  Located on chromosome 18
  Distance between a terminus base of telomere on chromosomal short arm and 5'-terminus of this base sequence : 26129789
  Distance between 3'-terminus of neighbour sequence of sequence listing upward to telomere on chrosomal short arm and 5'-terminus of this base sequence : 2185
aaggctgatctgagcctatacatatgtgtgtgtgtgtgtgtgtgtgtgtgtgtatgtctatatatatataacatatataagtgcgtgtgtgtgagagtgtgtgtgtgtgtgtatgtgtgtatttttcaacctcaggaaattcacaacatgctgctttttcaaggccagcagagcctcatacacattctaatcaagagttgtatcacctttgccat

SEQ ID NO: 23322 - DNA, 169 bp, Homo sapiens
  DISO7_10004350
  Located on chromosome 18
  Distance between a terminus base of telomere on chromosomal short arm and 5'-terminus of this base sequence : 26277803
  Distance between 3'-terminus of neighbour sequence of sequence listing upward to telomere on chrosomal short arm and 5'-terminus of this base sequence : 147799
tgggtcatggaagatttgggaatttggacttttttaggtgggaaataatttgtttgcttaaaatttctaaactacacacacacacacacacacacacacacacacacacacacactcacaaagggacaaacgataatgagaaaactatatcagaaaggtcaactgttgt

SEQ ID NO: 23323 - DNA, 238 bp, Homo sapiens
  DISD22_0011149
  Located on chromosome 18
  Distance between a terminus base of telomere on chromosomal short arm and 5'-terminus of this base sequence : 26500644
  Distance between 3'-terminus of neighbour sequence of sequence listing upward to telomere on chrosomal short arm and 5'-terminus of this base sequence : 222672
cttgtaattatattcgaattcatggatttaggccaggtgtggtggctcacacctgtaatcccagcgctttggaaggttgaggatggaggatggcttgaccccaggaggctgaggctgcagtttgttatgattgtgccactgcactccagcctgagcaacagagagagaccctgtctcttaaaacacacacacacacacacacacacacaaacacacactcgtggatttagttgccatt

SEQ ID NO: 23324 - DNA, 468 bp, Homo sapiens
  chr18.fa.O7frz.29325116
  Located on chromosome 18
  Distance between a terminus base of telomere on chromosomal short arm and 5'-terminus of this base sequence : 26578860
  Distance between 3'-terminus of neighbour sequence of sequence listing upward to telomere on chrosomal short arm and 5'-terminus of this base sequence : 77978
aatagaaacaggttaaacctcaaggaggaaacagttttatgaaagactgtttttcagaactgctgatttaatttagcattaaaaatatatatgagggctgggtgcagtggctcagacctatagtcccagcaatttgggaggccaaagcaggcaattacttgagcccaggagttcgagaccagcctgggcaatatggcaaaactccgtatctaccaaaaatacaaaaattagccaggcatggtggcgcacacctgtattcccagctactcaggaggctgaagtgggaggattcctttagcctgggaggtggaggctacagtgagctgtgattgcatcactgcactccagcctgggtgacagtgagaccttgtctcaagtgtgtgtgtgtgtgtgtgtgtgtgtgtgtgtgtgtgtgtctatgtgtgtgtatgaaatgtgcctgttctgagtgctataaaggactcataa

SEQ ID NO: 23325 - DNA, 449 bp, Homo sapiens
  AP001145.3_53799
  Located on chromosome 18
  Distance between a terminus base of telomere on chromosomal short arm and 5'-terminus of this base sequence : 26672269
  Distance between 3'-terminus of neighbour sequence of sequence listing upward to telomere on chrosomal short arm and 5'-terminus of this base sequence : 92941
gaacatttgacagaatcttcacacagaacatcaatcactgcagtggtgattttatattaagatctgacctagaaaaagcccttgatttttttcctgtactctccatcttatgtttttatgagaaaaccaaaatattatggaagacatttagaagaaaattggtccattttgagagagggagaaaattaaggataaaagagagaagatactgttcaaaaagcatttgtggtgtgtgtgtgtgtgtgtgtgtgtggcctgaaatagtgtgatcctacagctcagttaaaatttcatcttacctactattttccactaatttgcaagctagcatcccatttccatctttctaaattacttaacgatgtcattaaaaatatttccatactattctctgcaatagatattactccccttcaccttattttcttatttctcaataaacatccaaa

SEQ ID NO: 23326 - DNA, 467 bp, Homo sapiens
  AP001145.3_128735
  Located on chromosome 18
  Distance between a terminus base of telomere on chromosomal short arm and 5'-terminus of this base sequence : 26706700
  Distance between 3'-terminus of neighbour sequence of sequence listing upward to telomere on chrosomal short arm and 5'-terminus of this base sequence : 33982
ctttaacaaatgccaaatgtattattgtgtgtatatatgtcaccacatatacaaaatccaggggacaaaataaagcaagacctctttccacaaaacacatagaaaagtaaatttcaggtaagtaaaatatgtatatgtgaaaacacaaacagataagtaatatctgacatagtgtgacgtttgaggaagctgtctttggaggtggacaggtctcaatttatatgactgcttacctaccaaagaggagtaattcagacacactcatatatatatatatatatatatatgtctgtattttaattatgaagaatcaagacttatgaaaataaggaatcacaatcttgacagtatctattatatatgcaaatactaaaaaaagtaacctgtctttccaaatgctttattttgcaccctaaaatgttatacgcaatctgcaaaataatccactgttatcgacgtttgagtac

SEQ ID NO: 23327 - DNA, 194 bp, Homo sapiens
  chr18.fa.O7frz.29458920
  Located on chromosome 18
  Distance between a terminus base of telomere on chromosomal short arm and 5'-terminus of this base sequence : 26712776
  Distance between 3'-terminus of neighbour sequence of sequence listing upward to telomere on chrosomal short arm and 5'-terminus of this base sequence : 5609
cacctttcatgacataaagtaatcaatcaattattgattgacacttcatatcagactgtactcagtgttgcaggagactcatatgtatatagcagtcctcaacatacatttggggtgtgtgtgtgtgtgtgtgtgtgtgtgcgtgtgtgtatgcaatccaagggcttgggggctgtaagtacagttggaagcag

SEQ ID NO: 23328 - DNA, 456 bp, Homo sapiens
  chr18.fa.O7frz.29560246
  Located on chromosome 18
  Distance between a terminus base of telomere on chromosomal short arm and 5'-terminus of this base sequence : 26814047
  Distance between 3'-terminus of neighbour sequence of sequence listing upward to telomere on chrosomal short arm and 5'-terminus of this base sequence : 101077
ctagcatatgatccagcaaacccacttctgggtatacatccaaaggagatgatatcagtatcttgaagacatatctgtaccccatattcattgcagcactattcgtaatagtcaaatgataaagataatctgtgtctgttgacagatgaataaagaaattgtgatacatacacacacacacacacacacacacacacacaccctgattgcaacagacttcaaaaataagaaagtcttgccattggtgacaacatagatgacttggaggacatcatgataagtgaaataaaccaggcacagaaagacaaatcctgcatgatctcacttatatgtggaatcaaaagaagttgaaagctgagagtagaatggtgtttgccaggggctagaaggtggagaaatgaggagatactcatcaaagggtacaaatatttagttattcaggatgaataagttctg

SEQ ID NO: 23329 - DNA, 229 bp, Homo sapiens
  AC069494.2_95263
  Located on chromosome 18
  Distance between a terminus base of telomere on chromosomal short arm and 5'-terminus of this base sequence : 26843802
  Distance between 3'-terminus of neighbour sequence of sequence listing upward to telomere on chrosomal short arm and 5'-terminus of this base sequence : 29299
gtattaaccttgaatgtaaatggattaaattctccacttaaaagatatagattggtggaatggataaaacagtaaataaataaactatgtgctgcatacgagaaactcaccttaattttataaaacgtatttatttatttatttatttatttatttattttttaaaagtttattttaagttcagggtacatgttcagatgttcaggtttgttacataggtaaacaggtg

SEQ ID NO: 23330 - DNA, 203 bp, Homo sapiens
  DISD22_0011156
  Located on chromosome 18
  Distance between a terminus base of telomere on chromosomal short arm and 5'-terminus of this base sequence : 26971693
  Distance between 3'-terminus of neighbour sequence of sequence listing upward to telomere on chrosomal short arm and 5'-terminus of this base sequence : 127662
aagtgagttccactgaaccctaatcaaaggaaatatttgacatgaagtttttgttacaaatacatttggaaaatgcactcactaatatatttaaatccctaggatacacacagacagacacacacacacacacacacacactcttacagaacttttcccaaatttatctaacattaatcttgcactttatctataatccaaca

SEQ ID NO: 23331 - DNA, 474 bp, Homo sapiens
  chr18.fa.O7frz.29850958
  Located on chromosome 18
  Distance between a terminus base of telomere on chromosomal short arm and 5'-terminus of this base sequence : 27091824
  Distance between 3'-terminus of neighbour sequence of sequence listing upward to telomere on chrosomal short arm and 5'-terminus of this base sequence : 119928
aaagtttcttgaaggactgaagcttccatcaggctatatacatagtttgtatacacacacacatccccctctatatacatacatagttatatatatatatatatatatatatttatttatttaaatatatatatttaaatatatatttatatatatttaaatatatatatatttatatatatatttaaaatacacacacacagttttagtgagaaaaaaactggcttaacaggcaaagcattaaacctggtgctagttcctttgacattccctcattttgcactttttgtatacaaacaattgttcaagatgtaaacaaccttctcaaaattagcccacagaaaataaagtacatggagatgattttggacacaaatagccatattagttcttagaaaatggctgtttgcaaatgtaacattcacaattatgagcagaaagtaattagatgttaatgtctctgagcagttacag

SEQ ID NO: 23332 - DNA, 365 bp, Homo sapiens
  chr18.fa.O7frz.30077114
  Located on chromosome 18
  Distance between a terminus base of telomere on chromosomal short arm and 5'-terminus of this base sequence : 27339517
  Distance between 3'-terminus of neighbour sequence of sequence listing upward to telomere on chrosomal short arm and 5'-terminus of this base sequence : 247219
cttctgtagaattctcattgctagtaggaaatgtttatttttccctgtgaattcttaatgaagtataaacattacacacacacacacacacacacacacacacaaaagaaaaacactggcaaacttaaagccaagctactactaatatataagtaattttatacataaacttactcagaaagtagaaaacaaaaactattgttcctccagctatctaaattttcagacacttattttgaaattataatcttagaatttgtttagagagacaccaatggattaattaaaagatccaaacacagccaaaagtatacatttagttttagaattgccattttttcatgcttgaagtaaataacagtcat

SEQ ID NO: 23333 - DNA, 448 bp, Homo sapiens
  chr18.fa.O7frz.30148460
  Located on chromosome 18
  Distance between a terminus base of telomere on chromosomal short arm and 5'-terminus of this base sequence : 27455294
  Distance between 3'-terminus of neighbour sequence of sequence listing upward to telomere on chrosomal short arm and 5'-terminus of this base sequence : 115412
  misc_feature (1)...(448): n = A,T,G or C
taagcaattaacgtggagttaaccttatgcagtgggcttgatggagatctgaaaaaagtttcccagccaagataagtggacattctgccagacaacccagtagtaatgtgttggtccttctcaacatattatctctcaaaagatagtaaagagaaatatagcttattactgatgcggcttgtaagtaaattataaactgtttcttcatgctggagaaagacaatggttctctggttgatgctcaaggtctctcaataatatgttgctcctctttctcactcctcacctcatgaaatctttttatccaacctaggactgtacacacacacncacacacacacacacacacagaactcatattttttctctcataatttggctttggaatattaaatttaagtatcccgttgcattgattttttttatgtccacaatattgcacctagta

SEQ ID NO: 23334 - DNA, 304 bp, Homo sapiens
  chr18.fa.O7frz.30220603
  Located on chromosome 18
  Distance between a terminus base of telomere on chromosomal short arm and 5'-terminus of this base sequence : 27527413
  Distance between 3'-terminus of neighbour sequence of sequence listing upward to telomere on chrosomal short arm and 5'-terminus of this base sequence : 71671
  misc_feature (1)...(304): n = A,T,G or C
acctaacataggaaatcctcagaaaagaagttaataggaatattaaaagaaattgtaagttcctggcattgtcatggctcttccaggggcagaagaggtgaaaacgtagccatgcttgggtaaatatgtacttcggctgtctccaacgtttttggcaccagggactggtttcatggaagacattttttctgcagatatgtgtgtgtgtgtgtgtgtgtgtgtgtgtgtgtgtgtgttggcagnnggggaggggttgnnnatgattcaagaacattacatttatcattagattctcataaggagc

SEQ ID NO: 23335 - DNA, 429 bp, Homo sapiens
  AP001108.2_34884
  Located on chromosome 18
  Distance between a terminus base of telomere on chromosomal short arm and 5'-terminus of this base sequence : 27569116
  Distance between 3'-terminus of neighbour sequence of sequence listing upward to telomere on chrosomal short arm and 5'-terminus of this base sequence : 41399
ttattgcagaaatagaccaaacattgtgttatgggcttccatcaattttcttttttagtctattgaaaaaattgatgatttttctcatattctaaattgagaaaatagaaacatgaagaaattaagttgtttcattgaaggtacgcaattccaatgggcttcaaatccaaggagtgaggtatcaaacacagaaaatagatacatattagatagatagatgatagatagatagatagatagatagatagatagatagatagatgctaaataaatgctttttccaaataaaatatctaggttttccttacttcaaaagattatcgctaatgtgtcttaaaacagagccattgaacaatctctcctgcaatggaactgcccttacatgattcacacacacttggagtggtagtttaatgactgtcttcagct

SEQ ID NO: 23336 - DNA, 418 bp, Homo sapiens
  chr18.fa.O7frz.30306116
  Located on chromosome 18
  Distance between a terminus base of telomere on chromosomal short arm and 5'-terminus of this base sequence : 27609838
  Distance between 3'-terminus of neighbour sequence of sequence listing upward to telomere on chrosomal short arm and 5'-terminus of this base sequence : 40293
ccaaatctatttcaagactatgactttaattatcttctagacactattgatactcagatcctagaacagtgtttgacacacagtagatagccaatttctatttgttcagtgtacaattgggtaaatgagcaaagcatcagcaagctacagatacttttatgtgtgtgtgtgtgtgtgtgtaacactgagccttagcatgagcaggaaagaacctaataatgccttgtgcaataatggaggaccattgtatctatattatgtaactgaaatattgatatgaaatgagactgtgttatctgagcgaatatttatatatgtgagagttgttaccaacaactactcctctcaggaagctctgctcataggttgaagttcatgtttcacttaagaccttgcaagtcttgaccgaattgactat

SEQ ID NO: 23337 - DNA, 397 bp, Homo sapiens
  AP001396.2_184277
  Located on chromosome 18
  Distance between a terminus base of telomere on chromosomal short arm and 5'-terminus of this base sequence : 27716204
  Distance between 3'-terminus of neighbour sequence of sequence listing upward to telomere on chrosomal short arm and 5'-terminus of this base sequence : 105948
atttagactttaagctgccatcatagctcactgcagtgtcaaactcctgggctcaagcgatcctctgacctcagcccacaagtagctaggactacaggtgtgcaaccgccatgcccatctatttattattattattattattattattattattattattattttgtgtagagacagcatcttgctatgttgcttagactggtcttgaactcctggcctcaagcaatcctcctgccttggccttctaaagtggggtattacagacatgagctaccatgctgtgccttcagctgatatttttggaagcaagactttctcagtgaaggaagcagcaaattgatttacattctagtgcaaactacttatctcattgctgatcagtaacaaatagctgatt

SEQ ID NO: 23338 - DNA, 116 bp, Homo sapiens
  D18S877
  Located on chromosome 18
  Distance between a terminus base of telomere on chromosomal short arm and 5'-terminus of this base sequence : 27740070
  Distance between 3'-terminus of neighbour sequence of sequence listing upward to telomere on chrosomal short arm and 5'-terminus of this base sequence : 23469
gatgatagagatgacacatgataggtaaatagatagatagatagatagatagatagatagatagatgatggatagagagacagaaagtgaagagcatgataaagcatgtatgaaga

SEQ ID NO: 23339 - DNA, 432 bp, Homo sapiens
  AP001396.2_61710
  Located on chromosome 18
  Distance between a terminus base of telomere on chromosomal short arm and 5'-terminus of this base sequence : 27791490
  Distance between 3'-terminus of neighbour sequence of sequence listing upward to telomere on chrosomal short arm and 5'-terminus of this base sequence : 51304
actgattactctgcaatcacattccctccatttaaatattttccagcatttggacttcagccttccaactctgtatgctgtgctgtagcatcgaccatcatgtccccaaaccgtatatgaaactcagtcttctttcccgagaaatgcgcttaaaccccatttatccaatcacctacttatataattccctacaccaagcaatctccaaccattttatcacaagggaccagtttcgtggaagacaattttttcataaactgggggaaggggatggttttgggatgattcaagcacattacatttattatgtactttattacattgagatatatatatatatatatatatgtatgtgtgtgtatgtgtgtgtatatatatatatatatatatataatgaaataattatacaattcaccataatgtagaatcaga

SEQ ID NO: 23340 - DNA, 362 bp, Homo sapiens
  chr18.fa.O7frz.30635263
  Located on chromosome 18
  Distance between a terminus base of telomere on chromosomal short arm and 5'-terminus of this base sequence : 27922334
  Distance between 3'-terminus of neighbour sequence of sequence listing upward to telomere on chrosomal short arm and 5'-terminus of this base sequence : 130412
tagtagatttgtcagctgacctacataaattctgcgattcctaattttgcaattccttttttatgctacaaacatcaatgtacacactgctgatacctgcattcatggtgttgtctcatgcggaatctaggcatgaagagactaatgcaagcttttctattagccattaaaagtctgtctctaatctaggagtctcttgactgtgtgtgtgtgtgtgtgtgtgtgtgtgtgtgtgtgtgtgtattcctctaattctctttttttgcactaaaatattagctaatgtaacattttttattcctttaatgatttctgatttctaagttatattcttttattttgttgatgttcgctctaatgtt

SEQ ID NO: 23341 - DNA, 421 bp, Homo sapiens
  AC074237.1_70324
  Located on chromosome 18
  Distance between a terminus base of telomere on chromosomal short arm and 5'-terminus of this base sequence : 27978952
  Distance between 3'-terminus of neighbour sequence of sequence listing upward to telomere on chrosomal short arm and 5'-terminus of this base sequence : 56256
tgcttacatgttgaaacttctcatgtctttgttgagttgtttctctcgttttgatcttttatttaggtgtccctcttggtcagaatatgttacttattggtctcaatttatagcctgcttagccagttagatactccccatagtgtgtgtgtgtgtgtgtgtgtgtgtgtgtgtgtgtgtgtgtgtgtgtatgtgtgtgtgtgtcttagagttcacagttcagtgagtttatgattttttgcccacctttagtcaaggactagtagcttgaagattccttctgatcatttctgagaagttgcttctttggggatgcacagagcctttcagactgctggggatgactaggttaatatttttactcctggctttccaagagtcacccttaaatcagcagagcttattgttctggtagtgttcg

SEQ ID NO: 23342 - DNA, 390 bp, Homo sapiens
  AC062025.1_132591
  Located on chromosome 18
  Distance between a terminus base of telomere on chromosomal short arm and 5'-terminus of this base sequence : 28021418
  Distance between 3'-terminus of neighbour sequence of sequence listing upward to telomere on chrosomal short arm and 5'-terminus of this base sequence : 42045
gtgcaatggagttggttaccgagagaaccagcaagtcaagaatgtggtcaaagtctcatggggaataggaaacttgagattaaaactctatgcatttgctgtattttccctctgttttttccctttcactggctctgttttccatccctttctatcactttcccaagtttattcaacaaattcctcttttttttttcctgcaatcgacaagtacccaaataaaaccagtgggaacatgcaacaatattctgaaacaagcattttattcgtctgtacacacacacacacacacacacacacacacacacacacacacaccattatactctatattttcctgaagattatattgaaaaaatgacattgctgaattctagtggattctacaga

SEQ ID NO: 23343 - DNA, 335 bp, Homo sapiens
  AC062025.1_82902
  Located on chromosome 18
  Distance between a terminus base of telomere on chromosomal short arm and 5'-terminus of this base sequence : 28053885
  Distance between 3'-terminus of neighbour sequence of sequence listing upward to telomere on chrosomal short arm and 5'-terminus of this base sequence : 32077
atttagttggtatggagtggacttcacacattgatttattgaaaaagtttcttttgtggattctaatgtgtggctggtttgagaaatagcattcttgaataatttggaataatctattataaatatgttcgagtgtgtgtgtgtgtgtgtgtgtgtgtgtgtgtggcagtggggagagttgtagtttgcagctattgtttttgctttttggcttgggctgctcagctgtttgaataattcctaatgttcttaatctactaaaagagtttcataaaacatagttaacctgaacaaataaaaaggataatggcaagtccagtttcttaaaggatagg

SEQ ID NO: 23344 - DNA, 379 bp, Homo sapiens
  chr18.fa.O7frz.30773536
  Located on chromosome 18
  Distance between a terminus base of telomere on chromosomal short arm and 5'-terminus of this base sequence : 28061148
  Distance between 3'-terminus of neighbour sequence of sequence listing upward to telomere on chrosomal short arm and 5'-terminus of this base sequence : 6928
atcacgaggtcaggagtttgaaaccagcctggccagcatggtgaaacccggtctctactaaaaatacaaaaattcgctgtgcatggtggtgtgcacctgtagtcccagctactcggtgaggctgaggcaggagaatcacttgcacccaggaggcagaggttgtggtgagctgagctcctgctactgcactccagcctaggtgacagaacgagactccatctcaaaataaataaataaataaataaataaataaaatatatcttcatatttacacacacacacatatatgtaaaagttacaagaaaatctctaactctacctagggaaataaatgacatgtaatagaaaacatacttggtgcctgaatacaatgatctta

SEQ ID NO: 23345 - DNA, 418 bp, Homo sapiens
  chr18.fa.O7frz.30555094
  Located on chromosome 18
  Distance between a terminus base of telomere on chromosomal short arm and 5'-terminus of this base sequence : 28078376
  Distance between 3'-terminus of neighbour sequence of sequence listing upward to telomere on chrosomal short arm and 5'-terminus of this base sequence : 16849
aacatagatgtggttctgatctagttgtctctattttcatcagtttgtttatttatcactgccccagtgccatagttttacaatacattttatcatctagtggagaaacctctgacattctttaaaaacttctaatgccaggtatataccccgaagattttaaaacagattgaaatacatgtgggcgcatgttcatattccaaatattcatattccaactaaaaagtagaaacaactcaaacatccatcactatatgaatagataagcaaaatgtcatatatatacacacacatacacacacacacacacacatatatatatgtatatgcacaatgggacactcttcaggcataaaaaggaactaagtaatgatatattttacaatgtggataaaccttgaaacatgctaagtgaaag

SEQ ID NO: 23346 - DNA, 153 bp, Homo sapiens
  chr18.fa.O7frz.30883405
  Located on chromosome 18
  Distance between a terminus base of telomere on chromosomal short arm and 5'-terminus of this base sequence : 28151420
  Distance between 3'-terminus of neighbour sequence of sequence listing upward to telomere on chrosomal short arm and 5'-terminus of this base sequence : 72626
ctattctactccattggtctatgtgtctgttgttttaatttttaaaaaattttttatttatttatttatttatttaccaattccatgctgttttggttactgtacccttgtagtataacctgaagtcaggtaatgtgatgtcttcagctttat

SEQ ID NO: 23347 - DNA, 398 bp, Homo sapiens
  chr18.fa.O7frz.30957622
  Located on chromosome 18
  Distance between a terminus base of telomere on chromosomal short arm and 5'-terminus of this base sequence : 28263985
  Distance between 3'-terminus of neighbour sequence of sequence listing upward to telomere on chrosomal short arm and 5'-terminus of this base sequence : 112412
aaagcactatgcacagtatcacaaaaaataaaaatgtgtacagtatatatacttatgtgttttgtgtacataatttcagtggttatcattctccaagatgaaaagatttacatattcttgcattatttaatgtttctttgagtctgtcacaaaggaattttaattagaaaactctagccttcatggtcagaaccatgatagtctaaaagcaggacaagcacagataattcctaagaaatgattttttttaaactactaaaatgatatttccaaggtttcaaattaaatcatattggccaaactgtgtgtgtgtgtgtgtgtgtgtgtgtgtgtgtgtgtgtgtgtgtgtgtatgtatgtattcaatccggtatcacctgcaattctgctattgaaata

SEQ ID NO: 23348 - DNA, 125 bp, Homo sapiens
  DISD22_0011158
  Located on chromosome 18
  Distance between a terminus base of telomere on chromosomal short arm and 5'-terminus of this base sequence : 28372726
  Distance between 3'-terminus of neighbour sequence of sequence listing upward to telomere on chrosomal short arm and 5'-terminus of this base sequence : 108343
tcatgctttccatatacatggaaatacacatatacatatgtgtatgtgtatgtgtatgtgtttgtgtgtgtgtgtgtgtgtgtgtgtgtgtgtgtgtataaaatattgtcccacaacagtgcctt

SEQ ID NO: 23349 - DNA, 101 bp, Homo sapiens
  DISD22_0011159
  Located on chromosome 18
  Distance between a terminus base of telomere on chromosomal short arm and 5'-terminus of this base sequence : 28479679
  Distance between 3'-terminus of neighbour sequence of sequence listing upward to telomere on chrosomal short arm and 5'-terminus of this base sequence : 106828
ctggctgattgatagatgatggcggtgtgtgtgtgtgtgtgtgtgtgtgtgtgtcacagttggcaagtaatgccttgcttaatccttcaactatgttgagt

SEQ ID NO: 23350 - DNA, 467 bp, Homo sapiens
  chr18.fa.O7frz.31289294
  Located on chromosome 18
  Distance between a terminus base of telomere on chromosomal short arm and 5'-terminus of this base sequence : 28582361
  Distance between 3'-terminus of neighbour sequence of sequence listing upward to telomere on chrosomal short arm and 5'-terminus of this base sequence : 102581
aagccaactagtttatggtacttctgttaaagctacccaaagaaacagattctctctctctctctctctctttctctctctctccctctctctctttctctctccctctacttatatcagtcatctgagaccattatacatgaagcacttaatttacttataattccagagaaatatttttactttgaaaatatgaaatttgaaatcatgtccttcgtgaacactttagttgcagacaacttttaattaaagtaaacattacgcagcataggcttctgattacaaatatgtttacagttaaattaatgaaatacagctaccacaactcagaaaaatttcaagctttttttgttataaaatggcaaaattacaccaatctttttaaaacgtgggctgtgactacttactccaggtatctaaattgtgcacttttaaataaaataataaagtatccatttgcaacttac

SEQ ID NO: 23351 - DNA, 444 bp, Homo sapiens
  AC073209.2_88990
  Located on chromosome 18
  Distance between a terminus base of telomere on chromosomal short arm and 5'-terminus of this base sequence : 28607945
  Distance between 3'-terminus of neighbour sequence of sequence listing upward to telomere on chrosomal short arm and 5'-terminus of this base sequence : 25117
tcaggttaatctatgttctagcacgtgtcagaatttctttcctccttaaggctgaataatatcacagtgtgtgtgtgtgtgtgtgtgtgtgtgtgtagatagatagatacacagatatatatatatatacacacaaacaccgtagtttgttttatctgctgatttataggtggattaaattaaactctcaagataggatggaaatatttttttcccagtaggtaaacgcttggagaattttatgcatttggtttaatggtatatttcttatttagttgatttgttcacagctaatttattatatgaaagacagtaatgaatttctgatcaaagttaaaaatacttggaagacttaagaaagcatctatttgagatttactttccaaaaagaatagtgcccttagatatctctcttgcagtctcataacttactgccaagttaaa

SEQ ID NO: 23352 - DNA, 263 bp, Homo sapiens
  AC073211.4_12804
  Located on chromosome 18
  Distance between a terminus base of telomere on chromosomal short arm and 5'-terminus of this base sequence : 28724566
  Distance between 3'-terminus of neighbour sequence of sequence listing upward to telomere on chrosomal short arm and 5'-terminus of this base sequence : 116177
tatgtactgcgaaaccataaactttgtgtgactcactttattgtgatagctattttattgtggtggcatggaaacaaacttgtaatatatctgaggatctgaggtatgcctataattctatttagagagagagagagtgtgtgtgtgtgtgtgtgtgtgtgtgtgtgtgtgtattccagtcttccaaacaacagttatcaagaaggaacaagatatataggacagttgttggaggaaatgcaagtgaacaaacgatagaaagc

SEQ ID NO: 23353 - DNA, 350 bp, Homo sapiens
  chr18.fa.O7frz.32031901
  Located on chromosome 18
  Distance between a terminus base of telomere on chromosomal short arm and 5'-terminus of this base sequence : 28845750
  Distance between 3'-terminus of neighbour sequence of sequence listing upward to telomere on chrosomal short arm and 5'-terminus of this base sequence : 120921
agtaagcaatcgtacaaagtaaacagaccatttatacgcatgcatttaaaagggaccatatatatatatatatatatatatacacacacacatatataacatatatatatatatataacttatatataatgcaaactgactaataacataaaaaataatgattacaacaatgtggtaacattttaaaaccatcaattagcaaatatctggaaaaataataatgcccagcactggcaaatatactttgggactggtgttgttgtatactctgaaaagcatgtgaatttatctaaactttatgaactctagtaatatatatcaaaagctttaacgatatgttccatctgaat

SEQ ID NO: 23354 - DNA, 108 bp, Homo sapiens
  chr18.fa.O7frz.31763948
  Located on chromosome 18
  Distance between a terminus base of telomere on chromosomal short arm and 5'-terminus of this base sequence : 28912387
  Distance between 3'-terminus of neighbour sequence of sequence listing upward to telomere on chrosomal short arm and 5'-terminus of this base sequence : 66287
tgattaccacaattgagctaattaacataggcatcacctgacatggttacatatgtgtgtgtgtgtgtgtgtgtgtgtgtgtgtgtactgagaacatttgacacctac

SEQ ID NO: 23355 - DNA, 178 bp, Homo sapiens
  D18S463
  Located on chromosome 18
  Distance between a terminus base of telomere on chromosomal short arm and 5'-terminus of this base sequence : 29057133
  Distance between 3'-terminus of neighbour sequence of sequence listing upward to telomere on chrosomal short arm and 5'-terminus of this base sequence : 144638
ccacagggacttccattcattccagcattgtttgctgaaatgacttcctatcctttatccactgaaaatcctttgctcatttgttgaagatcaattgaccgtgtgtgtgtgtgtgtgtgtgtgtgtgtgtgtgtgtgtatttctgcatgctgttctaatggattgatctgtttgcctc

SEQ ID NO: 23356 - DNA, 233 bp, Homo sapiens
  AP001128.2_52217
  Located on chromosome 18
  Distance between a terminus base of telomere on chromosomal short arm and 5'-terminus of this base sequence : 29075535
  Distance between 3'-terminus of neighbour sequence of sequence listing upward to telomere on chrosomal short arm and 5'-terminus of this base sequence : 18224
cgtcttgaatcaggacagtactggaaaaaaatgaaacaggttaaagaggtttgcaaaacaaaataacatcacacacacacacacacacacacacacaaaatagggagaaacgttatagaagggttaagttagatagttataggaaagttgtgtgtgtatgtgtgtgtgtgtgttgtgcaatgattatgaattctaaaaagctggttgttgtggtttaatttagattctgtttg

SEQ ID NO: 23357 - DNA, 299 bp, Homo sapiens
  AC007921.3_110060
  Located on chromosome 18
  Distance between a terminus base of telomere on chromosomal short arm and 5'-terminus of this base sequence : 29147849
  Distance between 3'-terminus of neighbour sequence of sequence listing upward to telomere on chrosomal short arm and 5'-terminus of this base sequence : 72081
ggtcatttcaacagacacatagaaattctgaaagagagtgagataatattctgaaactaaaaaataaatacctaaaataaaagattcattgaatacaactacttccgattataaaggagtcactggtatcagacttaaattcctaccatacatatatgctcacacacacacacacacacacacacacacacaactttttttcagatagcacagaaatgtgtctcagaaaataatgggaaaaaaaaggtgagtctaaagtcttcccatctttttgtctgaagataatttctaaaccacag

SEQ ID NO: 23358 - DNA, 308 bp, Homo sapiens
  AP001794.3_31552
  Located on chromosome 18
  Distance between a terminus base of telomere on chromosomal short arm and 5'-terminus of this base sequence : 29173515
  Distance between 3'-terminus of neighbour sequence of sequence listing upward to telomere on chrosomal short arm and 5'-terminus of this base sequence : 25367
atacggagtaaatgtggctaacagagacaattctcatgaattttgtagggtctatgatcacctgaggctttgtgaaagcttaaatcctattcatcgtataataagtatgcttctgctgaagcaagtggtagatgtacatacacacacaccacacacacacacacacacacacacaccccacacacacatgcatacacatattttaaactcttaaatttctatattatagtagatgtgttataaagataaaagagagtcataatattgctagctgattgtatgtatagtacagctagattgctgtatgc

SEQ ID NO: 23359 - DNA, 207 bp, Homo sapiens
  D18S56
  Located on chromosome 18
  Distance between a terminus base of telomere on chromosomal short arm and 5'-terminus of this base sequence : 29210375
  Distance between 3'-terminus of neighbour sequence of sequence listing upward to telomere on chrosomal short arm and 5'-terminus of this base sequence : 36552
tatctcctgaaggacctgcctgagatacacacacacacacacacacacacacacacacacacacacacagacacatggaaggagcacaccctaacaataaaaagtatagtatagtaaatacataatcctgtagcatagtcatttattattatcaagtattatgtactgtatataattgtatatgctaggcgtttatacaactggcag

SEQ ID NO: 23360 - DNA, 120 bp, Homo sapiens
  Z67183
  Located on chromosome 18
  Distance between a terminus base of telomere on chromosomal short arm and 5'-terminus of this base sequence : 29389769
  Distance between 3'-terminus of neighbour sequence of sequence listing upward to telomere on chrosomal short arm and 5'-terminus of this base sequence : 179187
ccaatgcctaagaaatgcctagggagaataatatatgcacacacacacacacacacacacacacacatatatataatttatatatagccctggacatgacttcgtcaaagcacagattac

SEQ ID NO: 23361 - DNA, 130 bp, Homo sapiens
  Z67093
  Located on chromosome 18
  Distance between a terminus base of telomere on chromosomal short arm and 5'-terminus of this base sequence : 29462262
  Distance between 3'-terminus of neighbour sequence of sequence listing upward to telomere on chrosomal short arm and 5'-terminus of this base sequence : 72373
gttttagtgcctgtgcctttccgtaaaaatcttagtattaatataagtttgtctatgtctacacacacacacacacacacacacacacacaaacacagatgcatgcatatgtgagaactggaatttggat

SEQ ID NO: 23362 - DNA, 135 bp, Homo sapiens
  chr18.fa.O7frz.32529142
  Located on chromosome 18
  Distance between a terminus base of telomere on chromosomal short arm and 5'-terminus of this base sequence : 29725134
  Distance between 3'-terminus of neighbour sequence of sequence listing upward to telomere on chrosomal short arm and 5'-terminus of this base sequence : 262742
cgaggtcagatgtatcaagtaattgctcaattccatttatatattgcagacacttatttatttatttatttatttatttactgagatggagtttcactcttgtcacccaggctggagtacaatggtgcaatctcg

SEQ ID NO: 23363 - DNA, 345 bp, Homo sapiens
  AC009717.4_181965
  Located on chromosome 18
  Distance between a terminus base of telomere on chromosomal short arm and 5'-terminus of this base sequence : 29783554
  Distance between 3'-terminus of neighbour sequence of sequence listing upward to telomere on chrosomal short arm and 5'-terminus of this base sequence : 58285
gaaataaagattagttggaacctcaaaattcatttcttgggaaaaaaaatttaactgagcacttgctacatgctgggcactacactaagcatactatatagatcatcttattttattttattttattttattttattttatattttattttattttattttattttattttattttattttattttattttattttattttattttgagacaggggtctcactctgttgctcagactggagtgcagtagccccatcaccagttgctgcagcctcaacctcttgggttcaagtgatcttcccgcttcagcctcccaagaagctgggactataggtgcaagccatca

SEQ ID NO: 23364 - DNA, 477 bp, Homo sapiens
  chr18.fa.O7frz.32752252
  Located on chromosome 18
  Distance between a terminus base of telomere on chromosomal short arm and 5'-terminus of this base sequence : 30047430
  Distance between 3'-terminus of neighbour sequence of sequence listing upward to telomere on chrosomal short arm and 5'-terminus of this base sequence : 263531
gattagatgcaaaatcatactcagttttcttacgtaataattaaaaatgcaaatacattcactatattcaaagttctaacttccaaaacatgagcccttctatcctcgagttttggtgggatgtggaagaaaatcgtgtgtgtgtgtgtgtgtgtgtgtgtgtgtctcaaaacggaaaaaggcgtgactgaatccagtctagagatttccatgaactctcaggtggaagagcatgataattagggcgtccaggcctagcacacagttcattttcatgctctatttatccatttcattttccccgtgtccttgaggtaactttcaatgaaaattcattttgttgacaaaacttttctaagacgtgatctgggacgtcgtttttagcctctgggctggcaaaacaactaatcctgtcaccttgatgtttccttgtttaaggagaatcccaagctaatgtaacacctagcttactttgag

SEQ ID NO: 23365 - DNA, 455 bp, Homo sapiens
  chr18.fa.O7frz.33015700
  Located on chromosome 18
  Distance between a terminus base of telomere on chromosomal short arm and 5'-terminus of this base sequence : 30080802
  Distance between 3'-terminus of neighbour sequence of sequence listing upward to telomere on chrosomal short arm and 5'-terminus of this base sequence : 32895
ttttccaaagtaatgttaacaaacagcttccaccatattttctgtagtgccttggtgacattctttggcccactatggtcctcttgagttatgtggtctagttggtctagttttaattttctcagctctataacctcacaagacagtatacccaactgaatttacaaaattgagcatgaattttctatatgatcatttttcactgctgtctatggagaaacttatatgttcaaactaattatataccaataatatgtggccacttattgaagcttctgtttcccaccaaattattgacttttggctgctgttttgtttgtttgtttgtttgtttgtttgtttaggggccatgaatacatcaaaagattgtgtgttctgcctggaagaataatgaaccctgccttttttatttcttagtgttttattgtattctttagaatgcagttacagaattt

SEQ ID NO: 23366 - DNA, 462 bp, Homo sapiens
  AC017100.3_158976
  Located on chromosome 18
  Distance between a terminus base of telomere on chromosomal short arm and 5'-terminus of this base sequence : 30132283
  Distance between 3'-terminus of neighbour sequence of sequence listing upward to telomere on chrosomal short arm and 5'-terminus of this base sequence : 51026
aacactcttaactaggcctcagtgtgttatgctgaaattcccaaaccaggtgtaataaatggtttacaggaatggtcccttctgcccttggagttgccaaatgaggcctggggaagctggattccctgggctcattatctccaaatggagaaatctcttccatttatcccaaaatgctaatacacacacacacacacacacacacacacacacacacacacaaaataaatatgtgtgtatatataatatatataattttatctatataaaaattatttttatgcatgtggaaaactgaagaagcacagcattcagatgtctctagggcccagactccatcagatcccaggctctagaactgctcctacccctcctgacctgcttgttccattgtctccatgactatcccactgcctcactcctggtccgaccctctcaccctagctcattaacattgatgct

SEQ ID NO: 23367 - DNA, 242 bp, Homo sapiens
  AP001336.3_136142
  Located on chromosome 18
  Distance between a terminus base of telomere on chromosomal short arm and 5'-terminus of this base sequence : 30258868
  Distance between 3'-terminus of neighbour sequence of sequence listing upward to telomere on chrosomal short arm and 5'-terminus of this base sequence : 126123
gaattctggtctccagaactatgagagaataaatttctgttttaaaccatccagtttgtggtaatttgccctggcagccccagaaaaactaacgcacctttttaaaaatatagtttccaaaaatactaatctactcagtttcctgaatacaccacacacacacacacacacacacacacacacacactataatcctcaaatcttttaaggattaggtgatcttggcctaaatcctacttcta

SEQ ID NO: 23368 - DNA, 306 bp, Homo sapiens
  AC022960.2_119267
  Located on chromosome 18
  Distance between a terminus base of telomere on chromosomal short arm and 5'-terminus of this base sequence : 30304107
  Distance between 3'-terminus of neighbour sequence of sequence listing upward to telomere on chrosomal short arm and 5'-terminus of this base sequence : 44997
gcactatactgacagaaggttaactaaggctcacgtgaacccacaatcctacgcatcaaaccaaaatgtaaaagtagtctgaataaactcccatcccacaactgcctgatgtgtgagaagaaacccttttatttatttatttatttatttatttatttattattttggggggggcttaaaaacaaactttattacaaattatcaaaaaaaagtgttaactctgaaatatttaacagatttcatttaaactcatatggtcataaaactcaaactatcaaacaaaaatagcattatgcacttaaccac

SEQ ID NO: 23369 - DNA, 260 bp, Homo sapiens
  chr18.fa.O7frz.33282101
  Located on chromosome 18
  Distance between a terminus base of telomere on chromosomal short arm and 5'-terminus of this base sequence : 30396470
  Distance between 3'-terminus of neighbour sequence of sequence listing upward to telomere on chrosomal short arm and 5'-terminus of this base sequence : 92057
aattacagtacctactcctttcctccttcagcaaggagtcctcaggcaaggtaacactactggggccaggttctcagaagagaagactgtgagaaggaggaggaggaagaggaggaggaggaagagaggaggaggaagaggaggaagagaggaggaggaagtggaggaggaggaagaggaggaggaggaagaggaggaagaggaggaggaggaggaggaataacagccatttatcattctttgtattgttagctggtgaa

SEQ ID NO: 23370 - DNA, 480 bp, Homo sapiens
  AC009831.4_154436
  Located on chromosome 18
  Distance between a terminus base of telomere on chromosomal short arm and 5'-terminus of this base sequence : 30496022
  Distance between 3'-terminus of neighbour sequence of sequence listing upward to telomere on chrosomal short arm and 5'-terminus of this base sequence : 99292
tcctatgaattgcctgtttatgctcttttgtgaatggtttgttgcgattttctgctttgtaagagcccttgtatgctcttaatattggtcctttgtgatatattttgcaaatagtattttccagttttgacatgaaagagtttattcttttgcagggaagcacactctctttgcctttatagtgtcaagatattacatcaaactaagaaaggatgttatcattccaggactttaaaaagtgctctcctagtatttgcttctaggtgtgtgtgtgtgtgtgtgtgtgtgcgcgcgcgcgtgtgcctgtgtgtgtgttaccctggtttcattttttattatagcttaatcaagccataatatattaaaacacaatgaataagctaagattccaacccaaacagctggttagatatcacaataccattttgtgagtaagttaactttctccactgattttaaatgataccttaatcatatgca

SEQ ID NO: 23371 - DNA, 479 bp, Homo sapiens
  chr18.fa.O7frz.33600812
  Located on chromosome 18
  Distance between a terminus base of telomere on chromosomal short arm and 5'-terminus of this base sequence : 30714251
  Distance between 3'-terminus of neighbour sequence of sequence listing upward to telomere on chrosomal short arm and 5'-terminus of this base sequence : 217749
ctcatgagtttgatgctaatctgattctctttccttagtaggtgatctatttttacttcctctctggaagatactagaagttgaaaaattattttttattttattttatttatttatttatttatttatttgtttattgagatggagtctcgctctgtcacacaggcttgagtgcagttgtgcgatctcggttcatggcaagctccgcctcccaggttcacgccatcctcctgcctcagcctcttgagtagctgggactacaggcgcccgtcaccatgcctagctaattttttgtatttttagtagagacagggtttcaccgtgttagagccaggatgatcttgatttcctgacctcgtgatccgcctgcctcggcctcccaaagtgctggtattacaggcgtgagccaccgcgcccggctgaaaaattattatttgaagtttttccagtaatctctctggttgtgactcttaaattta

SEQ ID NO: 23372 - DNA, 456 bp, Homo sapiens
  AC015563.3_22054
  Located on chromosome 18
  Distance between a terminus base of telomere on chromosomal short arm and 5'-terminus of this base sequence : 30759978
  Distance between 3'-terminus of neighbour sequence of sequence listing upward to telomere on chrosomal short arm and 5'-terminus of this base sequence : 45248
gatgaggccttcctgtaacgccctggaggtccatagtttggaagtgttggagaattaaccaatctcttttatcaacactcccctccatcaaccctcaatcaatgcccaatggaagttgatgtataaacatcctacctctctggccccttttgtggaacaactctgaggtctgtattttactgtttccctgtctcattttcccctcctctacaggtgttggtcctctttctttctttctttctttctttctttctttctttctttctttctttctttctttctttctttctttctttctttctttctttctttctttccttccttccttccttccttccttccttccttcctttctttctttctttctttcctttctttctttctctctctctctcttttgtttttttacaggatcttgctctgttgccaggctggagtacagtggcatgatcatag

SEQ ID NO: 23373 - DNA, 454 bp, Homo sapiens
  AP001151.2_160796
  Located on chromosome 18
  Distance between a terminus base of telomere on chromosomal short arm and 5'-terminus of this base sequence : 30788612
  Distance between 3'-terminus of neighbour sequence of sequence listing upward to telomere on chrosomal short arm and 5'-terminus of this base sequence : 28178
agatttccagaacaaatcttagtcctattaaacctcctcagggctgggtgcagtggctcacacccgtaatcccagcactttgggaggccgaggcaggtggatcacctgtcaggagttccagaccagcctggccaacatggtgaaaccctgtctctgctaaaaccacacacacacacacacacacacacacacacacacacacacgaaaaaatagctaagtgtggtggcgggtgcctgtaatcccagctacttgggatgctgaggcaggagaatcacttgaatccgggaggcggaggttgcagtgagccgagatcgcaccactgtactccagcctaggcaaaagagtgagacttggtctcaaacaaaaaaacaaacaaacctccttagaaaatggcttatgagttttatcaggatgtcaatttcttcccaggaagaagttctttccaaatctagg

SEQ ID NO: 23374 - DNA, 118 bp, Homo sapiens
  D18S457
  Located on chromosome 18
  Distance between a terminus base of telomere on chromosomal short arm and 5'-terminus of this base sequence : 30900869
  Distance between 3'-terminus of neighbour sequence of sequence listing upward to telomere on chrosomal short arm and 5'-terminus of this base sequence : 111803
ctaccctggcacctggttctggagtgtgtgtgtgtgtgtgtgtgtgtgtgtgtgtgtgtgtataatacattagcacatccgctatgctttgatctcagtgtaacttcagggatatagg

SEQ ID NO: 23375 - DNA, 252 bp, Homo sapiens
  chr18.fa.O7frz.33905264
  Located on chromosome 18
  Distance between a terminus base of telomere on chromosomal short arm and 5'-terminus of this base sequence : 30992504
  Distance between 3'-terminus of neighbour sequence of sequence listing upward to telomere on chrosomal short arm and 5'-terminus of this base sequence : 91517
aaagactattcacttactggatgaggaaagcaggctttgggatctcagccaagatcccaaagatcacttactatataactgtgtgtgtgtgtgtgtgtgtgtgtgtgtgtgtgtgtgtgtgtgtgcgcgcgggcgctttggaggagggcagggttgaggtgaagtgaagtgataaatgccaggaattctgtagttcagtttaaatctcttcattctttaagttctatagttgtctgttctttcaatctacat

SEQ ID NO: 23376 - DNA, 370 bp, Homo sapiens
  AC021224.4_137708
  Located on chromosome 18
  Distance between a terminus base of telomere on chromosomal short arm and 5'-terminus of this base sequence : 31060631
  Distance between 3'-terminus of neighbour sequence of sequence listing upward to telomere on chrosomal short arm and 5'-terminus of this base sequence : 67875
ggacattgaaacaatgatacacagagctgtgcagcagaaatctctaatgacacaaatacaatagtaattattcatttcaaaacacagggactgttgattactagtacacaataaatggctaccaaaatagtctatccatttctcagactgtaagttccccatagtgtgtgtgtgtgtgtgtgtgtgtgtgtgtataacaacagaattgttcaccattaacacaatattcaaggttatttgctgtaacaaaatttttgtaaaccaaaagcatcacagtgttcactttgtattatttcacttaatcatcacaacaagacaaagagggaggtattatctctacttcacctataaacacaatttccatacaatg

SEQ ID NO: 23377 - DNA, 354 bp, Homo sapiens
  AC009835.5_117048
  Located on chromosome 18
  Distance between a terminus base of telomere on chromosomal short arm and 5'-terminus of this base sequence : 31119655
  Distance between 3'-terminus of neighbour sequence of sequence listing upward to telomere on chrosomal short arm and 5'-terminus of this base sequence : 58654
gtagaagtagctagatcagccttcgaaagagaaagtccaacttattaggtgcccctgcatagtatatatatatatatacacatacacacacacatatatagctatatatatatatatatatataagtatatatattagtgtatatatatatatatattagtatatatatatatatactagatcagccttggaaagagaaagtccaacttattaggtgcccctgcatagtatatatatacacacacacacacacacacacacacatagctatatatatctatatctatatctatctatatctatctatctatatatatatagccactgtggctacaactacatgaccagtgtaca

SEQ ID NO: 23378 - DNA, 161 bp, Homo sapiens
  chr18.fa.O7frz.34034483
  Located on chromosome 18
  Distance between a terminus base of telomere on chromosomal short arm and 5'-terminus of this base sequence : 31122850
  Distance between 3'-terminus of neighbour sequence of sequence listing upward to telomere on chrosomal short arm and 5'-terminus of this base sequence : 2841
cattgctgaatgactatcctagacacacacacacacacacacacacacacacaccaggagtagttatgcatatatcactagactagccacacacacacacacacacacacacacactagtagttatgcatacatcatgtaattgctaaatgtcaatttagc

SEQ ID NO: 23379 - DNA, 262 bp, Homo sapiens
  Z67679
  Located on chromosome 18
  Distance between a terminus base of telomere on chromosomal short arm and 5'-terminus of this base sequence : 31239257
  Distance between 3'-terminus of neighbour sequence of sequence listing upward to telomere on chrosomal short arm and 5'-terminus of this base sequence : 116246
aaccctgctggtttagatacttggagttgggaaaagatatggcactagaaaaatttataaatatataatccaactctgcttctaaaatcttccaaaatccgagtcattctaatctctgtttgggttgcatattttgaaaactgaaatggtaaaagtaatatttgccaaacacacacacacacacacacacacacacaaacctgtactagaacaaaaatgtaatcaccaaacattttctgagcaccaacagtattcattaaag

SEQ ID NO: 23380 - DNA, 289 bp, Homo sapiens
  AP001123.3_80536
  Located on chromosome 18
  Distance between a terminus base of telomere on chromosomal short arm and 5'-terminus of this base sequence : 31311441
  Distance between 3'-terminus of neighbour sequence of sequence listing upward to telomere on chrosomal short arm and 5'-terminus of this base sequence : 71922
aggtggatttcagtattgattctagaacatcttgtgcaatttctaacaacatcatctcacactcttcaactcagtgacaatgttgagcatttgtcattaacaaagggaactaagtcccctctaatttgagggaatgggatttacagacagtagtggacacacacacacacacacacacacacacacacactcttaatggagaaaatgggaagagggatgccaatgatttgtcatttgagaaggagcaaaggggagtattggcattgtttaatttgagtcaaatagcaga

SEQ ID NO: 23381 - DNA, 335 bp, Homo sapiens
  chr18.fa.O7frz.34175725
  Located on chromosome 18
  Distance between a terminus base of telomere on chromosomal short arm and 5'-terminus of this base sequence : 31497797
  Distance between 3'-terminus of neighbour sequence of sequence listing upward to telomere on chrosomal short arm and 5'-terminus of this base sequence : 186067
cttacaaaccaatccagagataaagataaagataggtccatatacatacatacatacatacatacatacatacatacatacatacacacacacacacacatagatagatctcgtgctggttttgctttttttatggacccctaactgacacactgcatatgcaaaaccattgtagtgtttaaaggtggtagataaaatttgtgtttatttcctgatgtaagtgttgctttaaattttgattggtaattccagttgctattgtctcagtaaaagaaagtatattcaatatgtaggccttcatatcccacatatactatgagcagacctgaaattta

SEQ ID NO: 23382 - DNA, 316 bp, Homo sapiens
  chr18.fa.O7frz.34574217
  Located on chromosome 18
  Distance between a terminus base of telomere on chromosomal short arm and 5'-terminus of this base sequence : 31662910
  Distance between 3'-terminus of neighbour sequence of sequence listing upward to telomere on chrosomal short arm and 5'-terminus of this base sequence : 164778
ggacagtataaatttaatgcaaacttatcagtctataaagtgtgataatgcctttagaacaagtgtgtgtgtgtgtatgtgtgtgtgtgttttctaagaaacaggggccaaagccatttgtgtgtgtgtgtgtgtgtgtgtgtgtgtgtgtgtgtttgcatgtccacatgcctgtgttctaagaaatggaagcagagacactgatagggtcttcaaatagctgttacagggaaaattattattttatggttttgctatgaaagaagtgaatttctatctacattaaacaagcagacagaattcactatcaaagcac

SEQ ID NO: 23383 - DNA, 386 bp, Homo sapiens
  AC025888.2_29790
  Located on chromosome 18
  Distance between a terminus base of telomere on chromosomal short arm and 5'-terminus of this base sequence : 31762268
  Distance between 3'-terminus of neighbour sequence of sequence listing upward to telomere on chrosomal short arm and 5'-terminus of this base sequence : 99042
ccaatacgttaactggtatcagatttggaaggtggaagtgaagcactgactcttacttttagaagacctttgcagtcagagagagcagttgaaagaggttgtgatggacagacagacatgctgtactagtccgttttcacactgctataaagaactgcctgagactgggtaatttataaaggtaagcggtttaattgactcacagttctgcatggctggggaaacttacaatcatggaggaaggcaaaggggagacaaggcacatcttacatggcggcaggagagagagagagagagagagagagagagactgagagagagaactgccaaacatttttaaaccatcagatctcataagaactcactcactatcatgagaacagcat

SEQ ID NO: 23384 - DNA, 465 bp, Homo sapiens
  AC025888.2_12521
  Located on chromosome 18
  Distance between a terminus base of telomere on chromosomal short arm and 5'-terminus of this base sequence : 31805483
  Distance between 3'-terminus of neighbour sequence of sequence listing upward to telomere on chrosomal short arm and 5'-terminus of this base sequence : 42829
cttagtgaaatactgattgcctacattgggcaaaatcctctaacctaaggctattttataataacatgttgaatagctcacgtaatttatcgaatgccatactgagagagagaaaaacagaatggctgtatgagtgctcaaagtatggtctccactgaatatgcatcactttcacaccatggtaaagttgaaaaactgtaagtggaaccacattaactcagaggctgtgtgtgtgtgtgtgtgtgtgtgtgtaagttaattatcatatccattagtgaaatagctattatccactttcaaatatgataaaaccgaggtctaaggtcatggaatttgtcacaggaccagtcttcaaacatgtatcagcaccaggactgcctgctactagagcctggacacattctacagctcttcacagtaagctccctcctctatctccttggctgctagcactttgtctgttat

SEQ ID NO: 23385 - DNA, 128 bp, Homo sapiens
  Z67776
  Located on chromosome 18
  Distance between a terminus base of telomere on chromosomal short arm and 5'-terminus of this base sequence : 31898415
  Distance between 3'-terminus of neighbour sequence of sequence listing upward to telomere on chrosomal short arm and 5'-terminus of this base sequence : 92467
actgaccaataattcaatagcagaatttgtgtgtgtgtgtgtgtgtgtgtggaaagatattttcttatacgtttcataaagaaaataaaaatggatatcactctggatttatcattatgccatagggg

SEQ ID NO: 23386 - DNA, 237 bp, Homo sapiens
  D18S456
  Located on chromosome 18
  Distance between a terminus base of telomere on chromosomal short arm and 5'-terminus of this base sequence : 32047203
  Distance between 3'-terminus of neighbour sequence of sequence listing upward to telomere on chrosomal short arm and 5'-terminus of this base sequence : 148660
tgcttggtaacatggctgatttatttacttgtagtttagatacatgcacacagataatgaacatcagtttgttggttggtttttttctgtgtgtgtgtgtgtgtgtgtgtgtgtgtgtgtgttttcttggtagttcaaggtgacctttgggtaaaaattttttaatgacaaattcacctcattgttggaagaaaacaggcacataaccttttacgacacagcagggttactgaaggt

SEQ ID NO: 23387 - DNA, 283 bp, Homo sapiens
  chr18.fa.O7frz.35041801
  Located on chromosome 18
  Distance between a terminus base of telomere on chromosomal short arm and 5'-terminus of this base sequence : 32080865
  Distance between 3'-terminus of neighbour sequence of sequence listing upward to telomere on chrosomal short arm and 5'-terminus of this base sequence : 33425
agtcaaacatctgatactgcagccatagttgagtatttgtggttcattgtgaaatgtcccgttatttttttcatgatatgaaaagtagaagtcgagccccacaagaaattcaaggactgttgtgtgtgcctgtgtgtgtgtgtgtgtgtgtgtgtgtgtgtacacgtgcatgcataggcactcacatttctggtagttatcacattgttgatgtaagattggattgctgaatgggaaggaaatactttttatacagaatgcctcacagtaatgcagtaagcat

SEQ ID NO: 23388 - DNA, 241 bp, Homo sapiens
  AC010798.8_116998
  Located on chromosome 18
  Distance between a terminus base of telomere on chromosomal short arm and 5'-terminus of this base sequence : 32258546
  Distance between 3'-terminus of neighbour sequence of sequence listing upward to telomere on chrosomal short arm and 5'-terminus of this base sequence : 177398
taatctgcacgttgtgcacatgtaccctaaaacttaaagtagaaataataataataataataaaatattttttataattgtctacttgattgcaagctataaaaagcaattaaaataaaaaaaaataaaataggccaggggtgcgtgggggtggcagctaccgcctgtagtgttgaaaaccttttttagttgagagaaggaaaacaaattacctctacccttagcagatggacagtactgg

SEQ ID NO: 23389 - DNA, 121 bp, Homo sapiens
  D18S1124
  Located on chromosome 18
  Distance between a terminus base of telomere on chromosomal short arm and 5'-terminus of this base sequence : 32297577
  Distance between 3'-terminus of neighbour sequence of sequence listing upward to telomere on chrosomal short arm and 5'-terminus of this base sequence : 38790
gatcacgccactgcactccagcctgggtgacagagtgagactccatctcaaaacaaacaaacaaaaaacaaaacacacacacacacacacacacacaaaatccctgtctgatagtttgaac

SEQ ID NO: 23390 - DNA, 153 bp, Homo sapiens
  D18S536
  Located on chromosome 18
  Distance between a terminus base of telomere on chromosomal short arm and 5'-terminus of this base sequence : 32473809
  Distance between 3'-terminus of neighbour sequence of sequence listing upward to telomere on chrosomal short arm and 5'-terminus of this base sequence : 176111
cacagttgtgtgagccagtccttcataacatatcactttctatctgtctgtctatctatctatctatctatctatctatctatctatctatcctatgggttccatttgtctggagaatcctgaataatacagaggactaacaccagtgataat

SEQ ID NO: 23391 - DNA, 211 bp, Homo sapiens
  DISO7_10004356
  Located on chromosome 18
  Distance between a terminus base of telomere on chromosomal short arm and 5'-terminus of this base sequence : 32663564
  Distance between 3'-terminus of neighbour sequence of sequence listing upward to telomere on chrosomal short arm and 5'-terminus of this base sequence : 189602
aggcaactcaaagcattatagtagaattccaattttctgaaagaaagaaaaagaaagaaagaaagagaaagaaagaaagaaagaaagaaagaaagaaagaaagaaagaaagaaagaaagaaagaaagaaagaaagaaatgtgtttgggtatgtaaaatacaataattgaatatgtgaaaatataaaatgcagtatgtggagtgttaacatt

SEQ ID NO: 23392 - DNA, 239 bp, Homo sapiens
  D18S1135
  Located on chromosome 18
  Distance between a terminus base of telomere on chromosomal short arm and 5'-terminus of this base sequence : 32916041
  Distance between 3'-terminus of neighbour sequence of sequence listing upward to telomere on chrosomal short arm and 5'-terminus of this base sequence : 252266
tggccccagtgaccactaaatattaataaatattaaacacaagttaattaatggtgatttaaagggaccccatgttgttaattcatgtcagtctctatttgatgaaatgtatctttttctttgtttccattcactcaatttctcttcttttagatatacacttgtataacacacacacacacacacacacacacacacacacacacattttgttttccagtccgcactcaagttttgca

SEQ ID NO: 23393 - DNA, 397 bp, Homo sapiens
  chr18.fa.O7frz.35851055
  Located on chromosome 18
  Distance between a terminus base of telomere on chromosomal short arm and 5'-terminus of this base sequence : 33017397
  Distance between 3'-terminus of neighbour sequence of sequence listing upward to telomere on chrosomal short arm and 5'-terminus of this base sequence : 101117
atatcaggaactttcctacgagctggtcatatgtgtgagaaaaacagaaatgtctttctggaccacatcctgcttgtcatcttgtgtgcactgtgtgtgtgtgtgtgtgtgtgtgtgtgtgtgtgtgtgtaaaaccctagcctaaaggcactaaactgccctttaatgggaatattaaaatagcccaggcaatggcagatataatgtaatgctaaaaaaggcaactaaagtgattagaacatatttatatttactttttttaaaaaacgtaaaacagtgcaatccttaaacaccttatgtattacactgaaaagatacaggtatatgtctttggtctactactgttatatgaataacttgttttatgactgtttcctgttaaacatttcagaagtgg

SEQ ID NO: 23394 - DNA, 113 bp, Homo sapiens
  DISD22_0011164
  Located on chromosome 18
  Distance between a terminus base of telomere on chromosomal short arm and 5'-terminus of this base sequence : 33368992
  Distance between 3'-terminus of neighbour sequence of sequence listing upward to telomere on chrosomal short arm and 5'-terminus of this base sequence : 351198
aattgcccaactagaaccagaaaaacatatatatatatatatatatatatatatatatatatatatatatatatatgcagacaagaaaatctgacccaatgccaaaggaatgt

SEQ ID NO: 23395 - DNA, 314 bp, Homo sapiens
  chr18.fa.O7frz.36216061
  Located on chromosome 18
  Distance between a terminus base of telomere on chromosomal short arm and 5'-terminus of this base sequence : 33510697
  Distance between 3'-terminus of neighbour sequence of sequence listing upward to telomere on chrosomal short arm and 5'-terminus of this base sequence : 141592
ccttaactaatcatatctgcaaagacctttttccaaataaagtcataatctgaggttccaggtggatatgaatcttgcagggacactattcagttctctgtgtgtgtgtgtgtgtgtgtgtgtgtatgtgtgtgtgtgtgtatacatatgaacccatttttataaataactgtatgtgtgaaacacatacacacaggtacccctcaccagacacacataaaagatgtttagggccagatgtggtggctcacgcctgtaatcctagccctttgggaggccgaggtgggcggatcatgaggttagcagttcaagac

SEQ ID NO: 23396 - DNA, 195 bp, Homo sapiens
  chr18.fa.O7frz.36340296
  Located on chromosome 18
  Distance between a terminus base of telomere on chromosomal short arm and 5'-terminus of this base sequence : 33623990
  Distance between 3'-terminus of neighbour sequence of sequence listing upward to telomere on chrosomal short arm and 5'-terminus of this base sequence : 112979
tttaaggaagtaatgttgacctactgtgtggctatgtggaagcttctctaaaatgctgccatttatatatatatatatatatatatatatatatatatatagagagagagagagagagagagagagagagagagagagagagagagagacgaagagtttgttattgttatactgaactcagaatgaaatagcctc

SEQ ID NO: 23397 - DNA, 473 bp, Homo sapiens
  chr18.fa.O7frz.36521573
  Located on chromosome 18
  Distance between a terminus base of telomere on chromosomal short arm and 5'-terminus of this base sequence : 33805320
  Distance between 3'-terminus of neighbour sequence of sequence listing upward to telomere on chrosomal short arm and 5'-terminus of this base sequence : 181135
attatctctatttgcagatgacataatcttatatgcaaaaaacccttaagatcacacacacacacacacacacacacacacacacgaactaataagtgaattcagccaagttgcaggatacaaaatcaacacccaaaaatcagttacatttctatatactgacaatctacaatctaaaaaggaaatgaagaaaacaatttcatttacaataccatcaaaaagactaaaatacttagcaataaacttaaccaagtaagtgaatgacttgttccctgaaaactacaaaacattgctggaaaatgcgaaagaaggcacatataattgggaagataccctatgttcagtctacccaaagaaatctacagattcagtgcaatccctattaaaattccagtgacaagttttgcattaatagaaaaactaattctaaaactcgtatggaacgtaaagggatctcaattagccagaacaat

SEQ ID NO: 23398 - DNA, 456 bp, Homo sapiens
  chr18.fa.O7frz.36618669
  Located on chromosome 18
  Distance between a terminus base of telomere on chromosomal short arm and 5'-terminus of this base sequence : 33927647
  Distance between 3'-terminus of neighbour sequence of sequence listing upward to telomere on chrosomal short arm and 5'-terminus of this base sequence : 121854
atgaccggaattatctgattactaagcgcgtgcgctctctctctctctctctctctctcacacacacacacacacacacacacacacacacacacacacacacacagcctgagctgaccagggcctggaccattactcagcccagacagactgaccctcctaatgctccaggtcacaaatgccctccaagggctcttgggctgggaagtgctgcagaagtagacagggagggcctgaagtattctccctcagccgtccctcctttatttaaagtacagaattatttgcttggtgcaggggctaggaaggtgccataccaggaatctctagtggcattttgtggctcatgggtggcttaggctggggtgagcctcggcaatggcacccctctgcagtaatcctcaccctcctgcaggaacttcagacaaacttcagttcacaaatactcatcgagtg

SEQ ID NO: 23399 - DNA, 456 bp, Homo sapiens
  AC036180.2_3866
  Located on chromosome 18
  Distance between a terminus base of telomere on chromosomal short arm and 5'-terminus of this base sequence : 34054024
  Distance between 3'-terminus of neighbour sequence of sequence listing upward to telomere on chrosomal short arm and 5'-terminus of this base sequence : 125921
attggaatgaactcaatattgtacattcatgcaatggagtattatgcagctataaaaaggaatggagaagatcttttaaacttctcataatcaccagggtatattgttaggtaaatcaaggtgcagaacaatgtgtgtttttacgtatgtttacatggttccaaagttaaaaccataagacacattcagtcaagtctgttttcacctccacatttcttcaccttgcttccttcctcccctatgaggaatcaatttctatagattttaattaattctttattttggaaattatgagcatgtatatttttgctacacacacacacacacacacacacacacacacacacacacatttagtttcctaatgctgctgtaaaaatttgccacaaacttagtggcttaaaacaacaaatttatttcctttcaattctagtgtctagaaggctgaaatgagtt

SEQ ID NO: 23400 - DNA, 362 bp, Homo sapiens
  AP001837.2_109437
  Located on chromosome 18
  Distance between a terminus base of telomere on chromosomal short arm and 5'-terminus of this base sequence : 34085856
  Distance between 3'-terminus of neighbour sequence of sequence listing upward to telomere on chrosomal short arm and 5'-terminus of this base sequence : 31376
atacagatttcctgtcaatgtaaggaagaaatcgctaagggaactaacaaaagtagaataagtgacatccagagtcactgaattctccatctattgagaagttcaaatctgacatttccttgacttcaaacatctgacatttccttctgaatatgaattatcatatctacaataaaagtctggtgcacatgtgtgtatatgtctgagtgtgattatgtgtatgctagggtatatgtgtcacatacacatacagacacatgcacacacacacacacacacacacacacacacacacacacacacacaaagtccattattaggatttcaacttcctctgctttaagatttgtcttccaatcatt

SEQ ID NO: 23401 - DNA, 468 bp, Homo sapiens
  chr18.fa.O7frz.36888226
  Located on chromosome 18
  Distance between a terminus base of telomere on chromosomal short arm and 5'-terminus of this base sequence : 34206047
  Distance between 3'-terminus of neighbour sequence of sequence listing upward to telomere on chrosomal short arm and 5'-terminus of this base sequence : 119829
gagtaaagctaggatccaagagaatgaagctttgttttctcagaaagttactatccagctgagattctctcaaactttctggagagctttggttagaaatatgaggggtaggagaaaatcatttggccgtagaaaatactgattaatctttgggaaaatttggcatgtgatattaagaataggatcagggttaggcgtggtggtgcgtgcctgtaatcccagcagtttgggaggccgtggtgggtggatcacttgagaccaggaattcaagaccagcctgggtacaaagtgagaacctgtcaaaaacaaaaagagaagaagaagaagaagaagaagaaggaagggaggaagtgaggaagggaggaagtgaggaagggtggaagggagggaggaaaggagggaaggaaagagggagggaaggaaggaagggagggagggagggagagaggattggatcagaagtttact

SEQ ID NO: 23402 - DNA, 334 bp, Homo sapiens
  chr18.fa.O7frz.36967046
  Located on chromosome 18
  Distance between a terminus base of telomere on chromosomal short arm and 5'-terminus of this base sequence : 34285035
  Distance between 3'-terminus of neighbour sequence of sequence listing upward to telomere on chrosomal short arm and 5'-terminus of this base sequence : 78520
atgacaaaggtgacattacaactgaccccacagaaataagaaaaactcctcagagattattatgaacatttctatgtacacaactagaaaaatctagatgaaacggataatgtcctggaaacacataacctcccaagattgaaccaggaagaaattgaaaccctgaacagaccaataatgagttccaaaattgaatcagtaataataataataataataataataataataagccttgccaaccaaaaaaaaaaaaaaagcccgggaccagatggattcacagcctaactctaccagatgcacaaagaagagctggtacctttcctactgaaac

SEQ ID NO: 23403 - DNA, 307 bp, Homo sapiens
  AC009272.2_36275
  Located on chromosome 18
  Distance between a terminus base of telomere on chromosomal short arm and 5'-terminus of this base sequence : 34304006
  Distance between 3'-terminus of neighbour sequence of sequence listing upward to telomere on chrosomal short arm and 5'-terminus of this base sequence : 18637
tatgtcctcatagcagaatgagaatgaatacagggagtgagccgctcttggagcttcttttgtctgtattcactggtgtctccaggctgcaggcttctctagcatccactccaggtacataagacaaaacaaaacaaaacacacacacacacacacacacacacacacagggaattcacaatcctgtttctcctaaggtcctgagtccctccctggtctgccttcttcttaccaccttttaacatcttttaattttgtttcatatataatgcccatagtttttagctgtacttaccaggacaaacag

SEQ ID NO: 23404 - DNA, 168 bp, Homo sapiens
  Z67330
  Located on chromosome 18
  Distance between a terminus base of telomere on chromosomal short arm and 5'-terminus of this base sequence : 34358740
  Distance between 3'-terminus of neighbour sequence of sequence listing upward to telomere on chrosomal short arm and 5'-terminus of this base sequence : 54427
aggatttcaaccaaatgcctgtcactttcacaccatcctaaaactgaaaaaatttaagtcaaaccatcataagtcagggacttctgtatacagtagcatatatatactatgtgtacacacacacacacacacacacacagtcacacactcacacagtagtcacagtag

SEQ ID NO: 23405 - DNA, 346 bp, Homo sapiens
  chr18.fa.O7frz.37474317
  Located on chromosome 18
  Distance between a terminus base of telomere on chromosomal short arm and 5'-terminus of this base sequence : 34778293
  Distance between 3'-terminus of neighbour sequence of sequence listing upward to telomere on chrosomal short arm and 5'-terminus of this base sequence : 419385
aaccatgacttaggtttcactactcgggtagctgatttcagcgcttcgggtcacttcctggtgttgtggagggtaactgtgttttccctttgggggctgtgagaactgtggcctcctcctgtgtgtctcctctggcttcctaagtagggagagtcaggagggagacgggggtgccttctgccaacctctctattcactcctcatccttccctctcgcagggtcacctgctggagacagctcctcacccttctttcgtattctctctctctctctctctctcaactattaattatggaaatttcctaccactcagaaatagaggggtactatgaatgcctacaggtg

SEQ ID NO: 23406 - DNA, 403 bp, Homo sapiens
  AP001158.3_155423
  Located on chromosome 18
  Distance between a terminus base of telomere on chromosomal short arm and 5'-terminus of this base sequence : 34778293
  Distance between 3'-terminus of neighbour sequence of sequence listing upward to telomere on chrosomal short arm and 5'-terminus of this base sequence : -346
aaccatgacttaggtttcactactcgggtagctgatttcagcgcttcgggtcacttcctggtgttgtggagggtaactgtgttttccctttgggggctgtgagaactgtggcctcctcctgtgtgtctcctctggcttcctaagtagggagagtcaggagggagacgggggtgccttctgccaacctctctattcactcctcatccttccctctcgcagggtcacctgctggagacagctcctcacccttctttcgtattctctctctctctctctctctcaactattaattatggaaatttcctaccactcagaaatagaggggtactatgaatgcctacaggtgctggggagggaggctctccattctttgaagcaactcttcaaggctacctgagtaatt

SEQ ID NO: 23407 - DNA, 366 bp, Homo sapiens
  chr18.fa.O7frz.37547520
  Located on chromosome 18
  Distance between a terminus base of telomere on chromosomal short arm and 5'-terminus of this base sequence : 34868148
  Distance between 3'-terminus of neighbour sequence of sequence listing upward to telomere on chrosomal short arm and 5'-terminus of this base sequence : 89452
ccatagaaacgctaatacaagtattaaaataagtataaaattattttcaccagcctgggcagcatagcaagacttcgtctctctctacacacacacacacacacacacacacacacacacacacacacacacacgaaaaattagccaggcacggtgatgtgcgcctgtagtctcagctccttgaggtgggaggattgcttgagcccaggagctcaagcctgtagtgaatcaagattgccccactgtactctaggctgggtctcagagcaagatcctgtcagtcaatcagtcaatcaataatagctatatgcattagtccagcacgagcattaaagagcataagatatggttaatactgcacctttc

SEQ ID NO: 23408 - DNA, 137 bp, Homo sapiens
  D18S1093
  Located on chromosome 18
  Distance between a terminus base of telomere on chromosomal short arm and 5'-terminus of this base sequence : 35111989
  Distance between 3'-terminus of neighbour sequence of sequence listing upward to telomere on chrosomal short arm and 5'-terminus of this base sequence : 243475
gggctctctggagaaacaaaaccaatagaatgtgtgtgtgtgtgtgtgtgtgtgtgtgtgtgtgtgtgtgtgtgtgtatgtatgtagttacataagaggagactttttatgtgattatgaagcccaagaagtctcat

SEQ ID NO: 23409 - DNA, 106 bp, Homo sapiens
  D18S57
  Located on chromosome 18
  Distance between a terminus base of telomere on chromosomal short arm and 5'-terminus of this base sequence : 35147448
  Distance between 3'-terminus of neighbour sequence of sequence listing upward to telomere on chrosomal short arm and 5'-terminus of this base sequence : 35322
ttcagggtcttttgaagaggttgaaaatacacacatacacacacacacacacacacacacacacacacacacacacacacacactctgcaaaatttaatgccttct

SEQ ID NO: 23410 - DNA, 110 bp, Homo sapiens
  DISD22_0011180
  Located on chromosome 18
  Distance between a terminus base of telomere on chromosomal short arm and 5'-terminus of this base sequence : 35506702
  Distance between 3'-terminus of neighbour sequence of sequence listing upward to telomere on chrosomal short arm and 5'-terminus of this base sequence : 359148
cattattgtacaaagatcacagagcaaaaaggggtgtgtgtgtatgtgagagagagagagagagagagagagagagagagagagattgagattgagatttctccttcaga

SEQ ID NO: 23411 - DNA, 122 bp, Homo sapiens
  DISD22_0011186
  Located on chromosome 18
  Distance between a terminus base of telomere on chromosomal short arm and 5'-terminus of this base sequence : 35590306
  Distance between 3'-terminus of neighbour sequence of sequence listing upward to telomere on chrosomal short arm and 5'-terminus of this base sequence : 83494
atgatgcaagcaattccccatttaaaatacacgcacgcgcacacacacacacacacaacacacacacacacacacacacacacacacacacacggagagagaaccaactattatttggaacg

SEQ ID NO: 23412 - DNA, 109 bp, Homo sapiens
  DISD22_0011190
  Located on chromosome 18
  Distance between a terminus base of telomere on chromosomal short arm and 5'-terminus of this base sequence : 35671307
  Distance between 3'-terminus of neighbour sequence of sequence listing upward to telomere on chrosomal short arm and 5'-terminus of this base sequence : 80879
gaatatgtgacactcatgttatggttaaaacacacacacacacacacacacacacacacacacacacacacacacacgtttaaatgaccacactgaattataagtggtt

SEQ ID NO: 23413 - DNA, 424 bp, Homo sapiens
  AC016493.3_170352
  Located on chromosome 18
  Distance between a terminus base of telomere on chromosomal short arm and 5'-terminus of this base sequence : 35837289
  Distance between 3'-terminus of neighbour sequence of sequence listing upward to telomere on chrosomal short arm and 5'-terminus of this base sequence : 165873
ggcagtgtttctgtttatgtaatgttctgaagaacttttggggcctagtacagtggctcatgcctgtaatcccagtgctttgagaagccaaggtgggaggatcacttgaggccaggagtttgagaccagcttgagcaacatagtaagaccttgtctctacaaaaaaaaaaaaaaattttttaagaaccttgtagattttctgtgtatgttggggattcattttttttttgataagaggctcttccataaatctttcctggatgtacaaaggcaattacaaccttacacacacacacacacacacacacacacacacacacacacacacttagaggaaagcaactgcctacacacacacacacacacacacacactacttagaggaaagcaactgcctgcccaaccttggactaatagtcatcct

SEQ ID NO: 23414 - DNA, 188 bp, Homo sapiens
  D18S1160
  Located on chromosome 18
  Distance between a terminus base of telomere on chromosomal short arm and 5'-terminus of this base sequence : 36169339
  Distance between 3'-terminus of neighbour sequence of sequence listing upward to telomere on chrosomal short arm and 5'-terminus of this base sequence : 331626
agctgccatgggattcaaaagccacacacacacacacacacacacacacacacacacatttttatactgggaacaaaaatataatactgaaatttataattgcctgttcacaattcttagcatagtactttagcattggcagaatgattttaggtacgttatttcatttaaattgcatcacaatcctg

SEQ ID NO: 23415 - DNA, 341 bp, Homo sapiens
  AP001175.3_6077
  Located on chromosome 18
  Distance between a terminus base of telomere on chromosomal short arm and 5'-terminus of this base sequence : 36181319
  Distance between 3'-terminus of neighbour sequence of sequence listing upward to telomere on chrosomal short arm and 5'-terminus of this base sequence : 11792
cagcttcaactgtagcactaagtccgagcaaaacaccttaacctccagctcatcctgtccccactgaaacagccctgaacatctagttttacttacatctaaagataagtcaagaaattgtgtgtgtgtgtgtgtgtgtgtgtgtgtgtgtatgtgtgtatgtgtgttgcgtgtgtggaggggcaagggtgtttcttgtctgctgggttgttctctgtgataggtttgtattaaaggttataaagtccatctatccatattgtctttctctttgaaagtgtaaaaaattgtaaaatagaacactaccattctattttgtaatcttaaacttcaaactgcac

SEQ ID NO: 23416 - DNA, 191 bp, Homo sapiens
  DISO7_00000020
  Located on chromosome 18
  Distance between a terminus base of telomere on chromosomal short arm and 5'-terminus of this base sequence : 36254520
  Distance between 3'-terminus of neighbour sequence of sequence listing upward to telomere on chrosomal short arm and 5'-terminus of this base sequence : 72860
ttccatctggaatctgagtggccgagtggccagccgcagctaattcccttcacccactgcatttcccaccttactcactgcctcttggtattccaggcgactttccttttatagtgtacacacacacacacacacacacacacacacacgacctgacagctcagtcaagtcaggccctccaagcagaatac

SEQ ID NO: 23417 - DNA, 217 bp, Homo sapiens
  D18S1100
  Located on chromosome 18
  Distance between a terminus base of telomere on chromosomal short arm and 5'-terminus of this base sequence : 36388649
  Distance between 3'-terminus of neighbour sequence of sequence listing upward to telomere on chrosomal short arm and 5'-terminus of this base sequence : 133938
ggccattttgtatccacataggaattcagattggggaaagataacagcacatgcacacacacacacacacacacacacacacacacgctgggcacatggcagcctctccacctcctccccagttttctgttcctgccagcagtccctagggccccataaagatagcaaccttctctgagcaggttaggcctggagagtgcaagggtggaacagtctg

SEQ ID NO: 23418 - DNA, 214 bp, Homo sapiens
  D18S1102
  Located on chromosome 18
  Distance between a terminus base of telomere on chromosomal short arm and 5'-terminus of this base sequence : 36389698
  Distance between 3'-terminus of neighbour sequence of sequence listing upward to telomere on chrosomal short arm and 5'-terminus of this base sequence : 832
ggaatgactgcgtctgtgtccctgtgtttgcagcagttttgttgtgaggccctgtgtgcatttgggtgtgggccattgtgttgagaatgggtgttgattctgtgtgtgtgtgtgtgtgtgtgtgtgtgtgtgtgtgtgtgtgtgtgtagacacggggtggggagggggatgccacttctgggtgtgacatcccaaaggctccaaaatcctgaaa

SEQ ID NO: 23419 - DNA, 317 bp, Homo sapiens
  AC015966.3_177238
  Located on chromosome 18
  Distance between a terminus base of telomere on chromosomal short arm and 5'-terminus of this base sequence : 36427446
  Distance between 3'-terminus of neighbour sequence of sequence listing upward to telomere on chrosomal short arm and 5'-terminus of this base sequence : 37534
attcatccatgaattcctctatccatgcatccatcatctacccaccatatatccttatgtatccattcatcaaccatccaccatccatccatctatccattcctctatcatccatcatctaccatccatccatccattcctctatgcatacatccatcatccctccatctaccatcagccatccaccatcatccatccatccatccatccatccatccatccatccatccacctaccattcatccactcaacaataagtatcaagggcatgcttgatgccaggccgtacactagtactggaataaggtctagtcgta

SEQ ID NO: 23420 - DNA, 197 bp, Homo sapiens
  D18S545
  Located on chromosome 18
  Distance between a terminus base of telomere on chromosomal short arm and 5'-terminus of this base sequence : 36462443
  Distance between 3'-terminus of neighbour sequence of sequence listing upward to telomere on chrosomal short arm and 5'-terminus of this base sequence : 34680
catctcgtgccacttagagccctggcctgaaaccatagacaccaaatacacagggcaaggcagagcccagtggtcccttggggccatttgaggtcatccatccatccatccgtccatccatccatccacccatccatccattcatctatccatccatccatccatccaatatattgcctgccatttgaagtatctga

SEQ ID NO: 23421 - DNA, 401 bp, Homo sapiens
  chr18.fa.O7frz.39062775
  Located on chromosome 18
  Distance between a terminus base of telomere on chromosomal short arm and 5'-terminus of this base sequence : 36516958
  Distance between 3'-terminus of neighbour sequence of sequence listing upward to telomere on chrosomal short arm and 5'-terminus of this base sequence : 54318
  misc_feature (1)...(401): n = A,T,G or C
gtctaggcaagtgatgcttatgtcccttcccactccacttttctgaggttctctgaccctcaggagggaaacataattgcagagtggggccctcctcatggatcaaactcttctagcccaagaggaggaatcagtattttctgacaatgctggacaaagaatagaggagcacacagggtttctgaagctggaggagcagtgaaatcacccagggagcatttgcaacacatggatcccaggcagatcctgactcttcatgactctgtgtgtgtgtgtgtgtgtgtgtgtgtgtgtgtgtgtgtgtgtgtgtgtgtgacagagagnagagnnnagagagagagagagagagaggtggagcctctttctttacatttattataaatctgaatgtcaaagaaatc

SEQ ID NO: 23422 - DNA, 192 bp, Homo sapiens
  DISO7_00000019
  Located on chromosome 18
  Distance between a terminus base of telomere on chromosomal short arm and 5'-terminus of this base sequence : 36585809
  Distance between 3'-terminus of neighbour sequence of sequence listing upward to telomere on chrosomal short arm and 5'-terminus of this base sequence : 68450
attccttcaggcaacaggatgcctggggtggtggacaagggctgggcacctctaagacacacacacacacacacacacacaaacacacacacacacacacacgcgtgcacgtgcacacacagacacacagcctaaacacatgcacagctgtgtcccttgtgctgtgcgtgtgtgaacattccagtgacagtc

SEQ ID NO: 23423 - DNA, 164 bp, Homo sapiens
  D18S475
  Located on chromosome 18
  Distance between a terminus base of telomere on chromosomal short arm and 5'-terminus of this base sequence : 36772670
  Distance between 3'-terminus of neighbour sequence of sequence listing upward to telomere on chrosomal short arm and 5'-terminus of this base sequence : 186669
aggactcgttaagagaccatcggttctgtgtgtgtgtgtgtgtgtgtgtgtgtgtgtgtgtgtgtgtgttatagggaggggcagcctcaggagacccggagggaccctgtgcttctgttagtctccgtgatgttgacgctgaagccatgaacacacaaagatca

SEQ ID NO: 23424 - DNA, 327 bp, Homo sapiens
  AP001356.3_126041
  Located on chromosome 18
  Distance between a terminus base of telomere on chromosomal short arm and 5'-terminus of this base sequence : 36778591
  Distance between 3'-terminus of neighbour sequence of sequence listing upward to telomere on chrosomal short arm and 5'-terminus of this base sequence : 5757
tttggcttcacatgaattataccaccgggtttcctggttttccagcttgccaacagcatatcatgggacttctctgactcaacaatcacatgagccaattctcataataaatacactctatctatctatctatctatctatctatctatctatccatccatctatcgatctgtctattatctatctatctatctatctatctatctatctatctatctatctatctatctatctatcgtctataccatctatctatctatccatctacccactcatcctttcatccattccattggttatgtttctctggcaaaccttgagtaatac

SEQ ID NO: 23425 - DNA, 442 bp, Homo sapiens
  chr18.fa.O7frz.39325060
  Located on chromosome 18
  Distance between a terminus base of telomere on chromosomal short arm and 5'-terminus of this base sequence : 36833091
  Distance between 3'-terminus of neighbour sequence of sequence listing upward to telomere on chrosomal short arm and 5'-terminus of this base sequence : 54173
atcattctatgaggccagtattaccctgataccagaactggacaaagacacaaaagagagaaagagagaaagagagagagaaagaaggaaggaaggaagggagggaggaaggaaggaaggaaggaaggaagagagggagggagggggaaaaaaagaaagaaagaaaaggaaagaagggaagaaagaaagaaagaaagaagggaagaaagaaagaaagaaagaaagaaagaaagaaagaaagaaagaaagaaagaaagaaagaaagaaagaaagaaagaaaggaaagaaagaaagaaagaaagaaagaaagagaaagaaaagcaagcaagcaagctagctagctacaggccaatgtctctgaggaattattgatatgaaaatcgtgaacaaaataatagcaaactgaattcaacaatacattagaaagattattcatcgcaac

SEQ ID NO: 23426 - DNA, 453 bp, Homo sapiens
  chr18.fa.O7frz.39541639
  Located on chromosome 18
  Distance between a terminus base of telomere on chromosomal short arm and 5'-terminus of this base sequence : 37061849
  Distance between 3'-terminus of neighbour sequence of sequence listing upward to telomere on chrosomal short arm and 5'-terminus of this base sequence : 228316
tgtttatgatacctggcattacttgtggatatcctttcataaaggatgttttgagttccctaacccctcttcttccccaggtatctctctctctctctctctctctctctctctctctctctctctctctctctccctctcctaccatctctttccaatacagttgtgccacaaaattgaatctcatgtaacacatgtattagcgttctgctctttgccttctctgtttgtttcaatttgtatttttttatgtttgtggttgttgtttcttcttagtctttgatgtctttattcaaaagtcaggccattcttgactgcatccatatgttaaaaagaacttgagagctaatggaaagctgaaggcttgggtggagcttgccaacttactaggctgagagggctgtggactgggcttcccagtgggaacatcaaacatcgagatttgtaggactt

SEQ ID NO: 23427 - DNA, 430 bp, Homo sapiens
  chr18.fa.O7frz.39640372
  Located on chromosome 18
  Distance between a terminus base of telomere on chromosomal short arm and 5'-terminus of this base sequence : 37126613
  Distance between 3'-terminus of neighbour sequence of sequence listing upward to telomere on chrosomal short arm and 5'-terminus of this base sequence : 64311
atgcttattggtcattcctatcctctttctgaaatgtcttttcaaattctctgcacatttttaactaggttatttgtcttcttggattatttaggatctttatatactctggatacaagtacttttttcagacataagaattgtgagtttcttagcctgaagcttgcttcttcatatacttaaatgtgtctttaaaaaagcagaattttaatcaattggtgatagaaacaaatagacgatagatagatagatagatagatagatagatagatagatagacagaatctgttttatcaaattatttttttcaagttttgtgatttttatgaattaatgaatctctgctttctctaagttagcaagaattttctgttttcattaataaattttaccttttaatttggtttttaatcattccacattaacgttt

SEQ ID NO: 23428 - DNA, 420 bp, Homo sapiens
  AC046202.2_110254
  Located on chromosome 18
  Distance between a terminus base of telomere on chromosomal short arm and 5'-terminus of this base sequence : 37241593
  Distance between 3'-terminus of neighbour sequence of sequence listing upward to telomere on chrosomal short arm and 5'-terminus of this base sequence : 114550
ctggacgcttcatctacacaacaaaaccattgttggcggggcgtggtggttcacacctgtaatcctagtactttgggaggctgaggtgggcagatcatgaggtcaggagatcaaaactatcctggctaacagggtgaaaccccatctctactaaaaatacaaaaaattagccaggcatggtggtgggcgcctgtggtcccagctactcaggaggctgaggcaggagaatggcttgaacccaggaggcggaggttgcagtgagcagagattgcaccactgcactccagcttgggtgacagagtgagactgtcaaaaaaaaaagaaagaaagaaagaaagaaagaaagaaagaaagaaagaaagaaagaaagaaagaacgttggcttccacaatccccctttgatggttaatattgagtgtc

SEQ ID NO: 23429 - DNA, 241 bp, Homo sapiens
  D18S1128
  Located on chromosome 18
  Distance between a terminus base of telomere on chromosomal short arm and 5'-terminus of this base sequence : 37283544
  Distance between 3'-terminus of neighbour sequence of sequence listing upward to telomere on chrosomal short arm and 5'-terminus of this base sequence : 41531
ctttggatgtggactggagctacatcatcagctttcttgggtctccagcttctcaactgattatcttgggaattgtcaggcttcctaattgcatgattgcatgagtcaattccttctatttccttataataaattctgtgtgtgtgtgtgtgtgtgtgtgtgtatctctctctgtctctatgtgtgtgtttgtgtgtgtgtgtgtataatctccttctctctaaaggcagtttctctgaca

SEQ ID NO: 23430 - DNA, 237 bp, Homo sapiens
  Z17109.1_203
  Located on chromosome 18
  Distance between a terminus base of telomere on chromosomal short arm and 5'-terminus of this base sequence : 37415238
  Distance between 3'-terminus of neighbour sequence of sequence listing upward to telomere on chrosomal short arm and 5'-terminus of this base sequence : 131453
ctctgaactcagaactaatgatcagattatttattttaattcctaaatcatttccttttaagaattctcatgcaacaaaaaatattaattgaattctaaaagtagaaggagtaacttgggttccatcttcaggaaacacatacacacacacatacacacacacacacacacacacacacacacacacacgagaatcagatgctttgggcctatctcatcaagtgcaggtaaagtaac

SEQ ID NO: 23431 - DNA, 123 bp, Homo sapiens
  D18S67
  Located on chromosome 18
  Distance between a terminus base of telomere on chromosomal short arm and 5'-terminus of this base sequence : 37415343
  Distance between 3'-terminus of neighbour sequence of sequence listing upward to telomere on chrosomal short arm and 5'-terminus of this base sequence : -132
aaggagtaacttgggttccatcttcaggaaacacatacacacacacatacacacacacacacacacacacacacacacacacacgagaatcagatgctttgggcctatctcatcaagtgcagg

SEQ ID NO: 23432 - DNA, 210 bp, Homo sapiens
  D18S1096
  Located on chromosome 18
  Distance between a terminus base of telomere on chromosomal short arm and 5'-terminus of this base sequence : 37603645
  Distance between 3'-terminus of neighbour sequence of sequence listing upward to telomere on chrosomal short arm and 5'-terminus of this base sequence : 188179
taggattctccagaggcaaagaataaataaggagtgtgtgtgtgtgtgtgtgtgtgtgtgtgtgtgtgtgtgtgtgtagagagagagagagagagacagaaacagacagaaacagatctaacaaaatgaagtgactcacacaattatcaaggctgaaaagtcccaggatctgtagttgacaaactggagacccctgagagcctatgttta

SEQ ID NO: 23433 - DNA, 218 bp, Homo sapiens
  chr18.fa.O7frz.40136678
  Located on chromosome 18
  Distance between a terminus base of telomere on chromosomal short arm and 5'-terminus of this base sequence : 37650309
  Distance between 3'-terminus of neighbour sequence of sequence listing upward to telomere on chrosomal short arm and 5'-terminus of this base sequence : 46454
gcaagttgtctgaaatcactagatactaggttgccttcttagtcaaatatcaagtccacttctcttcctcaccaatacattaccttttacctcaccagtctcacaaaaacaaccatttgtggctataacacacacacacacacacacacacacacacacacacacacacgtgatttggatgacaaacatggaattttaagtataggcttcaactttgc

SEQ ID NO: 23434 - DNA, 328 bp, Homo sapiens
  AC013361.5_123249
  Located on chromosome 18
  Distance between a terminus base of telomere on chromosomal short arm and 5'-terminus of this base sequence : 37739262
  Distance between 3'-terminus of neighbour sequence of sequence listing upward to telomere on chrosomal short arm and 5'-terminus of this base sequence : 88735
gtaaggcttaggtcaaagaaactgtgaataaacaccatactctagtgtttaatttatttcttacaggggtacaattagcggtcttgagacgcctttacatatatacacacacacacacacacacacacacacacacacacacacatatataaaatccagcaatagatttatatagatctatatataaaaatataaatatggttgaataaagaagtaaataaattgtagatagtgggatccaggtttctttgtgacagagaaagaagtaacaaataagagaatgggaaggctagaatgaattttgtggtgctgaagtacagatgtcagt

SEQ ID NO: 23435 - DNA, 451 bp, Homo sapiens
  chr18.fa.O7frz.40341698
  Located on chromosome 18
  Distance between a terminus base of telomere on chromosomal short arm and 5'-terminus of this base sequence : 37864063
  Distance between 3'-terminus of neighbour sequence of sequence listing upward to telomere on chrosomal short arm and 5'-terminus of this base sequence : 124473
cactaactggtacctaaatctgacagtgaggatcaacagtgatcctaagagaagaactcaaactggaatttcaggaaaaaaaatcttctagagataaatgatgattccaagagcaggagagaccatagagtgggaaaaggaaaggaagaaataatgattcaagccagctctttggcccctcgtcatctctcattcagtgttggaaatttttggtaattgaaatttaccaaatttaaatgtgtgtgtggcggctggtgtgtgtgtgtgtgtgtgtgtgtgtgtgttgctagcttttggaaatagcagatttggtaattcatatttccaaaagctgtaagtacaaacacacacttaaatatttacagattgcttagaagttcacagtgtactaaaatttatattaataaaattctattgattggaccacctaaagtctgttccataccagtct

SEQ ID NO: 23436 - DNA, 166 bp, Homo sapiens
  Z66787
  Located on chromosome 18
  Distance between a terminus base of telomere on chromosomal short arm and 5'-terminus of this base sequence : 38095824
  Distance between 3'-terminus of neighbour sequence of sequence listing upward to telomere on chrosomal short arm and 5'-terminus of this base sequence : 231310
aagccccaacaaagatgctcagtgtttcatgtggagtttatttgatatatacaggggtgtgtgtgtctgtgtgtatgtatgtgtgtgtgtgtgtgtgtgtgtgagagagagagagagagagagagagagaccacacaatttcttatgcctttgtaatgttattttt

SEQ ID NO: 23437 - DNA, 299 bp, Homo sapiens
  DISD22_0011195
  Located on chromosome 18
  Distance between a terminus base of telomere on chromosomal short arm and 5'-terminus of this base sequence : 38359993
  Distance between 3'-terminus of neighbour sequence of sequence listing upward to telomere on chrosomal short arm and 5'-terminus of this base sequence : 264003
cagtcaatgtttatggaactaaggtttatttaagtgatcctattttgagtactctctctctctctctctctctctctttatatatatatatatatacatacacatatatatacacacatatatatattagctcaataaatgtaataaacatagaacatgggtaattttattattgccatttcatagttagaaaccttaaatacaaaatgttgagtaatttgcccagtgtcacatagtctatagcaatgttagaagtcacacccaagaattcttgtttcattggccacaaattcaccact

SEQ ID NO: 23438 - DNA, 386 bp, Homo sapiens
  chr18.fa.O7frz.40733298
  Located on chromosome 18
  Distance between a terminus base of telomere on chromosomal short arm and 5'-terminus of this base sequence : 38468961
  Distance between 3'-terminus of neighbour sequence of sequence listing upward to telomere on chrosomal short arm and 5'-terminus of this base sequence : 108669
tacctatttaggtgcaagtttaactgtaggaagcacttatacatttatttatatatgcacacacatgcacacatgtatatctatatttatatagatataaatataaatataaatatatatatatatatatatatatatattttcactcatttaagagggtttttgacctcttaccatatgccaagcattcttctaggcattgaatatttagtactgaatgaaaaagtcatattttatattcttattgaaattatagtctagtataaaagaaggtcctttactcaagaaaaataaaaaatattttaagatctctacaagtttaaggtctttatctcacagcattataatttttttttgttttattctccagctgtatctcatgtaaa

SEQ ID NO: 23439 - DNA, 288 bp, Homo sapiens
  AP002475.2_169012
  Located on chromosome 18
  Distance between a terminus base of telomere on chromosomal short arm and 5'-terminus of this base sequence : 38555419
  Distance between 3'-terminus of neighbour sequence of sequence listing upward to telomere on chrosomal short arm and 5'-terminus of this base sequence : 86072
aatcagattcatagactgttaggtttttatgcacaactatttacattcaattattcagtcaatgccatggagacagggttacaagattgaaagatgaatattttctgttacccgtctctgtgtgtgtgtgtgtgtgtgtgtgtgtgtgtgtgtgtgtgtgttttaacataacaagaaactgctacctggatatcaagaagcaatcatcttgcagttaatatgaaagataaaaacaaaacaaaacatatcttcatcacagctatccaagcagaacatcaatgactaaac

SEQ ID NO: 23440 - DNA, 258 bp, Homo sapiens
  chr18.fa.O7frz.40955283
  Located on chromosome 18
  Distance between a terminus base of telomere on chromosomal short arm and 5'-terminus of this base sequence : 38577053
  Distance between 3'-terminus of neighbour sequence of sequence listing upward to telomere on chrosomal short arm and 5'-terminus of this base sequence : 21346
tgaacttaaactttgaccaattaccaaatatttattaagcatctctgataaacaatgtgaagccatgcgtacacacacacacacacacacacacacgcacacacacacacacacacacacaatgtataatcttggtcgtgtgtccaaattgtgaagacagtaaataaaattaactttacattaatgttattctacttttttgtttttgtagtttttaaagctatttattcaacgctaactagtcaagccatattctca

SEQ ID NO: 23441 - DNA, 184 bp, Homo sapiens
  D18S860
  Located on chromosome 18
  Distance between a terminus base of telomere on chromosomal short arm and 5'-terminus of this base sequence : 38881285
  Distance between 3'-terminus of neighbour sequence of sequence listing upward to telomere on chrosomal short arm and 5'-terminus of this base sequence : 303974
tgaataaaattgggagcagcgtatatattctgccacttctaaaatcaactctggcttcttgagttggaaaacaccagatttgctattcattctttattattattattattattattattattattattattattatttgtttccaccactatctttgcctttccagtgtcttgacaaagtgaaa

SEQ ID NO: 23442 - DNA, 170 bp, Homo sapiens
  D18S855
  Located on chromosome 18
  Distance between a terminus base of telomere on chromosomal short arm and 5'-terminus of this base sequence : 38881285
  Distance between 3'-terminus of neighbour sequence of sequence listing upward to telomere on chrosomal short arm and 5'-terminus of this base sequence : -184
tgaataaaattgggagcagcgtatatattctgccacttctaaaatcaactctggcttcttgagttggaaaacaccagatttgctattcattctttattattattattattattattattattattattattattatttgtttccaccactatctttgcctttccagtgtc

SEQ ID NO: 23443 - DNA, 372 bp, Homo sapiens
  chr18.fa.O7frz.41536149
  Located on chromosome 18
  Distance between a terminus base of telomere on chromosomal short arm and 5'-terminus of this base sequence : 39166232
  Distance between 3'-terminus of neighbour sequence of sequence listing upward to telomere on chrosomal short arm and 5'-terminus of this base sequence : 284777
cagactatgtcaattgctaaattaagaaggaaaaatcaagacttcattgatgtatacacagagagcttaccctgatgtgtgtgtgtgtgtgtgtgtgtgtgtgtgtgtgtgtgtgttgacagagagagccaaagggaagagaaagagagagagagaaggcccagaggctggggaaagttaataaaggtgtagaatgtatagaatgagccattcatgctcagagccaaacaatggatttaaactgctcaagaatcattatttactaggtatctttataatttccttcctttaaaatggtctactgattttataaaatttcttatccctacaaaaaaacaaaagacaaaacttaatcatagactgccttgagtt

SEQ ID NO: 23444 - DNA, 101 bp, Homo sapiens
  DISD22_0011206
  Located on chromosome 18
  Distance between a terminus base of telomere on chromosomal short arm and 5'-terminus of this base sequence : 39308702
  Distance between 3'-terminus of neighbour sequence of sequence listing upward to telomere on chrosomal short arm and 5'-terminus of this base sequence : 142098
ctaggattaagtgatggaaattccaaagacacaaatgtatgtctaataactatatatatatatatatatatatattcaccaaacacataagaaggcatgat

SEQ ID NO: 23445 - DNA, 120 bp, Homo sapiens
  D18S1157
  Located on chromosome 18
  Distance between a terminus base of telomere on chromosomal short arm and 5'-terminus of this base sequence : 39413979
  Distance between 3'-terminus of neighbour sequence of sequence listing upward to telomere on chrosomal short arm and 5'-terminus of this base sequence : 105176
ggattcaatagcagattggaaataacagaagaaacaatcaaagcacacacacacacacacacacacacacacacacagaaaaaagccatagaaaataaattgaacaggatctcaggaatc

SEQ ID NO: 23446 - DNA, 456 bp, Homo sapiens
  AP001799.2_130776
  Located on chromosome 18
  Distance between a terminus base of telomere on chromosomal short arm and 5'-terminus of this base sequence : 39467214
  Distance between 3'-terminus of neighbour sequence of sequence listing upward to telomere on chrosomal short arm and 5'-terminus of this base sequence : 53115
atctttcaagaatcctcttgacatgacaggtttttatacaaaagttttagattactggcattgacaggtaggagatgaaaagtcacataggaataaaacgtgtggtagtagggaaggataggaaattgtagtaaacaattgataaatcagaacacagagggcacaagaagactgaaataaaatactagaatggtaggctgaaaacatactgtgttcaatgcaccagactagaaacacatctctctttctctctgtctctctctgtctcgtgtgtgtgtgtgtgtgtgtgtgtgtgtgtggtgcctgtccactatgagttttcacacaacatttgcttcatgaatgaatgagaaggtaaatgatggataaacagaaataaaacaacatatccctgaagcagagactaccttggcaaacaagttaaaccagcatttctcaatcttggcattattgata

SEQ ID NO: 23447 - DNA, 346 bp, Homo sapiens
  chr18.fa.O7frz.41838987
  Located on chromosome 18
  Distance between a terminus base of telomere on chromosomal short arm and 5'-terminus of this base sequence : 39506638
  Distance between 3'-terminus of neighbour sequence of sequence listing upward to telomere on chrosomal short arm and 5'-terminus of this base sequence : 38968
tccatatggagtaagagtggtgctgatctatattagggagaaaaagtactcctcagtaaacacaacatgctgatatagaatagttcagggttttttgttttgttttcttttgctttgttccttggattggtgtgtagatgtgtgctggagaggagggaagcatcacatacaacattaagcataccttggcgggaattgctttgtaaatgaaccctaaagtaaatgtctttatatatacaccacacacacacacacacacacacacacacacaaagaaacacacacattatgaacaaaagaaatttaaaataaaacttgtcccttgtaacgtgaacctatgtgaatg

SEQ ID NO: 23448 - DNA, 399 bp, Homo sapiens
  AF097649.1_13030
  Located on chromosome 18
  Distance between a terminus base of telomere on chromosomal short arm and 5'-terminus of this base sequence : 39588411
  Distance between 3'-terminus of neighbour sequence of sequence listing upward to telomere on chrosomal short arm and 5'-terminus of this base sequence : 81427
aagtcaatctaccagcactcagtaattctattccagcatacgttgataatagaccaattgcaacatcatgcctttctcttagtggggaaatgaatcttgagacttccagaggcatctcaagcacaaaaccttcaaaacaaaacaaaataagctataaggctacatattgaaacccccttaggttatgaagaggaaagcaaagtgttcagtcgaagagaccctgaactacacacacacacacacacacacacacacacacacgcacacacacacgcacacacacacacacacacatcagactgttttgatcaaactgttttgataactcttaatagtgtttaaggaaaatggatgaaattgttatccacagtcccatatttcctgtctatctcaagttcc

SEQ ID NO: 23449 - DNA, 285 bp, Homo sapiens
  D18S468
  Located on chromosome 18
  Distance between a terminus base of telomere on chromosomal short arm and 5'-terminus of this base sequence : 39738636
  Distance between 3'-terminus of neighbour sequence of sequence listing upward to telomere on chrosomal short arm and 5'-terminus of this base sequence : 149826
aatcaaaatggcaatgtcggtggagtccagtacaagatcattcaactagaatacatagcaaacgttgcattttacattgcaaactcagacccctgcataaactcactcacacatacaaacacacacacacatacacacacacacacacacacacacacacacacacgttttctgaaataataatcttaaatatggattatgtcctttggaatgttctcttctttctcttctatttcttgtaaaatattacatcaagggtactaataggctgctctccacacattt

SEQ ID NO: 23450 - DNA, 218 bp, Homo sapiens
  D18S1120
  Located on chromosome 18
  Distance between a terminus base of telomere on chromosomal short arm and 5'-terminus of this base sequence : 39748727
  Distance between 3'-terminus of neighbour sequence of sequence listing upward to telomere on chrosomal short arm and 5'-terminus of this base sequence : 9806
tcaacttttcatcacagcacttacatctattaaatagtcaataaaaaacactttttcctcgtgttagggtatttattagtttttaatataatgtatttgatatattttcttcttcatctattttatatgtatttaaacatataaaattatttatacacacacgcatacacacacacacacacacacacacacacaccccgatggtaatgtagtagatt

SEQ ID NO: 23451 - DNA, 251 bp, Homo sapiens
  G08014
  Located on chromosome 18
  Distance between a terminus base of telomere on chromosomal short arm and 5'-terminus of this base sequence : 39847298
  Distance between 3'-terminus of neighbour sequence of sequence listing upward to telomere on chrosomal short arm and 5'-terminus of this base sequence : 98353
  misc_feature (1)...(251): n = A,T,G or C
gccaaatgtagatcttgggacttgtcagattccacaattttatgagccaaattcttgtaataaatttatctatctatctatctatctatctatctatctatctatctatnnnntatttctattggttcagtttatccaaagaatgctgaataatacagaaggtaatggggatgtttgagaatttgaagaaaggccaattggcttaagcattgtgaccatgggagacagaggcacaagatgatactgaagaa

SEQ ID NO: 23452 - DNA, 197 bp, Homo sapiens
  D18S865
  Located on chromosome 18
  Distance between a terminus base of telomere on chromosomal short arm and 5'-terminus of this base sequence : 39847314
  Distance between 3'-terminus of neighbour sequence of sequence listing upward to telomere on chrosomal short arm and 5'-terminus of this base sequence : -235
  misc_feature (1)...(197): n = A,T,G or C
gggacttgtcagattccacaattttatgagccaaattcttgtaataaatttatctatctatctatctatctatctatctatctatctatctatnnnntatttctattggttcagtttatccaaagaatgctgaataatacagaaggtaatggggatgtttgagaatttgaagaaaggccaattggcttaagcattgt

SEQ ID NO: 23453 - DNA, 459 bp, Homo sapiens
  chr18.fa.O7frz.42464141
  Located on chromosome 18
  Distance between a terminus base of telomere on chromosomal short arm and 5'-terminus of this base sequence : 39976663
  Distance between 3'-terminus of neighbour sequence of sequence listing upward to telomere on chrosomal short arm and 5'-terminus of this base sequence : 129152
ttccatctaaagaaatttgtttagccattatttgagaatatactgctctccttcatttctgaaagatcttttccctggagatagggttctgagttgagagctcttcccctttcacatcctcttacacacacacacacacacacacacacacacacaccacaacacacgtacacaaactgaaaaacagtgtactacttcctttgggactctatgttgtataatgagaaatctgctatcatcaaattgttttcctatcttgtaggtatggctctggctgctttcaaatatttttcacctttagttttcagaagtttaattataatttatcttgacttgaatttatttgggtttatcttgtttagaattttcctagtttcttgaataaaaaggtttatgtgtcttgccaaatttaaagttttcagtcattagttttccttgtacagtttcatctcactgtat

SEQ ID NO: 23454 - DNA, 470 bp, Homo sapiens
  AC034299.2_129880
  Located on chromosome 18
  Distance between a terminus base of telomere on chromosomal short arm and 5'-terminus of this base sequence : 40045497
  Distance between 3'-terminus of neighbour sequence of sequence listing upward to telomere on chrosomal short arm and 5'-terminus of this base sequence : 68375
cttaatccagatctgcattaatctgctctcattatcctgcttctttcctgattagctggaggtcaaaaaatctggacttgtacatgctgactgcctgacctgctgaggtggatggcagatgcagggcagccttcagacctgagtaagagaaagtccatctcaatgtcctcctgggctttcaattcagtgacaaattgcagggtaaaaatcttccgattggggtgaggtgggattcttttcaaaagtctttccagagcaaatgagtttgcatgaaaatctgacactagtaatcacatactttggcacagagaaataggttggaatagagtgtgtgtgtgtgtgtgtgtgtgtgtgtgtgtgtgtgtgtgtgtgtgtgtgtgttgggggtgaaaggtgaaggatggtctggaggggaatgttttcccagaaaagaagcacttttacaagtgtcaacaggatgactaaagtga

SEQ ID NO: 23455 - DNA, 327 bp, Homo sapiens
  chr18.fa.O7frz.42569172
  Located on chromosome 18
  Distance between a terminus base of telomere on chromosomal short arm and 5'-terminus of this base sequence : 40090141
  Distance between 3'-terminus of neighbour sequence of sequence listing upward to telomere on chrosomal short arm and 5'-terminus of this base sequence : 44174
tagtgatctaatgtacagcatgaggaccgtagttaatattattgtatactaaaaattttctaagataggagattcttgtgcatttaccacacacacaccacacacacacacacacacacacaagataattttggggggtgaaggatatactaatttgcttgactataataataatttcatgatgtatatgtatatcaaatcatcatattgtatactttaaatacatagagtaatttaaaaacataacaggttttccttccttacagcaatgttgctccaagtatgttcccaagatcatcgtgcctgaataaacttaaatgccaatta

SEQ ID NO: 23456 - DNA, 283 bp, Homo sapiens
  chr18.fa.O7frz.42884060
  Located on chromosome 18
  Distance between a terminus base of telomere on chromosomal short arm and 5'-terminus of this base sequence : 40405539
  Distance between 3'-terminus of neighbour sequence of sequence listing upward to telomere on chrosomal short arm and 5'-terminus of this base sequence : 315071
ctcaaggaagttaggttgagtaggggaaaaaaaagccagtttcaaagggtttgaatgtttgattctactcatataacattcacgaaataattatagatatagagaataaattagcggctgtcaagggctaggggaagaaggaaagtggttgctacatgggtgccacatacacacacgcacacaaacacacacacacacacacacaccaaataacatacaaattatttcatgtataactggtaaaatataaataagcactgtgaattataccaatgcttatttc

SEQ ID NO: 23457 - DNA, 412 bp, Homo sapiens
  AC025835.2_152292
  Located on chromosome 18
  Distance between a terminus base of telomere on chromosomal short arm and 5'-terminus of this base sequence : 40516850
  Distance between 3'-terminus of neighbour sequence of sequence listing upward to telomere on chrosomal short arm and 5'-terminus of this base sequence : 111028
aatttaagtttcttatagatgccagatattacacctttgttgaaagtacagtttgcaaaatttttatcccattctgtagtttagacaaactctattgacagtttcttttgttgtgcagaagctttttagtttccatacaccaacaacagtcaagccaagagccaaattgggaatgaactctcattcacaactgtcatgacacacacacacacacacacacacaatacctaggaatacagctaaccaaagaggtgaaagatctataaaccactgctcaaagaaatcagagatgacacaaacaaatggaaaaacattccatgctcatgagtacaaacaatcattatcattaaaatgcccaaattgcccaaagcaatttaaagattcaatgctatgcctattaaactaccattga

SEQ ID NO: 23458 - DNA, 412 bp, Homo sapiens
  chr18.fa.O7frz.43075117
  Located on chromosome 18
  Distance between a terminus base of telomere on chromosomal short arm and 5'-terminus of this base sequence : 40557930
  Distance between 3'-terminus of neighbour sequence of sequence listing upward to telomere on chrosomal short arm and 5'-terminus of this base sequence : 40668
ttaccactgctatgcaatatagtactggaagttctagccagggcaattaggcaagaaagatcacacacacacacacacacacacacacacacacacacctgttagaactaataaataaattcagcaaagtatcagaatacaaaatcaacatataaatatcaattgcatttatatacactaacaatgagcaatctgaaaaaatgaaattataaaaacaattccatttacagtagcatcaaaaagaaaaaaaacttagaaattaacaatggaggtgaaggaccaccatatattgctgaaagaaatttaaaaagacataaacaaatgaaaatacatcccatgttcatgaactggaagacctaatagtgttaagaagccaacagcacccaaagttatttacagatttcatgcagtc

SEQ ID NO: 23459 - DNA, 277 bp, Homo sapiens
  AC021504.3_19419
  Located on chromosome 18
  Distance between a terminus base of telomere on chromosomal short arm and 5'-terminus of this base sequence : 40717744
  Distance between 3'-terminus of neighbour sequence of sequence listing upward to telomere on chrosomal short arm and 5'-terminus of this base sequence : 159402
gtagcactatctcagcaatgaggtaatgaaacaaatatttaaatatttaaatttcagcacagagatatagattgatattttttcaggctgtagctagtagttgtatttggtgattaactgcacgcttcctctctctctctgtttcacacacacataaacacacacacatgcaaacacacacacacacacacacacacacacacacatgcatacatacatcatttgcctattattttcccacagataaccagaggacagatatttgccgtcaagatag

SEQ ID NO: 23460 - DNA, 363 bp, Homo sapiens
  chr18.fa.O7frz.43403606
  Located on chromosome 18
  Distance between a terminus base of telomere on chromosomal short arm and 5'-terminus of this base sequence : 40889931
  Distance between 3'-terminus of neighbour sequence of sequence listing upward to telomere on chrosomal short arm and 5'-terminus of this base sequence : 171910
tatcctgtttcagctttcatacagaaacgaccagagtatgaaaatggtagtggacagtgcagtgtataaacagtgtgggaaagaaagggtgggtcttgataattcaaagtactccctaaaccactttgaccacaatgacataaatatttcaagcaagaaatacacacacacacacacacacacacacacacacacacacgagaaagagagagagacagatgagagagaaaaagaaagagagagagggaatgtgcgtgtaggtgcatgcacagcatgtgtgaatgcaggtcatgtaactaattgttttaattctttaatcaatttgttaacatagatcttctttcggcatactgctattaagta

SEQ ID NO: 23461 - DNA, 343 bp, Homo sapiens
  AP002894.1_27822
  Located on chromosome 18
  Distance between a terminus base of telomere on chromosomal short arm and 5'-terminus of this base sequence : 41041492
  Distance between 3'-terminus of neighbour sequence of sequence listing upward to telomere on chrosomal short arm and 5'-terminus of this base sequence : 151198
tactgttgatcctgagaaacagtaagtttggggttcttgttgctcatttagcaaaaataaacttacaaaaaacaggaaggaaaggaaggaaggaaaggaaggaaggaaaggaaggaaggaaagaaggaaggaaggaaggaaggaagggaaggaaagaaggaaggaagggagggacacatacacagaaaacccacatagaaaacacttccttgtgttactgttcacctcgatatctcatgaccaagtaatctgtcacactcacaggaggagagctgacattgggaagaacagaaaggggagggtggatagaatgagaaacagagtacgaacttgaagtttctga

SEQ ID NO: 23462 - DNA, 285 bp, Homo sapiens
  chr18.fa.O7frz.43895123
  Located on chromosome 18
  Distance between a terminus base of telomere on chromosomal short arm and 5'-terminus of this base sequence : 41137201
  Distance between 3'-terminus of neighbour sequence of sequence listing upward to telomere on chrosomal short arm and 5'-terminus of this base sequence : 95366
ggtaacatgaactgactttgattttagcagctgcactctggttacttttgataagaaactgtaggagggtgaaaagtttgaagaagagaagcaatcaggaggctattgcagtaatcaagatgagaaatcatggtggctgggttcttagggcttatagtggtagaggtggtaagaagtggctagatttctctccccattcttattttactttctggttattttatttatttatttatttatttatttatttatttatttattttaattagcgcatcaactagtaat

SEQ ID NO: 23463 - DNA, 478 bp, Homo sapiens
  chr18.fa.O7frz.44032251
  Located on chromosome 18
  Distance between a terminus base of telomere on chromosomal short arm and 5'-terminus of this base sequence : 41259030
  Distance between 3'-terminus of neighbour sequence of sequence listing upward to telomere on chrosomal short arm and 5'-terminus of this base sequence : 121544
gcattgcatgaaataagattagatattgtttcatgaatattctctctctctgctctctttctctctctctctctctctctctctctcacacacacacacacacacacacacacgattatttgatttaaaatgtatttctcacaatgagtcatattaggatgtttaaaaactactaccatagacctaaagcttcttaaaaataaggaagtatctgttttattaccactaaatgtcctatgccctagcacagtgcctcacccaaacaaggtattcaataagtatttgttgaatgactgctcttgttcacccctattatcttacagtcataatgtccagagaggtaaaatgtattttctaaagttataatttgggttaataatcaaatcagggattcttggtcctgagtcattttaaaatgctttcttctccacgcttcaaaaaattactggtataattgtcattgcattatcgacttaaa

SEQ ID NO: 23464 - DNA, 413 bp, Homo sapiens
  chr18.fa.O7frz.44145595
  Located on chromosome 18
  Distance between a terminus base of telomere on chromosomal short arm and 5'-terminus of this base sequence : 41466409
  Distance between 3'-terminus of neighbour sequence of sequence listing upward to telomere on chrosomal short arm and 5'-terminus of this base sequence : 206901
tgagctgagatcgtaccattgcactccagcctgggcaacaagagggaaactctgtctaaaaaaaaaaaaaagaagaagaagaagaagaagaaaactcactgctatattacttttgtaggtaataaatttattttaatgctgatatcacttatttaaaataatttatttttttctttagaaatagaatctcgctatttttcctgggctggtattaaactcctggcctcaagcaatcctcctgactcagcctcccaaagtactgagtgtataggtgtgagccatcacgcctggccctctttaaaatatttttgttgttattttaattttcttttgctgctgtaagaaattaccacaatttttgtggatggaaacaaaacaaatttattactctacagttctaaggtcagaagtca

SEQ ID NO: 23465 - DNA, 169 bp, Homo sapiens
  chr18.fa.O7frz.44316552
  Located on chromosome 18
  Distance between a terminus base of telomere on chromosomal short arm and 5'-terminus of this base sequence : 41542913
  Distance between 3'-terminus of neighbour sequence of sequence listing upward to telomere on chrosomal short arm and 5'-terminus of this base sequence : 76091
gtacatgactggttgcactaacttcagaaggagggtgagagctgggattcccaggcatgtaaacacacacacacacacacacacacacacacacacacacacacgcacacttctacatattctcttgtttttcttatgctgtttcctctgcctagaatcttactatggc

SEQ ID NO: 23466 - DNA, 251 bp, Homo sapiens
  D18S1136
  Located on chromosome 18
  Distance between a terminus base of telomere on chromosomal short arm and 5'-terminus of this base sequence : 41616615
  Distance between 3'-terminus of neighbour sequence of sequence listing upward to telomere on chrosomal short arm and 5'-terminus of this base sequence : 73533
ctttttggtcttaggtaaattgtctattcaaacaaatttccgtgtgtgtgtgtgtgtgtgtgtgtgtgtgtgtgtgtgtgtataacttattttcttcttttgcataatctgaacgcatcaatgaaggccttccaaggatgcaatatggtcagttccatgaatgatatccttgcatactgcattctcagattcttctcattctagggctctgtgtcagaaactgttgtgtggaacaagacccactaacttgg

SEQ ID NO: 23467 - DNA, 320 bp, Homo sapiens
  chr18.fa.O7frz.44495662
  Located on chromosome 18
  Distance between a terminus base of telomere on chromosomal short arm and 5'-terminus of this base sequence : 41753617
  Distance between 3'-terminus of neighbour sequence of sequence listing upward to telomere on chrosomal short arm and 5'-terminus of this base sequence : 136751
cactataccactttgcaggtagtgtgaatataataactgagttaaattatcaaagtacattattaaaattgatttaacttgttcctttttaatcttttctgtggcttctagacaatttaaaattacatgtgtgactcacatatttattctggataataatagtctcaagtatgcttccacttggggagaaaaaaatgtatgtgtatatatatatatatatatatatatatatatatgctagataatggacatttatttttatttctaatttttctgagttttatttttggttcagggagtacaggtgcagtttctttaca

SEQ ID NO: 23468 - DNA, 131 bp, Homo sapiens
  Z66996
  Located on chromosome 18
  Distance between a terminus base of telomere on chromosomal short arm and 5'-terminus of this base sequence : 41928235
  Distance between 3'-terminus of neighbour sequence of sequence listing upward to telomere on chrosomal short arm and 5'-terminus of this base sequence : 174298
aaggccgttctgagggcagaagaaactaacacacacacatacacacacacacacacacacagagatgtaaatacacacatacacacactttcatactttcttttctccttcccagtactattgagtaaaaa

SEQ ID NO: 23469 - DNA, 156 bp, Homo sapiens
  D18S1123
  Located on chromosome 18
  Distance between a terminus base of telomere on chromosomal short arm and 5'-terminus of this base sequence : 41960143
  Distance between 3'-terminus of neighbour sequence of sequence listing upward to telomere on chrosomal short arm and 5'-terminus of this base sequence : 31777
cgagaacccttgtcccttagaagcacaaagcctagaggcaagattactttaacacaaagtgaatgtgtgtgtgtgtgtgtgtgtgtgtgtgtgtgtgtaatctgaaggaaaataaattagatgtgagtttccttgaggacttcagcaggtaatggt

SEQ ID NO: 23470 - DNA, 196 bp, Homo sapiens
  Z66609
  Located on chromosome 18
  Distance between a terminus base of telomere on chromosomal short arm and 5'-terminus of this base sequence : 41977142
  Distance between 3'-terminus of neighbour sequence of sequence listing upward to telomere on chrosomal short arm and 5'-terminus of this base sequence : 16843
agtttaaaacctgtaggggctttgtgtgtatgtgtgtgtgtgtgtgtgtgtgtttgtgtttaattatgagagaaaaaaactaaggagaaaaattttgataatgaagaaaaatgcagagcacatactatcaagactttattgatagaatttcagcaagttattctatgcctgataaaaggtcatattcagagagcca

SEQ ID NO: 23471 - DNA, 172 bp, Homo sapiens
  D18S65
  Located on chromosome 18
  Distance between a terminus base of telomere on chromosomal short arm and 5'-terminus of this base sequence : 42030891
  Distance between 3'-terminus of neighbour sequence of sequence listing upward to telomere on chrosomal short arm and 5'-terminus of this base sequence : 53553
gctggtcttactatctcaggggtgaaagagatagaagaaaatttaaatataagtggatccatgcatttcaaacccatgttgttcaagattcaactctgtgtgtgtgtgtgtgtgtgtgtgtgtgtgtatgtgtgtataagttatataatcaaacactgcaatttcctgcctc

SEQ ID NO: 23472 - DNA, 202 bp, Homo sapiens
  Z66691
  Located on chromosome 18
  Distance between a terminus base of telomere on chromosomal short arm and 5'-terminus of this base sequence : 42067420
  Distance between 3'-terminus of neighbour sequence of sequence listing upward to telomere on chrosomal short arm and 5'-terminus of this base sequence : 36357
agctagtgctcctgattctgagtatttgtagttcaatctatggatatcattcatttggatttacagtattgtcttgaattatctaatgcacctacatctatacatataattatacacacacacacacacacacacacacacacacaccatgcacttgattatcgagtacagccagagcctaactgctgagtgttgaggaaat

SEQ ID NO: 23473 - DNA, 152 bp, Homo sapiens
  DISD22_0011223
  Located on chromosome 18
  Distance between a terminus base of telomere on chromosomal short arm and 5'-terminus of this base sequence : 42389815
  Distance between 3'-terminus of neighbour sequence of sequence listing upward to telomere on chrosomal short arm and 5'-terminus of this base sequence : 322193
aagtcctcactgtaacaattgcgttttaaaaaagaaacatgcacacacacacacacacaaacacacacacacacacacacacacacaccccatagggtttttaaattcttacttgctgaaaaaaagccattctaatatagaaatatgccagc

SEQ ID NO: 23474 - DNA, 465 bp, Homo sapiens
  chr18.fa.O7frz.45202090
  Located on chromosome 18
  Distance between a terminus base of telomere on chromosomal short arm and 5'-terminus of this base sequence : 42565911
  Distance between 3'-terminus of neighbour sequence of sequence listing upward to telomere on chrosomal short arm and 5'-terminus of this base sequence : 175944
caactgactaacattgacgttaaaacagaggtcctaagactgacataacatactctttgtagcaataagatacaaaattccaaccagactctagtattgagtcacttgacagtttgcaggggcctgaaagaaaccaaagtagctcacccaagatatatgtgtatagatagatagatagatagatagatagatagatagatagatagttagatatatatagatagatatagatagatacatatatagatatctatctatatacatatatagatatagatatatagatatatatagatatatagatacagatatagatagatatatagatatatatagatagatatatagatatatctatagatatctatagatatatatatggatatctatagatatctatatatatctttaacatattttgaaatggccctgcaaagctgtatcttgttggtgaaatttgcattc

SEQ ID NO: 23475 - DNA, 428 bp, Homo sapiens
  AC022743.3_150064
  Located on chromosome 18
  Distance between a terminus base of telomere on chromosomal short arm and 5'-terminus of this base sequence : 42606119
  Distance between 3'-terminus of neighbour sequence of sequence listing upward to telomere on chrosomal short arm and 5'-terminus of this base sequence : 39743
tcattgttaaacgtggtcttacacattcacacttagctattaatggtttaaattatttaaaatagcaaatccattatccacctagaactgaaggaattataaacaaattactaatatttgcattaatctttagaatttacaaagtgttcatacatacacacacacacacacacacacacacacagtgtaatctcatgataatcttacaatattcccttgagatatggtacgtatgttagatattattcataccacttataaaaggtgagggaaatgattcagagggtttaagtgacctatccacagccactgagctacggatatcagtggaagaagataaattgaaactcaagtttttccattctaagacctaagccttcaaaaaatgtgtttcctgtagttatctatgccaatcataagtgatttat

SEQ ID NO: 23476 - DNA, 424 bp, Homo sapiens
  chr18.fa.O7frz.45325146
  Located on chromosome 18
  Distance between a terminus base of telomere on chromosomal short arm and 5'-terminus of this base sequence : 42698453
  Distance between 3'-terminus of neighbour sequence of sequence listing upward to telomere on chrosomal short arm and 5'-terminus of this base sequence : 91906
gaccttctgattatgtgagttaatacttagtaaactcctctttgtgtgtgtgtgtgtgtgtgtatatatatatgtgtgtgtgtgtgtgtgtgtgtatatatatatatatcctattctgtctctctagataatcttgactaatatacccacccttctcacccacccttcttccaatattcacttgcctgcttctctggtacatatagcgcattaacagtgttctccccacagctttaaaatgcacgtatttcacctccaactagtcaaagaaaatgagaatctctgtgcttctcagtctgaattccaaaattcctgcagagataatctaattggctatacttacataaggagcccacaccagattggagctacaattactaaaggtcaaggccacattatgtaaaatagcttctaaggtccactg

SEQ ID NO: 23477 - DNA, 397 bp, Homo sapiens
  AC073843.1_126735
  Located on chromosome 18
  Distance between a terminus base of telomere on chromosomal short arm and 5'-terminus of this base sequence : 42814450
  Distance between 3'-terminus of neighbour sequence of sequence listing upward to telomere on chrosomal short arm and 5'-terminus of this base sequence : 115573
aaatcttggtcttcagtttagatttttttcctgtgctccagaactctatttccactgcacgttatgatattatatttctattttcatgttacaaaagcatcaccaattcaattcccctttaacaattgaacttaccctctaaaacctgtgggtgaaggggtgtgtgtgtgtgtgtgtgtgtgtgagtgtgtttaggcatatacatgttccaaatataaatgaatgccatcattagctacctgacaactaaaataaaagtctaatgttgtcactgactactttggcttcctcttgctatatccaccctccacagatcaccagttctatttacttatatattttttaaacctataactttcattcgattccagcagccttcatcctagtttaggctgtt

SEQ ID NO: 23478 - DNA, 198 bp, Homo sapiens
  G10062
  Located on chromosome 18
  Distance between a terminus base of telomere on chromosomal short arm and 5'-terminus of this base sequence : 42950233
  Distance between 3'-terminus of neighbour sequence of sequence listing upward to telomere on chrosomal short arm and 5'-terminus of this base sequence : 135386
gccttcaggtgaagtcaagaaatacacgcatggttcttttgggtatctagcctgccaagagtggatcttgagatttctcagcctccataatcacatgagccaactccctatatctatctaatctatctatctatctatctatctatctatctatctatctatctactatatattactggtctgtttctctggagaacc

SEQ ID NO: 23479 - DNA, 388 bp, Homo sapiens
  chr18.fa.O7frz.45675210
  Located on chromosome 18
  Distance between a terminus base of telomere on chromosomal short arm and 5'-terminus of this base sequence : 43038837
  Distance between 3'-terminus of neighbour sequence of sequence listing upward to telomere on chrosomal short arm and 5'-terminus of this base sequence : 88406
aggaatagttgactgtccaatcatattcattaaaagactgttcattttatacttcgctgcagtgtcacgactgtcatcataggtccatattatcattgtcctgtttctagactccatttatttggccttttgttattcttagcttaactgtatgatgatctaatttctgtagatttaaaagtattgatatctaatataaaatgcattcactcagtttttcctttttaaaggctttttcaactcttcttggctctttccattatcacatacattttagaatcagttcattaagttataagatacacacacacacacacacacacaacccccagaagaaaaagcaaactttcacaatattgattgatattgaatcaaattcatagattgg

SEQ ID NO: 23480 - DNA, 404 bp, Homo sapiens
  chr18.fa.O7frz.45776454
  Located on chromosome 18
  Distance between a terminus base of telomere on chromosomal short arm and 5'-terminus of this base sequence : 43140211
  Distance between 3'-terminus of neighbour sequence of sequence listing upward to telomere on chrosomal short arm and 5'-terminus of this base sequence : 100986
taattggtgaattcatagcaagatttgggtgggaatttcaataaatcttgttttgtagggctgccagctaagttttgtgactttgaacaaataactgcattctaactagatggggaataatactgttgaaagtggtgctttctctgtgataagtccatgtgtaagtggtattgtgtgtgtgtgtgtgtgtgtgtgtgtgtgtgtgtgtgtgtgcgtgcagtggcatacacaggttagccagataatttgaatgtgcagatcagactttttgatactctatgtcttatttatcttgcttactttaaatcagaatctttatatgccaaaatagacagaataaagatttagcatttttctagtatatataatgatgttgatggatgtcatagatgtttcaaatctgc

SEQ ID NO: 23481 - DNA, 290 bp, Homo sapiens
  chr18.fa.O7frz.45853937
  Located on chromosome 18
  Distance between a terminus base of telomere on chromosomal short arm and 5'-terminus of this base sequence : 43239376
  Distance between 3'-terminus of neighbour sequence of sequence listing upward to telomere on chrosomal short arm and 5'-terminus of this base sequence : 98761
atactttcatccttctcctgatcaaaatgaaagccttaaaacactccagtcatatcacatctcccatccccttaattttttctgtgtgtgtgtgtgtgtgtgtgtgtgtgtgtgtgtgtgtgttagctatccaatgtcttaagcaaattatttcattttatattttgcctaatttttctagttgtcctgagataattagtctgaatttatgtcaagaaattctatttctatttttgcttcctgaggtttttacttatattcttcaagttcagcaatgactttagattaat

SEQ ID NO: 23482 - DNA, 313 bp, Homo sapiens
  AC067801.2_170716
  Located on chromosome 18
  Distance between a terminus base of telomere on chromosomal short arm and 5'-terminus of this base sequence : 43376825
  Distance between 3'-terminus of neighbour sequence of sequence listing upward to telomere on chrosomal short arm and 5'-terminus of this base sequence : 137159
tttcaaatcctgttactgtcagtgggaatctggacaattttaaagccagggtgagaatatatcaaccttcttaaacataaatattacatagtcaaacatcacctagaaaccaagtggtggagctgtgtgtcatccaaaataatgttaaagacatgcatatatgtatatatatatatatatatatatatatatataaaatgaaagttatttacatatataaccttcagtatacacatgcatgcatgtaagttatgaaagttatatatacatgcatgtatgtaactttcattacatatgcagaataacttgaaag

SEQ ID NO: 23483 - DNA, 463 bp, Homo sapiens
  chr18.fa.O7frz.46409075
  Located on chromosome 18
  Distance between a terminus base of telomere on chromosomal short arm and 5'-terminus of this base sequence : 43483526
  Distance between 3'-terminus of neighbour sequence of sequence listing upward to telomere on chrosomal short arm and 5'-terminus of this base sequence : 106388
taccttattgtggaggtaatgtagtcaacaatagacaacatgacccacaaatattcttaataagacagaaatgaactgcaatacacagccttacttggaaagcaaagcaaagaatgaggcttccactttcacttttttctttgagaaataaatttttttctgaggattcttatgtattacatgggacatgagaccttttcatacaaggtttagtgcaggccgtttgtttattaaatatgaataaagttaattttccaagtttaagttaaatttaaatggaaatcaaatagtgtgtgtgtgtgtgtgtgtgtgtgtatctcactagatctcatcttgcacaactcactttggaaatagctctccttaagctcctttatcatttgcaaaatggaagcaaaatatatcacaaaaggcattcatgttgactttgcacaaatcactggtttagatacttggataacaa

SEQ ID NO: 23484 - DNA, 144 bp, Homo sapiens
  D18S454
  Located on chromosome 18
  Distance between a terminus base of telomere on chromosomal short arm and 5'-terminus of this base sequence : 43483735
  Distance between 3'-terminus of neighbour sequence of sequence listing upward to telomere on chrosomal short arm and 5'-terminus of this base sequence : -254
ttagtgcaggccgtttgtttattaaatatgaataaagttaattttccaagtttaagttaaatttaaatggaaatcaaatagtgtgtgtgtgtgtgtgtgtgtgtgtatctcactagatctcatcttgcacaactcactttggaa

SEQ ID NO: 23485 - DNA, 234 bp, Homo sapiens
  D18S1145
  Located on chromosome 18
  Distance between a terminus base of telomere on chromosomal short arm and 5'-terminus of this base sequence : 43519111
  Distance between 3'-terminus of neighbour sequence of sequence listing upward to telomere on chrosomal short arm and 5'-terminus of this base sequence : 35232
aggaactaatgctactgacgccttaatcctgtacttctggcttcctgaactgtgagataatttctgttgtttgaagccactcagtttgtggtaatttgttatggtagcaccaggaaacacacacacacacacacacacacacacacacacacacaaacacagagacagagaggtgaagtggcctacccactagcaaaggcaggactagagaccaagtctctccatttgcagcca

SEQ ID NO: 23486 - DNA, 357 bp, Homo sapiens
  chr18.fa.O7frz.46525408
  Located on chromosome 18
  Distance between a terminus base of telomere on chromosomal short arm and 5'-terminus of this base sequence : 43519202
  Distance between 3'-terminus of neighbour sequence of sequence listing upward to telomere on chrosomal short arm and 5'-terminus of this base sequence : -143
taatttgttatggtagcaccaggaaacacacacacacacacacacacacacacacacacacacaaacacagagacagagaggtgaagtggcctacccactagcaaaggcaggactagagaccaagtctctccatttgcagccagtactcctttcattgcatctattcatttatttttatccctattttgttccagaaaaaaaatacacataccattttttttccttcaggcaaataaatacaagaactaaaaccaaaatacaaacaacttacaacagagaaacaagctcatttctagaagcaacagagccctaattatctgtataaaatctaactatactgccatacgagaaactag

SEQ ID NO: 23487 - DNA, 384 bp, Homo sapiens
  chr18.fa.O7frz.46311932
  Located on chromosome 18
  Distance between a terminus base of telomere on chromosomal short arm and 5'-terminus of this base sequence : 43691926
  Distance between 3'-terminus of neighbour sequence of sequence listing upward to telomere on chrosomal short arm and 5'-terminus of this base sequence : 172367
tctgaataccaggctaacatatacaattgtcttctttaaatctctacttggatgttgtagtaagctttcttattattttcattactattattgccaccattattgtcatcatcatcatcatcatcatcatcataattggctttctccctaagagaaaattataccacttcatcactttgatgatgttctaaccttatgacttcttttggccaattaaatgtggcatgcacagtttaagtaggttttaagatgcagtgtgtgaactctcatatcttttttacatctaccacagtaattaggaacattctggttagagaggctgaccataagctttggtcccaaagagaagaaaacagaagcagagtggtatccaattccatagtg

SEQ ID NO: 23488 - DNA, 458 bp, Homo sapiens
  chr18.fa.O7frz.46644463
  Located on chromosome 18
  Distance between a terminus base of telomere on chromosomal short arm and 5'-terminus of this base sequence : 43920035
  Distance between 3'-terminus of neighbour sequence of sequence listing upward to telomere on chrosomal short arm and 5'-terminus of this base sequence : 227725
ctgcaaacctgtacagaatattactgtactaaatactgtgggcaaatgtaacacaatggtaagtatttgtgtatctaaacacagaaaaggtacagcaaaaatacagtattatattatatgggatcacagtaatatatgtggtctgttgttcactgaaacattattatgggtgtgtgtacacacacacacacacacacacacacacagaggcatatatattttttcatatatatgtaagagagtgagaatatccctcctttcctttctctcctctcccctctcatgattcagagatgggctacatacaaggaaggaacgttggataagaagtcaaggaacatagcatctattcctggctttgaattaacttagtggcttggggtagtgcatcgtttcctcagttttaaaaagatgggattctaatagatgatctcacaggtaaacttctactgcactat

SEQ ID NO: 23489 - DNA, 390 bp, Homo sapiens
  D18S861
  Located on chromosome 18
  Distance between a terminus base of telomere on chromosomal short arm and 5'-terminus of this base sequence : 44129401
  Distance between 3'-terminus of neighbour sequence of sequence listing upward to telomere on chrosomal short arm and 5'-terminus of this base sequence : 208908
ctagcccttaggtcagcacaggtgatttctgtaggaagggccctgtcaccttttagatacatccaattcctcttaaacatgagcacctatcagaaataatgaaaaaactcacctttgggattttcattagtttggcaatcacttctccttttgaaagattggtggactgtacattttattattattattattattattattattattattattagttaaaaggaagccaactgtttcatttgataccacacaaagataacagcattgtaaagtcccaaagagtttcccactgagttcctccaaagtgacgaattcctagcaaaaggtcttctcacactcagcttgtcagagaccttgcttgcagcagtgtctcaggaacacttgttggct

SEQ ID NO: 23490 - DNA, 448 bp, Homo sapiens
  chr18.fa.O7frz.46957653
  Located on chromosome 18
  Distance between a terminus base of telomere on chromosomal short arm and 5'-terminus of this base sequence : 44309909
  Distance between 3'-terminus of neighbour sequence of sequence listing upward to telomere on chrosomal short arm and 5'-terminus of this base sequence : 180118
tactgaagtgttccaggatctccagggctctgggcactgtgagattatacacattggtgcgcgcacacacacacacacacacacacacacacacacacagagagctctcactccacccccacccctacctccccacctccccacctcctattccccggagggccagtgactcacagtcaacggcaggttttcagagccgactctggtaaaaattagcaggagccttttattgttcaaggagaggaaggactcctccgtctcctttcacggctgcgtggaagtgtcatcttttaatttttccccctccattggaattgctgtacccacctctaaaaactgccatcatcagcctttttgtctcgtcctttgttttcttgcaaatggtcactagaccgggcccagcctgtggggacttccatataaaaacagctggctatggaggcttaat

SEQ ID NO: 23491 - DNA, 366 bp, Homo sapiens
  AP001497.3_86945
  Located on chromosome 18
  Distance between a terminus base of telomere on chromosomal short arm and 5'-terminus of this base sequence : 44446912
  Distance between 3'-terminus of neighbour sequence of sequence listing upward to telomere on chrosomal short arm and 5'-terminus of this base sequence : 136555
gtatccaatacgatagccactagccacccagggctactcaaatttaacttaattaaactaaaattgaaaattcggtttcttagtaacactcgccacatttcaagggttcggtagccagtggatagcagttatcgcaaaggacagcacagatagagaacatttttatcatcacagaaatttctgttggatgccatagttatttggatcattgagattccagagatataagcagaatctctcctaatatgtgtgtgtgtgtgtgtgtgtgtgtgtgtgtgtgtgtgtgtgtgtgtgtgtgtgtgtgagagagagagatttcatgtataatgcagaatttcttcagtaaacaatatggaatatgactgg

SEQ ID NO: 23492 - DNA, 446 bp, Homo sapiens
  chr18.fa.O7frz.47161484
  Located on chromosome 18
  Distance between a terminus base of telomere on chromosomal short arm and 5'-terminus of this base sequence : 44494442
  Distance between 3'-terminus of neighbour sequence of sequence listing upward to telomere on chrosomal short arm and 5'-terminus of this base sequence : 47164
gatgtctgaggtagtgttagtcaggaaatctcccctttcccctgagcatgctgtatgcactctttggaaagtagtcattttagccagcccacttaaagagtggggagttatgttctatcttcttgagggctgagtatccacatcaattatttggaattgttctgaatgggagatttgactattctacccatttatctatttaataactcatttatatcggtatggactcatggatatttattttacttcacttctttatttttcaagttgtttcaactttggtcattggaagctcttggctcttgtgttcctttgacatatctaacacctccatgtatgtatgtgtgtagtgtgtgtgtgtgtgtgtgtgtgtgattaaatacttcttgctttctgggattgaaaggttctctatgctcattttgtatatttcctgtttcagcctt

SEQ ID NO: 23493 - DNA, 121 bp, Homo sapiens
  D18S854
  Located on chromosome 18
  Distance between a terminus base of telomere on chromosomal short arm and 5'-terminus of this base sequence : 44748827
  Distance between 3'-terminus of neighbour sequence of sequence listing upward to telomere on chrosomal short arm and 5'-terminus of this base sequence : 253939
accatggcacgtgtatacctacgtaacaaaactgcacattctgccatgtaccccagaacttaaagcataataataataataataataaagtaaaaaaaaaatctattgagcatttgctgca

SEQ ID NO: 23494 - DNA, 333 bp, Homo sapiens
  AC023421.2_83895
  Located on chromosome 18
  Distance between a terminus base of telomere on chromosomal short arm and 5'-terminus of this base sequence : 44984940
  Distance between 3'-terminus of neighbour sequence of sequence listing upward to telomere on chrosomal short arm and 5'-terminus of this base sequence : 235992
gtatttccataactcatcagtcatggatcttaaatacatatccaaaagaaaaaattttaaataagaaaaagtcacatgatccaatgagatccaggtacattaagccaaataaagtttaacatctttcattagcattggcttctcaaagactttaatgccagtgtgcttttaatgaatcacttatccttcttttatcagagaagggcgtgtgtgtgtgtgtgtgtgtgtgtgtgtgtgtccacatattaacatctctacgagtacacttccaaacacctcgagttttggaatcattcttttgcaagagtagacttactgacttgaatgctattg

SEQ ID NO: 23495 - DNA, 451 bp, Homo sapiens
  chr18.fa.O7frz.47701621
  Located on chromosome 18
  Distance between a terminus base of telomere on chromosomal short arm and 5'-terminus of this base sequence : 45145201
  Distance between 3'-terminus of neighbour sequence of sequence listing upward to telomere on chrosomal short arm and 5'-terminus of this base sequence : 159928
ttcagcactgtaaagaacaaaggccagtgcgaggcttggctggcacagccagtcctggttctcgggcaccttggcagcccccagctgggtggctcctcccccgctcaaggtcaagaccctgctcaaggaggctcatctggcctcctatgtggacaaccatttcggagctccctgatatttttgccagcatttcgtaaatgtgcatacgtctgtgtgtgtgtgtgtgtgagagagagagagagagagagagtacacgcattagcttgagcgtgaaacttccagaaatgttcccttgccctttcttacctagaacacctgctatagtaaagcagacaggaaactgtttacagggcctggaggcccagtcttgtcctcctctgtcaccgacttgctgtgtggacctgggacactctcttcacttctctgggtctcaattcatttactgttgaac

SEQ ID NO: 23496 - DNA, 366 bp, Homo sapiens
  AP001563.3_44039
  Located on chromosome 18
  Distance between a terminus base of telomere on chromosomal short arm and 5'-terminus of this base sequence : 45230440
  Distance between 3'-terminus of neighbour sequence of sequence listing upward to telomere on chrosomal short arm and 5'-terminus of this base sequence : 84788
aaatagaattatgacatgatccagcaattctacttctcacatgcccaaaagaagtgaaagcaaggcccgaaagagatattggtacatccgcattcacagaaacattattcacaatagtcaaaaggcagaagcaacccaagtccccatcaatgactgaatggataaacaaaaagttatacacacacacacacacacacacacacacacacacacacacgcaccaaggaattattatacaggcttaaaaatgaagtaaatgctgacacatgctacaacatggatgaaccttgaggatatcatgctagctgaaataaaccagtcacaaagaccatatattacatagttccattaatatgaaatgtctga

SEQ ID NO: 23497 - DNA, 120 bp, Homo sapiens
  DISD22_0011237
  Located on chromosome 18
  Distance between a terminus base of telomere on chromosomal short arm and 5'-terminus of this base sequence : 45353951
  Distance between 3'-terminus of neighbour sequence of sequence listing upward to telomere on chrosomal short arm and 5'-terminus of this base sequence : 123145
ctcctcagtagttcaatacctttctttgtagtctaggatgagtgtgtgtgtatgtgtgtgtgtgtgtgttgcatgtgtgcttgttttagaagcaagagaagacaagaggaaggccaatgt

SEQ ID NO: 23498 - DNA, 153 bp, Homo sapiens
  DISD22_0011241
  Located on chromosome 18
  Distance between a terminus base of telomere on chromosomal short arm and 5'-terminus of this base sequence : 45570779
  Distance between 3'-terminus of neighbour sequence of sequence listing upward to telomere on chrosomal short arm and 5'-terminus of this base sequence : 216708
aggaagctaatattatatcacacccctttgttatgaagaatagtccaagaaaaaaaaaactatctatctatctatctatctatctatctatctatctatctatctgtctatcaatcatctatctatctcacaaccctgatattgtaactggca

SEQ ID NO: 23499 - DNA, 195 bp, Homo sapiens
  D18S1143
  Located on chromosome 18
  Distance between a terminus base of telomere on chromosomal short arm and 5'-terminus of this base sequence : 45731167
  Distance between 3'-terminus of neighbour sequence of sequence listing upward to telomere on chrosomal short arm and 5'-terminus of this base sequence : 160235
cactgaatggcactgtaactctatccatttacctaagtcagaaacctaagcatcatttttgactttctatgttctttcatttgcctaattcccaacattactaaccctccattcgtacacacacacacacacacacacacagtattttccattgtttttttttcctagttcagccacagtcatttctcacccagg

SEQ ID NO: 23500 - DNA, 201 bp, Homo sapiens
  D18S1111
  Located on chromosome 18
  Distance between a terminus base of telomere on chromosomal short arm and 5'-terminus of this base sequence : 45777071
  Distance between 3'-terminus of neighbour sequence of sequence listing upward to telomere on chrosomal short arm and 5'-terminus of this base sequence : 45709
cacaccaggtcttagttaggcattttttaaaagcagacgtgtgtgtgtgtgtgtgtgtgtgtgtgtgtgtgtgtgtgtgtgtgtgtgtgtgtttctttttcctgaaggctgtttcatggcttgcagggcaaagggcaaaggactgatagaatgttctctttaaaacgtggtagaaacaaagaaaagaagtccctctgtgca

SEQ ID NO: 23501 - DNA, 269 bp, Homo sapiens
  AC064800.2_75080
  Located on chromosome 18
  Distance between a terminus base of telomere on chromosomal short arm and 5'-terminus of this base sequence : 46078606
  Distance between 3'-terminus of neighbour sequence of sequence listing upward to telomere on chrosomal short arm and 5'-terminus of this base sequence : 301334
tgataaagattgaactcgctaggaggctataataattctgtgcttagtaacatagcctcaaactatataaagcaaaaattgttctacaataagaaatatctaccaccttagtggtatatatttcaatagtggtacatgcgcacacacacacacacacacacacacacacacacacccctacctgtacaattttgcaggagactgcaaccaaacatttgggaaacatcactgcaattttttacagtctcttttaggaaaggacatacttc

SEQ ID NO: 23502 - DNA, 248 bp, Homo sapiens
  AC021934.3_63671
  Located on chromosome 18
  Distance between a terminus base of telomere on chromosomal short arm and 5'-terminus of this base sequence : 46089085
  Distance between 3'-terminus of neighbour sequence of sequence listing upward to telomere on chrosomal short arm and 5'-terminus of this base sequence : 10210
ccgagcaagaatctaacatacaataagaaatctcttttctgacctataaataaattaattacaaataaatgaataaacaaatagcctgcccatcagatagaaaacacatactgtgtttcagagaaattaaaaacaaacacggaaggaaggagggaaggaaggaaggaaggaaggaaggaaggaaggaaagaaggaagggaggaaggaagggcgggcaggcaaagaccctactcctagatgctgtctgg

SEQ ID NO: 23503 - DNA, 346 bp, Homo sapiens
  chr18.fa.O7frz.48858587
  Located on chromosome 18
  Distance between a terminus base of telomere on chromosomal short arm and 5'-terminus of this base sequence : 46095865
  Distance between 3'-terminus of neighbour sequence of sequence listing upward to telomere on chrosomal short arm and 5'-terminus of this base sequence : 6532
cataggtaacaaacctgtatgttgtgcacatgtaccctagtacttaaagtataataataaataaataaataaataaataaataactttttaggtctttattcataaataagactaatctgtacatttctttctcttaatttatcagcctgattttggtatcaaaaatcataaaataaactaggacacattacctttttccctattcttcgaaactatttatataagatggagattcataatttcttaaatatttgttagattttgcctgaacaatcttcttggtgtgatgtcttgggtgaattttaattgctgctctaatttctttagtgattacagatctccttg

SEQ ID NO: 23504 - DNA, 497 bp, Homo sapiens
  AP002391.1_22793
  Located on chromosome 18
  Distance between a terminus base of telomere on chromosomal short arm and 5'-terminus of this base sequence : 46281636
  Distance between 3'-terminus of neighbour sequence of sequence listing upward to telomere on chrosomal short arm and 5'-terminus of this base sequence : 185425
ttcagaacaagcaaatacctagaaacagaaagtagattagtggttgcctagtgttgggaagtgtagtgcaatgaatggggagtgattgctaatgggtatgtagtttctttttagggtaagaataatgcactaaaactgatcgtggtgatgattacacaatgctgtgaaaaatactaaaaaaagcaataaaccatacactttaaatgggtgaactgtatatgtgttatggagttgaaatgtgtctcaccaatggggcaatatatatatatatatatatatacacacacacacacacatatatatacatatatacacacatatatacatatatatacacacatatatacatatatatacacatatatatatacatatatatatatatgtgtgtatgttggaatcctgacccttcattcctcagaatgtgactttacttggcaataaggtctttacaggggtaatctaattaaatgaggtcattaaggtggatcctaatc

SEQ ID NO: 23505 - DNA, 441 bp, Homo sapiens
  AC011814.3_167942
  Located on chromosome 18
  Distance between a terminus base of telomere on chromosomal short arm and 5'-terminus of this base sequence : 46516786
  Distance between 3'-terminus of neighbour sequence of sequence listing upward to telomere on chrosomal short arm and 5'-terminus of this base sequence : 234653
aaaccaaatacctcatgttctcacttataagtgagagctaaacaatgaactcatggacataaggaggggaacaacagaccctgaggcctgcttgagggtggagggtgggaggagggagaggagcagagaaaaataactattgggtactgggctttgtgcctgactgatgaaataatctgtacaacaaacccccatgacaaaagtttacccctgaacctaaaataaaagtttaaaaaagtgaatagtcccctgtaactataccatggaaaatgatgtaagtctctccaaactcttttacatctgtgtgtgtgtgtgtgtgtgtgtgtgtgtgtagagcacatacacagagcaacaaaaatgcgttgtcctgtagatacaagtgatatttgttctatggcctgttttttttccttcatttaatctattgtggacaactttgaa

SEQ ID NO: 23506 - DNA, 191 bp, Homo sapiens
  D18S460
  Located on chromosome 18
  Distance between a terminus base of telomere on chromosomal short arm and 5'-terminus of this base sequence : 46703454
  Distance between 3'-terminus of neighbour sequence of sequence listing upward to telomere on chrosomal short arm and 5'-terminus of this base sequence : 186227
gccagccttggcagtcattcagccccagaattcttgctttcactttatcttttgcctgtgtgtgtgtgtgtgtgtgtgtgtgtgtgtgtgtgtgttttaaataattgtgctagtttgacaatacttttataaatataaatttcattttttccccagtattttagatgttttcatggcaaggacccttcagg

SEQ ID NO: 23507 - DNA, 379 bp, Homo sapiens
  AC011804.3_31101
  Located on chromosome 18
  Distance between a terminus base of telomere on chromosomal short arm and 5'-terminus of this base sequence : 46758334
  Distance between 3'-terminus of neighbour sequence of sequence listing upward to telomere on chrosomal short arm and 5'-terminus of this base sequence : 54689
ttactgagtgcttaggaaatgtcaggaattctcaatctctctctctctctctctctctctctctctctctgtgtgtgtgtgtgtgtgtgtgtgtgtgtgtgtgtgtgtacttgagagacagggtctcactctgttgcccaggctggagtgcagtggcatgatcctagctcacgcaacctccatctcctgggctcaaggaacccttctaccctagtagctaggaatacaggggcatgttaccacacctgactaatttttaaaatgttttgtagagatgggggtctatattagggttctctagagggacagagcttactaggatagatctacatatgaaggggtgaaggggagttaattaaggagtattgactcacatgat

SEQ ID NO: 23508 - DNA, 162 bp, Homo sapiens
  chr18.fa.O7frz.50176861
  Located on chromosome 18
  Distance between a terminus base of telomere on chromosomal short arm and 5'-terminus of this base sequence : 46851272
  Distance between 3'-terminus of neighbour sequence of sequence listing upward to telomere on chrosomal short arm and 5'-terminus of this base sequence : 92559
aaatctaatgaattcgaggaagcctgtccctccctggacacagacacacacacacacacacacacacacacacacacacacacacccttcgatttcaagggactcattgatccacaggggtctcagggttgatgaacactgttaagaacatcggctttagag

SEQ ID NO: 23509 - DNA, 284 bp, Homo sapiens
  chr18.fa.O7frz.50105098
  Located on chromosome 18
  Distance between a terminus base of telomere on chromosomal short arm and 5'-terminus of this base sequence : 46879189
  Distance between 3'-terminus of neighbour sequence of sequence listing upward to telomere on chrosomal short arm and 5'-terminus of this base sequence : 27755
cacctttctaataacatgcattagaatgatggagaaagtggggaggggatgatagcagcacactccttatagcatataccccaaatgcagccatatacaggcgttcaaaatcctacactcaaccccaggagcccttcaccccccccccccacatacacgcacgcgtgcgcacacacacacacacacacacacactcttccatctccaatctcctcttgcatttcacctgtatctccctcttggctcactgcaatctctcctgattctaatgttggtaaatgtgc

SEQ ID NO: 23510 - DNA, 463 bp, Homo sapiens
  chr18.fa.O7frz.50002935
  Located on chromosome 18
  Distance between a terminus base of telomere on chromosomal short arm and 5'-terminus of this base sequence : 46999862
  Distance between 3'-terminus of neighbour sequence of sequence listing upward to telomere on chrosomal short arm and 5'-terminus of this base sequence : 120389
ctaccacgtaaatcaaaggagacagggctctttttccagttcatctcattaagacatgtttaccatttaggcacattataatacttgagcaatggcaatataacacatctctctgtgtctgttatctatctgtctgtctgtctgtctgtctgtctgtctgtctatctatctatctatcgatggatccattgtatgggagaaaaagtattaacgtttcctcacaaggtccatggctgacacctcatacaaaattgcattaacaagagaaaagcataataaatttatttaaccaaagttttacatggcacaggagcattcagaaatgaagacccaaatacccagggaaaactgtatattcttatgcttaggtttgaagaagaatggacagtcatgtagaaatgtgattggacaaaaaagggtataatttaatggtataactgggaggaactcagcttatttgttc

SEQ ID NO: 23511 - DNA, 275 bp, Homo sapiens
  chr18.fa.O7frz.49922119
  Located on chromosome 18
  Distance between a terminus base of telomere on chromosomal short arm and 5'-terminus of this base sequence : 47036379
  Distance between 3'-terminus of neighbour sequence of sequence listing upward to telomere on chrosomal short arm and 5'-terminus of this base sequence : 36054
aactttggcaaatatcctagacacacatacacatacacagacacacacacacacacagagagagagagagagagagagaggtaagaaaacaccctggatgggaaagggctgtacatgtgaggatagatccctgagagaatgtagcctccaggctcaggcttagcagacagtcccagggctctgaggccatagtacctctgttcctggaccttccaggctctagccatggccagctgtgtcctagagtcaggctgtttggccattagagaaagtag

SEQ ID NO: 23512 - DNA, 181 bp, Homo sapiens
  D18S1137
  Located on chromosome 18
  Distance between a terminus base of telomere on chromosomal short arm and 5'-terminus of this base sequence : 47185443
  Distance between 3'-terminus of neighbour sequence of sequence listing upward to telomere on chrosomal short arm and 5'-terminus of this base sequence : 148789
ggacttgcacgctaatgacaaggaaatggacaatgaaccacgagcagataaattgtgtgtgtgtgtgtgtgtgtgtgtgtgtaaatagggtgctaaggcagagaacgatgggaatgtcacttagaaatgacatttaggcaaggactgaagattgagaaggagccagatgtgcaaatagtca

SEQ ID NO: 23513 - DNA, 308 bp, Homo sapiens
  chr18.fa.O7frz.49731053
  Located on chromosome 18
  Distance between a terminus base of telomere on chromosomal short arm and 5'-terminus of this base sequence : 47223167
  Distance between 3'-terminus of neighbour sequence of sequence listing upward to telomere on chrosomal short arm and 5'-terminus of this base sequence : 37543
taccacaggatactcttagttcatcttgtatttttcttactcccactctggatcaaccatttctccaagaagccctgattccttttactgggaaatggtatttagaaaccaaaatcttggtattagatgtgcacattgctattgggatgtcactgtttctaagtcctttcagtagacagggatagaaatatgaatctatctatctatctatctatctatctatctatctatctatctaatctctattgtgatgatcataaatgagtttgtgctgatgtctctaacactaattcaatgcaacagatttc

SEQ ID NO: 23514 - DNA, 461 bp, Homo sapiens
  AP001386.3_154318
  Located on chromosome 18
  Distance between a terminus base of telomere on chromosomal short arm and 5'-terminus of this base sequence : 47332847
  Distance between 3'-terminus of neighbour sequence of sequence listing upward to telomere on chrosomal short arm and 5'-terminus of this base sequence : 109372
ttaacatcaaactcttggtgagataccctagctacaaaaagagaaaacccactcatacataagaaccagaaagcagtaacacacaaagatcatgcaagtagaaacagaccatagagtcaaaagactacttatttcactggaaaactatatatttagcttctgcagtttgactaaaacatatcataaggaatactgcaaaagaaaaaaacctcacaattttgtagaataaattccaaacatataacaaccgaagagaaattgtgaaatagggtaaaatgagggcaaaaataataatagtaatacagaaatgtatgtatatatatatatatagtcatcccttggcatttacaggggattggttctaggaccggctccccctaactaaaaacccttagatgttcaagtccctgacataaaagggtgtagtatttccatgtaacttaaattcacgtcatcctgta

SEQ ID NO: 23515 - DNA, 413 bp, Homo sapiens
  AP002403.1_92154
  Located on chromosome 18
  Distance between a terminus base of telomere on chromosomal short arm and 5'-terminus of this base sequence : 47518516
  Distance between 3'-terminus of neighbour sequence of sequence listing upward to telomere on chrosomal short arm and 5'-terminus of this base sequence : 185208
ggcatagttactgcatgaatactatatagctacaaaaaagaataaacttctgaatagtctacaacatgaataaatctcacagattatctatcaatcatctatcatctatctatccactgcctatcatctatctatctatctatctatctatctatctatctatctatctatccatctaaaatatattctatagagactggatttccctatgttgcccaggctggtcttgaactccggagctcaagcaatcctcccacctcggcctcccaaaacgttgggattacaggtgtgggccaccacaccaggccacagatatattgttaagtgaaatataaaatgagtgaatatggcatgattgcatttatataaagctcaaaacagcaaaactgctgtacaatgatacaagtcaggat

SEQ ID NO: 23516 - DNA, 359 bp, Homo sapiens
  G08007
  Located on chromosome 18
  Distance between a terminus base of telomere on chromosomal short arm and 5'-terminus of this base sequence : 47518612
  Distance between 3'-terminus of neighbour sequence of sequence listing upward to telomere on chrosomal short arm and 5'-terminus of this base sequence : -317
atctatcatctatctatccactgcctatcatctatctatctatctatctatctatctatctatctatctatctatccatctaaaatatattctatagagactggatttccctatgttgcccaggctggtcttgaactccggagctcaagcaatcctcccacctcggcctcccaaaacgttgggattacaggtgtgggccaccacaccaggccacagatatattgttaagtgaaatataaaatgagtgaatatggcatgattgcatttatataaagctcaaaacagcaaaactgctgtacaatgatacaagtcaggatagtggttacctttgagggagttccgactggacggaggtttaa

SEQ ID NO: 23517 - DNA, 437 bp, Homo sapiens
  chr18.fa.O7frz.51116599
  Located on chromosome 18
  Distance between a terminus base of telomere on chromosomal short arm and 5'-terminus of this base sequence : 47653061
  Distance between 3'-terminus of neighbour sequence of sequence listing upward to telomere on chrosomal short arm and 5'-terminus of this base sequence : 134090
gtttagagtagcctcagttccttaccttttcagttctccctcactatgcctctcttggactccatatacctctgcgatatcatttggatctgtgttccctctgaatctcatgtggaattgtaatcctcaatgttggaggtggggcctggtgggacgtggttggatcatggaggtggatttctcatgaatggtttagcaccattccgttggtgctatcttcacaatagtgagtgagttcatgtgagatctggtcattcaaaagtatgtggcacctccccacctctgtctctctctctctctctctctctctcgcttctcctttcaccatgttacttgaaagctctcatttcaccttgcaccatgagtaaaacttcctgaggcctccccagaagcagatgtcagtgttatgcttcctgtacatcctgcagaatcataag

SEQ ID NO: 23518 - DNA, 274 bp, Homo sapiens
  D18S450
  Located on chromosome 18
  Distance between a terminus base of telomere on chromosomal short arm and 5'-terminus of this base sequence : 47668323
  Distance between 3'-terminus of neighbour sequence of sequence listing upward to telomere on chrosomal short arm and 5'-terminus of this base sequence : 14825
tgggaccaacctaactgtggtgcctccaactcatgccctatacctggtaccacccttagatccaggcaagcaggacccaggcatcgacctgagcctcaggacctgcctacccctcccaactccttccttaaaattttctaagtactattgaacctggactgagacctgcgtggacctaggttccaatttctcccatggtatgtgcgtgcgcgcacacacacacacacacacacacacacacacacacacacacacaggttcatgcaccatacaa

SEQ ID NO: 23519 - DNA, 465 bp, Homo sapiens
  AC048380.3_157416
  Located on chromosome 18
  Distance between a terminus base of telomere on chromosomal short arm and 5'-terminus of this base sequence : 47714420
  Distance between 3'-terminus of neighbour sequence of sequence listing upward to telomere on chrosomal short arm and 5'-terminus of this base sequence : 45823
ggatgtcataatgaaataccatagatgaagtggcttaagccacagaaattaattttctcacagttctagaagctgaaatttcaagttccagctgattcagtttctggtcaggggcctcttcctgccgtacagatggccaccttctcactatgtcctcacatggactttccttgctctctgtgtgtgtgtgtgtgtgtgtgtgcacgcgtgcgtgtgtgtgtgtgcacgcatgcgtgtgtgtggagagagagacagacagacagagagaaaacgtctagtgtctcctcttataaggacactaatcctatcagatcagggccccacccttttgacttcatttaaccttaattacttccttagaggccctgtctccaaatgcagccacactgaaggttaggtcttcaacatatgaatttgaggaaacacagacattcacattatatcatggatttatactgattcaag

SEQ ID NO: 23520 - DNA, 443 bp, Homo sapiens
  chr18.fa.O7frz.50900799
  Located on chromosome 18
  Distance between a terminus base of telomere on chromosomal short arm and 5'-terminus of this base sequence : 47867369
  Distance between 3'-terminus of neighbour sequence of sequence listing upward to telomere on chrosomal short arm and 5'-terminus of this base sequence : 152484
taatcgtagctaacatcgattaagttctttctctgtgtgaggcactctgctgagtgttttattaaccccatttaacggataggaaaactgagacagaaaaggtaagcagctggcccaggatcacacccatatggcttaaaggggcagaggcagaatttgaacccacacagtgtgtgtggctccagaaaacttgcttctaaccttgtactacactgtctctctaaatgaacacctgaatgagctcacacacacactttcccagaccaccagccccagaggaagccccactgatttggttacaaatcaaggttacacacacacacacacacacacacacacagaggcattctggcatcgttcatgaatactcgttaattgacacaaaatttatggtaggagaaagcgaccttactctctgatgcttgctaagatccttctgtctc

SEQ ID NO: 23521 - DNA, 456 bp, Homo sapiens
  AC048380.3_109483
  Located on chromosome 18
  Distance between a terminus base of telomere on chromosomal short arm and 5'-terminus of this base sequence : 47989763
  Distance between 3'-terminus of neighbour sequence of sequence listing upward to telomere on chrosomal short arm and 5'-terminus of this base sequence : 121951
ctcttcaatagatgaagcaactaggagacccagaaattgagtaatttgcatgaggctgggttggctccagaatctgtgtccttaattaatcaccctcctgcctctttgcctaaacaacagcaacaatattagtggtaatgaaagtagtcatagtagtagcaatatatttacttcattatttattttaattttgttattattaccagtatttaccattaaacatatgtgtgtatgtttaagatatatttaatggtaaatacagataataatacatacacaagaaatatacacacacacatttataaacaaacaagctaaacatttatatatatatatatatatatatatatatatatatatatatatatataagctagactatatatgtgtgtatatatgtaccgtttactgtgggctgtcacagttctaagcatctaagcactccagatacattca

SEQ ID NO: 23522 - DNA, 390 bp, Homo sapiens
  chr18.fa.O7frz.51262184
  Located on chromosome 18
  Distance between a terminus base of telomere on chromosomal short arm and 5'-terminus of this base sequence : 47995933
  Distance between 3'-terminus of neighbour sequence of sequence listing upward to telomere on chrosomal short arm and 5'-terminus of this base sequence : 5714
cactcgtttatagcctgatctcagaagtgacagagcttcacactgccatttgctgtatgtcatttgcacagaccaaccctggtacaatatgggaagggcctacacagaggtgcggatccccaaaggcaggaatcatggggggctcctggaggctggaggacaccctcactgaatcacacccaggaatccatttctttctttttttcttttcttttctttcttccttccttccttccttccttccttccttccttccttccttccttccttccttccttccttccttcctttttttttttggagtctctctctggcacccaggctggagtgcagtggcacaatcttggatcattgcaacctccacctcccaggtacaagcgattcttgtgc

SEQ ID NO: 23523 - DNA, 422 bp, Homo sapiens
  chr18.fa.O7frz.51354086
  Located on chromosome 18
  Distance between a terminus base of telomere on chromosomal short arm and 5'-terminus of this base sequence : 48076135
  Distance between 3'-terminus of neighbour sequence of sequence listing upward to telomere on chrosomal short arm and 5'-terminus of this base sequence : 79812
gcattccagactgtaatcatatcaggagtctggagggctcgggcaggaccctgggagctggggaaggctcctgctcaggtctggaccttaagacctggataggattaggggagtgctgaaggactctgtagggacagctgaacagctttgtcacacaaacaccctgcctccaccccaacttctctcagagggctgcaggagctatgtggcctcaggcaaacccactgacatctctgattaacctctgggcagaacagagtctcagcatgtgtttaattaatgaaacaataatgaaccagcctttctctgcatcatttattattcattcattcattcattcattcattcattcattcattctacagttagtgagaaaagtctttgcctgtagggtgcagaggtaccaatcagacctttcatct

SEQ ID NO: 23524 - DNA, 226 bp, Homo sapiens
  chr18.fa.O7frz.51481141
  Located on chromosome 18
  Distance between a terminus base of telomere on chromosomal short arm and 5'-terminus of this base sequence : 48263825
  Distance between 3'-terminus of neighbour sequence of sequence listing upward to telomere on chrosomal short arm and 5'-terminus of this base sequence : 187268
tgtagtgagccgagatcacgccactgccctccagccagggtgacagagtgagactccatctcaaaacacacacacacacacacacacacacacacacacacacacgagatcccaggcaggctaccagccttgctccctggtccatcaatgtacttcccatgtgacctcagggctgccaccaaaacaagtgtctaccatcatcaggtcctaggcaactaacagaagt

SEQ ID NO: 23525 - DNA, 480 bp, Homo sapiens
  chr18.fa.O7frz.51597693
  Located on chromosome 18
  Distance between a terminus base of telomere on chromosomal short arm and 5'-terminus of this base sequence : 48301763
  Distance between 3'-terminus of neighbour sequence of sequence listing upward to telomere on chrosomal short arm and 5'-terminus of this base sequence : 37712
gaaattatctgcatgcgagattgtctcttcttctccatgtacttatccaaccatgcctttgtattagcatgggttcattcacaagtattttatttatttatttatttatttatttatttatttatttatttattgagacagagtttcgctcttgttgcccaggccggagtgcagtggtgcaatcttggctcactgcaacctctgctttcaagtgattctcctgcctcagcctcccgagtagctggggttacaggtgcccgccaccacgcccagctaatttttgtatttttagtagaaatggggtttcaccgtgttggccaggctggtctcaaaactcctgacctcaagtgatccgcctgcctcagcctcccgaagtgctgggattacaggcgtgaaccaccgcacccggcccctattttatattttatatttgaatctaatactacattattgattttgttgttccagttgttccaggtt

SEQ ID NO: 23526 - DNA, 476 bp, Homo sapiens
  AP001388.2_11969
  Located on chromosome 18
  Distance between a terminus base of telomere on chromosomal short arm and 5'-terminus of this base sequence : 48356241
  Distance between 3'-terminus of neighbour sequence of sequence listing upward to telomere on chrosomal short arm and 5'-terminus of this base sequence : 53998
gacagatgtttccagtttgaggtctcgggctgccatcaattgttccactaaaccctgtttcctattaagcagactccgggaggtggagaagttgccttccatcatgcagtctctgtgtgtgtgtgtgtgtgtgtgtgtgtgtgtgtgtgtgtgtgtgtgtagtgggtgctgaggactggctggggaggccatgaagggctatggacatgtctgttctccatgcctcctggccaaccatgggcagagctggactttgtcctgggaactgtcccttggctccggagcagcttcatctgactgaagggctgagagccgggacttgggagggctctggttggggattctcactacacacctggccatgaccttctcctctgcccgtgggcaaactatggttggtcacctgcccatccctgcgttccctgtccttcttcctgaaagagtctgtgttagtctgtttcatgttgctataaagg

SEQ ID NO: 23527 - DNA, 368 bp, Homo sapiens
  chr18.fa.O7frz.51723230
  Located on chromosome 18
  Distance between a terminus base of telomere on chromosomal short arm and 5'-terminus of this base sequence : 48426592
  Distance between 3'-terminus of neighbour sequence of sequence listing upward to telomere on chrosomal short arm and 5'-terminus of this base sequence : 69875
attaagtagcctcctgaattctactctttcttgtgctgcctgaccttgcatttatatttcgtttatagagcagtatccaacagaaagtcgggagagaaagctaaaccctaaagcctatcacttttgaagcttaatattagctctctctctctctctctctctctctctctctctctcaaaagggcttaacaggaaagaatttgaaactaatggctaaaatgatgttttggggattatctatgaatttagccacatttcccttatcatgatcaccagggataacaaatagcaacctataattacttttgcttcatgttatagcacagcccaaagtatgcagcaagatattaacacagtagcattctgga

SEQ ID NO: 23528 - DNA, 334 bp, Homo sapiens
  AP001388.2_103762
  Located on chromosome 18
  Distance between a terminus base of telomere on chromosomal short arm and 5'-terminus of this base sequence : 48443373
  Distance between 3'-terminus of neighbour sequence of sequence listing upward to telomere on chrosomal short arm and 5'-terminus of this base sequence : 16413
tacttacagtgaggtcctttctacttcctcacctccactctgcttttcacttcttccaaaggagaatgtgtttcaaatggatgtagtttaaattctttgcatggttctgtgtgtcctgattaaaaaaaattaatatggtctttcagagactttttttttctttttctttcgtgtgtgtgtgtgtgtgtgtttaagagatggtcttgaatttctgggctcaagagattctcctgactcagtctcctgagcagctgggataacagtgtaccaccacgcctggctctcagagacatttttaaggatatcaattgcctggttactaagaacgttcctc

SEQ ID NO: 23529 - DNA, 185 bp, Homo sapiens
  DISD22_0011245
  Located on chromosome 18
  Distance between a terminus base of telomere on chromosomal short arm and 5'-terminus of this base sequence : 48583141
  Distance between 3'-terminus of neighbour sequence of sequence listing upward to telomere on chrosomal short arm and 5'-terminus of this base sequence : 139434
tcttggaaccagccattcaccccctccatagcaatttttctttcattgtaatattaagatataataatatatatttcatataacattctgctgtataaaagatccttgtatcatatatatatatatatatatatatatatatatatatatatatatacacacatagatgggtcctggtcttattc

SEQ ID NO: 23530 - DNA, 284 bp, Homo sapiens
  DISD22_0011252
  Located on chromosome 18
  Distance between a terminus base of telomere on chromosomal short arm and 5'-terminus of this base sequence : 48655087
  Distance between 3'-terminus of neighbour sequence of sequence listing upward to telomere on chrosomal short arm and 5'-terminus of this base sequence : 71761
attgacgtagaagcaaatggcttttaaggacagttggatgctaaatttactgaagctggtaagtatactgtggtagcataagcgatatcctctttcaggaaatacacattaaagtatttaggagtaaagggatattacgatgcatgtaacttatcctcaaatgattttaaaaaaccgtgtgtgtgtgtgtgtgtgtgtgtgtgtgtgtgtgtgtgtgtgtggtggggggagagaaagagaaagggggagagagagagaagaaagtacagaatgagacagaagag

SEQ ID NO: 23531 - DNA, 134 bp, Homo sapiens
  DISD22_0011264
  Located on chromosome 18
  Distance between a terminus base of telomere on chromosomal short arm and 5'-terminus of this base sequence : 49179012
  Distance between 3'-terminus of neighbour sequence of sequence listing upward to telomere on chrosomal short arm and 5'-terminus of this base sequence : 523641
tcatgacaaagaagtctatacttcccgtttccctttacctcagaggtagagggcctatttctgtcttgagggtaaattcacacacacacacacacacacacacatgttttccagtgtgactaatagcagtcgtt

SEQ ID NO: 23532 - DNA, 272 bp, Homo sapiens
  chr18.fa.O7frz.52384076
  Located on chromosome 18
  Distance between a terminus base of telomere on chromosomal short arm and 5'-terminus of this base sequence : 49284956
  Distance between 3'-terminus of neighbour sequence of sequence listing upward to telomere on chrosomal short arm and 5'-terminus of this base sequence : 105810
ttacaatggttggatttatgatttttcaacttcattatggatttattggaatgtaaccctatcctaagttgaggagcatctgtgtgtgtgtgtgtgtgtgtgtgtgtgtgtgtgtgtgtgtgtactatctagatctagaaatatttattagatttaaatatcgtgaagaactagctcacacaactgtagaggctaagaagtcccacaatggacatgccatctgcaagctggagacccagaaaagccagaggtgtaattcaggatgagtctga

SEQ ID NO: 23533 - DNA, 471 bp, Homo sapiens
  AP001847.3_220344
  Located on chromosome 18
  Distance between a terminus base of telomere on chromosomal short arm and 5'-terminus of this base sequence : 49365376
  Distance between 3'-terminus of neighbour sequence of sequence listing upward to telomere on chrosomal short arm and 5'-terminus of this base sequence : 80148
ctttcagctgaccagtgagtgtttagccttttgaaagctctgagaagccctgcagtgaagaaacctatagaaccctgagtatgtcccaaactgacttcaccacgaacccccaagcccttatttcacccctaagagctgctggggggactgggagggatgtgttgagagagtgggggtcacgcccaacatccagcttattcaggatcagccttgtgctgggaaatccaggccttctcggagcatgtgagcgtcccccctccccctaacctgttgtaaggagcttacagtctggccagggacacagtaccgggggctgggggcggggcccatcaactgcgtggggccactctggctgcaggaagagtgtgtgtgtgtgtgtgtgtgtgtgtgtgtgtgtgtgtgtgtgtgtgtgtgtagggggtggggggctggttaaaggaaggcttaaagggctccgaggatagtctgtcc

SEQ ID NO: 23534 - DNA, 272 bp, Homo sapiens
  AP001406.2_121130
  Located on chromosome 18
  Distance between a terminus base of telomere on chromosomal short arm and 5'-terminus of this base sequence : 49570041
  Distance between 3'-terminus of neighbour sequence of sequence listing upward to telomere on chrosomal short arm and 5'-terminus of this base sequence : 204194
tgctaagtaggtgaatatacatcaccaacagcccctggaacctgctgcagctggctctccttaggggtcctagcctctgtctgggcaaatgaggaggaccacgttctggaaggagtctctcagcaggctgcaaactggagccctcctcctcctcctcctccttgcccggccagcagcacaggcccctactcatgacccagtgtcaccaccccagcagaggggcccactgcactgttttcttttgctctcttaaggtaggactcctaaggtag

SEQ ID NO: 23535 - DNA, 231 bp, Homo sapiens
  D18S473
  Located on chromosome 18
  Distance between a terminus base of telomere on chromosomal short arm and 5'-terminus of this base sequence : 49683541
  Distance between 3'-terminus of neighbour sequence of sequence listing upward to telomere on chrosomal short arm and 5'-terminus of this base sequence : 113228
cagcatcaggctgaggggtgagaagggcagaagcctatgaagaagagatggacattttccatctcttctcattcacacacacttcttttcatacaaacacacttcttttcacacacacacacacacacacacacacacctcttctcattctatactgcccaatgcaccaaatggacggcagtggccccactaatgagagcccacagaacactaagcccaagtgctccacaa

SEQ ID NO: 23536 - DNA, 411 bp, Homo sapiens
  AP002440.1_32933
  Located on chromosome 18
  Distance between a terminus base of telomere on chromosomal short arm and 5'-terminus of this base sequence : 49696812
  Distance between 3'-terminus of neighbour sequence of sequence listing upward to telomere on chrosomal short arm and 5'-terminus of this base sequence : 13040
agactaaagagcgagaactgaccctactctttcagagtttggagtgtcacaaaggagaaaggtaggcagcaagtaatacacacacacacacacacacacacacacacacacacacacacacacacacaaaatgctcagccccacagaggagaggtaagaacccatgaaagaagaagtgacctgtgaagggcctggggaggagcagggtgttgggcgggctggaggtccacagaccacagagcacatctgtcacctttcctgcctcttaccagcctcagccaggccttggtcactgcaggtgttcctcatctcacctgtccctgacacagagtacagctgccctgaggaaccacaggacattgactgagctgtatgcatggggaggcacagatgctctatgcctttcttatc

SEQ ID NO: 23537 - DNA, 354 bp, Homo sapiens
  chr18.fa.O7frz.52505742
  Located on chromosome 18
  Distance between a terminus base of telomere on chromosomal short arm and 5'-terminus of this base sequence : 49696869
  Distance between 3'-terminus of neighbour sequence of sequence listing upward to telomere on chrosomal short arm and 5'-terminus of this base sequence : -354
aaaggtaggcagcaagtaatacacacacacacacacacacacacacacacacacacacacacacacacacaaaatgctcagccccacagaggagaggtaagaacccatgaaagaagaagtgacctgtgaagggcctggggaggagcagggtgttgggcgggctggaggtccacagaccacagagcacatctgtcacctttcctgcctcttaccagcctcagccaggccttggtcactgcaggtgttcctcatctcacctgtccctgacacagagtacagctgccctgaggaaccacaggacattgactgagctgtatgcatggggaggcacagatgctctatgcctttcttatc

SEQ ID NO: 23538 - DNA, 404 bp, Homo sapiens
  AC044841.3_52311
  Located on chromosome 18
  Distance between a terminus base of telomere on chromosomal short arm and 5'-terminus of this base sequence : 49881631
  Distance between 3'-terminus of neighbour sequence of sequence listing upward to telomere on chrosomal short arm and 5'-terminus of this base sequence : 184408
ttaaggtcacgagttcaagaccagtctggccaatatgatgaaaccccatctctactaaaaatacaaaaattctcagggcatggtgacgtgcacctgtaatcccagctactcaggaggctgaaggaggagaatcactagaacccaggaagcagaggttgcagtgagctgagatcgtggcattgcactccagcctgggtgcgacagagccagactccgtctgaaagaaaaaaaggaaggaaggaaggaaggaaggaagaaaagaaggagagaaagagagaaagaaagataagataacctgactggaaaaccagggctagattttccttccccaggatcacattcactcagtatcaagatttgtgtcaaaaaaggtattagagagttctagttacaaggctgttaga

SEQ ID NO: 23539 - DNA, 224 bp, Homo sapiens
  DISD22_0011285
  Located on chromosome 18
  Distance between a terminus base of telomere on chromosomal short arm and 5'-terminus of this base sequence : 50580282
  Distance between 3'-terminus of neighbour sequence of sequence listing upward to telomere on chrosomal short arm and 5'-terminus of this base sequence : 698247
actctcaagtccctaggcccattcccacccctgcatcattttttattcatcaactttttattgagcatatacttactacatgccagaaaccatacatggttggaggtataagggtaaatctagacaccatgcttttgctcttgggattcccagtatgatgggaagaaagacccagagagagagagagagagagagagagagagtcccatgagataagcactgtg

SEQ ID NO: 23540 - DNA, 413 bp, Homo sapiens
  AP001499.4_146844
  Located on chromosome 18
  Distance between a terminus base of telomere on chromosomal short arm and 5'-terminus of this base sequence : 50684534
  Distance between 3'-terminus of neighbour sequence of sequence listing upward to telomere on chrosomal short arm and 5'-terminus of this base sequence : 104028
ttatgtctggaacagtgacatcatgctctccacttacctcatctggcacaagctacccaggggcttgttttcctatgaattagaatgttactcaatttgatttctgtgtacttacccccatgagctatttgtcctattgagtgtctctaacagcacgctccccaccagcttcctcaatgacaatcctgttccaggagccaagaaaatatatatatatatatatatatatatatctggacacatgcagaatgcaaacaccaagtgggacaactggagattctgggacagggaaagataccgaacccttggggttatgcacctgcagggagaagtctgtgctagccacctctcacttcagcactctccagaagcatgggctcacctcttccctgtaccattagttcagaaacatc

SEQ ID NO: 23541 - DNA, 452 bp, Homo sapiens
  AP001499.4_80651
  Located on chromosome 18
  Distance between a terminus base of telomere on chromosomal short arm and 5'-terminus of this base sequence : 50716646
  Distance between 3'-terminus of neighbour sequence of sequence listing upward to telomere on chrosomal short arm and 5'-terminus of this base sequence : 31699
aggttcaagcagttcatgtagctgagatcacaggtgtgcgccaccatgcctggctaatttttgtattttcagtagggatgaggtttcaccatgttgaccaggctggtctcaaactcctgacctcaagtgatcctccagcctcggcctcccaaagtgctgggattacaggtatgagcccataatcagtgtacatttcatcctagcctgaattgtacgcttttaaatggttacatgattaatgttatattatgtgaattgtacacacccctcctccaaacacacacacacacacacacacacacacacacacagaaggggcatggcatggattctgaaacagtgaggggaaattagccagcccaggaaagcaaggagaagtgcttcccttggagcagcccaagccaaggtgagtggactgggctggggcacctcagcagtagaaagatacctgt

SEQ ID NO: 23542 - DNA, 447 bp, Homo sapiens
  AC040919.1_98337
  Located on chromosome 18
  Distance between a terminus base of telomere on chromosomal short arm and 5'-terminus of this base sequence : 50967490
  Distance between 3'-terminus of neighbour sequence of sequence listing upward to telomere on chrosomal short arm and 5'-terminus of this base sequence : 250392
ttctaactgacatcgaatgaagaagatcttagctgtttataagggtgtatatattagatcattcaaccagactttatgcaaaatgaggacaggagttgtgttttttattttatatagtctcaaaatctctttctcacccagtccagggctctttctctctttctttctttccttctttccttccttccttccttccttccttccttccttccttccttccttccttccttccttccttccttctttcctccctccctccctccctccctttctttctttctttctttctttctttctttctttctttctttctttctttctttctttctttctttccttctttctttctttcttttgactagtcaagcacaatagtgagaagggggtaaagagtagaacaaggagctgaatctgtaactgactgtgaacaatctattgaggttaatc

SEQ ID NO: 23543 - DNA, 135 bp, Homo sapiens
  G09631
  Located on chromosome 18
  Distance between a terminus base of telomere on chromosomal short arm and 5'-terminus of this base sequence : 51005259
  Distance between 3'-terminus of neighbour sequence of sequence listing upward to telomere on chrosomal short arm and 5'-terminus of this base sequence : 37322
actatattgctttgaaggtcttagccagaccaatatagatagatagatagatagatagatagatagatagatagatagacagaatgaagattggaatggaagaaataaaactttcatcattagcaggtgacatga

SEQ ID NO: 23544 - DNA, 291 bp, Homo sapiens
  D18S1110
  Located on chromosome 18
  Distance between a terminus base of telomere on chromosomal short arm and 5'-terminus of this base sequence : 51092384
  Distance between 3'-terminus of neighbour sequence of sequence listing upward to telomere on chrosomal short arm and 5'-terminus of this base sequence : 86990
tgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcga

SEQ ID NO: 23545 - DNA, 123 bp, Homo sapiens
  D18S474
  Located on chromosome 18
  Distance between a terminus base of telomere on chromosomal short arm and 5'-terminus of this base sequence : 51192221
  Distance between 3'-terminus of neighbour sequence of sequence listing upward to telomere on chrosomal short arm and 5'-terminus of this base sequence : 99546
tggctttcaatgtcagaaggcatttgtgatggtcacaactgtgtgtgtgtgtgtgtgtgtgtgtgtgtgtgtgtactactgacatctagtgggtggaggccagggatgctggtaaacacccca

SEQ ID NO: 23546 - DNA, 235 bp, Homo sapiens
  Z67654
  Located on chromosome 18
  Distance between a terminus base of telomere on chromosomal short arm and 5'-terminus of this base sequence : 51313609
  Distance between 3'-terminus of neighbour sequence of sequence listing upward to telomere on chrosomal short arm and 5'-terminus of this base sequence : 121265
cagtgggccatctagcatataggtaactcagccatggctgagaaagaaaataaataaacaactttgctgttagctatcatttcttacacacacacacacacacacacacacacactcacctgcacacacacacactaattcacacacaaacatagacacacatacctgtaccacactcactcatatctaccacctcctctccactcttcaacactcacatgtttccacacaggcg

SEQ ID NO: 23547 - DNA, 295 bp, Homo sapiens
  chr18.fa.O7frz.54444942
  Located on chromosome 18
  Distance between a terminus base of telomere on chromosomal short arm and 5'-terminus of this base sequence : 51503917
  Distance between 3'-terminus of neighbour sequence of sequence listing upward to telomere on chrosomal short arm and 5'-terminus of this base sequence : 190073
actggagtaatccttaaatgaaaccttgatggttgagtagaggaagaaacaggtggagtgggagttagggaagactgttagagagaggccaaggagagagcaggaacaaagaccaacagtaaaagtgcatgaatggtttagggagaggcaggctggcaggatgtcgtgtgtgtgtgtgtgtgtgtgtgtgtgcgcgcgcaaaacgaaacagaataaatcaaaacacggagacactttttttccctaaagtaaagaagcaatactcaatccgctgttttatttcttgtagctgaaa

SEQ ID NO: 23548 - DNA, 349 bp, Homo sapiens
  AP001378.4_9552
  Located on chromosome 18
  Distance between a terminus base of telomere on chromosomal short arm and 5'-terminus of this base sequence : 51586978
  Distance between 3'-terminus of neighbour sequence of sequence listing upward to telomere on chrosomal short arm and 5'-terminus of this base sequence : 82766
ctattaacctcttgccaggtacatgatttgcaaatattttctctcattctgtggattgtctcttccttctgttaatcgtttcatttgctatgcagcagctttttagtttgatactatccatttgtctattttatatatatataaattttgttgcctgtgttttcggatatctatatccatatctatctatctatctatctatctatctatctatctatctatctatctatctatatcaattactgcccaggccaatgttgtggagcatgttttcttctagtagttttatagtctcaagtcttatatttaaatctttagtctattttgagttgatttgttcacatcgtat

SEQ ID NO: 23549 - DNA, 231 bp, Homo sapiens
  D18S838
  Located on chromosome 18
  Distance between a terminus base of telomere on chromosomal short arm and 5'-terminus of this base sequence : 51647919
  Distance between 3'-terminus of neighbour sequence of sequence listing upward to telomere on chrosomal short arm and 5'-terminus of this base sequence : 60592
gtttacccggccatgagatgaatctaggatttaaaaaaaaaaaaagtatatccttaactcatctaaaaactatagactaaagaaaaagacccacagtaaatattttctattttaaagttaatattagtgactactatctttctttgtgttgtcaggttctctctctctgtggtgtgtgcgtgtgtgtgtgtgtgtgtgtgtgtgtagtagtgcaaccttcaagataaagct

SEQ ID NO: 23550 - DNA, 449 bp, Homo sapiens
  AC027216.2_51971
  Located on chromosome 18
  Distance between a terminus base of telomere on chromosomal short arm and 5'-terminus of this base sequence : 51835377
  Distance between 3'-terminus of neighbour sequence of sequence listing upward to telomere on chrosomal short arm and 5'-terminus of this base sequence : 187227
gaagtatgcatcctttattctctatgattgatggggtgaaaaattgcatcaattttgcatctatctagaatatacaaaaaatgggatattttgacatatgtatacactgcaaaataatcaccacaatcatgctaaataacatcaccttacattgttcctttgtggggtgtgtgtgtgtgtgtgtgtgtgtgtgtgtgtgtgtgtgtgtggtgagaatacttgagacctcctcttagcaaggttcaaatatacattatattaactatagttaacctgctgtacattaggtctccattacttatttgtcttatagctgaaggttttgtactcttggaccaatagttcccctttcttctaccttccagctccgtgtaacccctactctctgttactataagctagacttaaattttttttttaagattctatgtacaagtgacattatgcag

SEQ ID NO: 23551 - DNA, 257 bp, Homo sapiens
  chr18.fa.O7frz.55119932
  Located on chromosome 18
  Distance between a terminus base of telomere on chromosomal short arm and 5'-terminus of this base sequence : 52112154
  Distance between 3'-terminus of neighbour sequence of sequence listing upward to telomere on chrosomal short arm and 5'-terminus of this base sequence : 276328
tgtaccaatctaatagcaagactccatttctaaaaaaaaaaaaaaaaaaaaaaaaaaagaacactaaagaaaaactacataaaaatatcaatagagtttttatgtatatatatatatatatatatatatatatatatatatacactataaaacaattagagagtgcaaagaaatataagattccatacagaataagcaataaacatgacaaggtaacaaagctaataaaagatgtgtaaatcctttatggaaaagat

SEQ ID NO: 23552 - DNA, 362 bp, Homo sapiens
  chr18.fa.O7frz.55240738
  Located on chromosome 18
  Distance between a terminus base of telomere on chromosomal short arm and 5'-terminus of this base sequence : 52282785
  Distance between 3'-terminus of neighbour sequence of sequence listing upward to telomere on chrosomal short arm and 5'-terminus of this base sequence : 170374
aagtcatactcgtgaagtagaaagaaaagaaaaacaaacagaaagttgcaccagaattagtgtggcactggtttatttcctacctgattgtaaaggaaaaattgagatatgctaatttatcatgcagccgcataacttcataatgcaaaatttatgagaagagatgagaggaaattggagaggaacattatgggagcaataaatacttatatatacttatatataatacttatatataattgcaaatattataatgctgttgcatattagttgagaccatttaggtgattatttaggctaaaagtatatatatatatatatatatatttaattaaaatactatttaactgagcctcttgtag

SEQ ID NO: 23553 - DNA, 439 bp, Homo sapiens
  AP001484.2_30349
  Located on chromosome 18
  Distance between a terminus base of telomere on chromosomal short arm and 5'-terminus of this base sequence : 52436407
  Distance between 3'-terminus of neighbour sequence of sequence listing upward to telomere on chrosomal short arm and 5'-terminus of this base sequence : 153260
ataggactcactaccatgtcatacaccgtctgtttgtttatgtattattattaccccttgcctacttccctacactaaaatgtaagctccatgacacagggatttgtgtcagttttattatttgctccagcccaggtgcctggaacagagtgctggcacaggtgctggcacagagtgagtactctgaattatgtattgaatgaatgaatgaatgaatgacggaaatgtcctctccaatctctcctggccatttctgacagttcctaactgtaactctgcagaagtccctgggctgctttttcttctctgctgcctgatagtggatccatagattctcaggaaacccaggcctgtccactgcgatggctgccatgttctttcatatactcagcatgcagtaattgtaggcatagcatacttaccgtaatagctgcattta

SEQ ID NO: 23554 - DNA, 162 bp, Homo sapiens
  D18S846
  Located on chromosome 18
  Distance between a terminus base of telomere on chromosomal short arm and 5'-terminus of this base sequence : 52436569
  Distance between 3'-terminus of neighbour sequence of sequence listing upward to telomere on chrosomal short arm and 5'-terminus of this base sequence : -277
tgctggcacagagtgagtactctgaattatgtattgaatgaatgaatgaatgaatgacggaaatgtcctctccaatctctcctggccatttctgacagttcctaactgtaactctgcagaagtccctgggctgctttttcttctctgctgcctgatagtgga

SEQ ID NO: 23555 - DNA, 234 bp, Homo sapiens
  D18S851
  Located on chromosome 18
  Distance between a terminus base of telomere on chromosomal short arm and 5'-terminus of this base sequence : 52554805
  Distance between 3'-terminus of neighbour sequence of sequence listing upward to telomere on chrosomal short arm and 5'-terminus of this base sequence : 118074
ctgtcctctaggctcatttagcaatttagccatcaattataacttacatacagatttagatataaatatagacagataaatacataaataaatatatagttatacacacacaaacatctctttctatctatatatcttatctatctatctatctatctaaatttgtagtttctcatatgttttaagagtgagtcttggtaccagaaaacatggattggcatcactgcttcataa

SEQ ID NO: 23556 - DNA, 262 bp, Homo sapiens
  D18S484
  Located on chromosome 18
  Distance between a terminus base of telomere on chromosomal short arm and 5'-terminus of this base sequence : 52577162
  Distance between 3'-terminus of neighbour sequence of sequence listing upward to telomere on chrosomal short arm and 5'-terminus of this base sequence : 22123
tgtagcatttttaagacagtaaagaaaaggagaataggaaaactatcaagatgggaaaactaggtagaaagtaaatttcataaaacctataaagactaaagcaaaataaaagtttaacttaaaaagttgagattattttttaaaaaaataaacgtatttagaaaccctaaaatgtgaagttaatacacacacacacacacacacacacacacacacacagtttattctcttaaaacaaaaattgacaaagcaaggaatatgt

SEQ ID NO: 23557 - DNA, 401 bp, Homo sapiens
  chr18.fa.O7frz.55900679
  Located on chromosome 18
  Distance between a terminus base of telomere on chromosomal short arm and 5'-terminus of this base sequence : 52858640
  Distance between 3'-terminus of neighbour sequence of sequence listing upward to telomere on chrosomal short arm and 5'-terminus of this base sequence : 281216
actgattagcatctgtttaatgagtagaaagttaggtaattgacatgaattgtgtcccctcaaaatacatgtgttgaagccctatccctcaatgtggctgtatttggaaatagggcctataaggagttgataaatgttacatgaggtcataagagtgggtccctaatccgataggtccagggcccttattaaaagaggaagagatagtagagcgctcacttgcgcttgccttctcacacgtacacacacacacacacacacacacacgttctctctccacgtcccaccacccccctgcccccctgtccccaccaatgtgaggacactgtgagaaggcagccacttgcaaagagaatagagcccttaccaggaaccaagtttgctgacaccttcaacttgga

SEQ ID NO: 23558 - DNA, 282 bp, Homo sapiens
  chr18.fa.O7frz.55821695
  Located on chromosome 18
  Distance between a terminus base of telomere on chromosomal short arm and 5'-terminus of this base sequence : 52937813
  Distance between 3'-terminus of neighbour sequence of sequence listing upward to telomere on chrosomal short arm and 5'-terminus of this base sequence : 78772
tagatgtccaataaatgctgactgactctggattccccagaaacaggacacatacacacacacacacacacacacatgcatacacacaatataagtatgtatttatattatttttatatattaatatatgtttatgtgatatataaatattttatataatatataggatctatccatctatttagaaagataaatagagacagagaaagagattgatcacaaggaattggctcacatggttctggaggcttagaagtcctagtatctataattggcaagctg

SEQ ID NO: 23559 - DNA, 227 bp, Homo sapiens
  AP001593.3_89393
  Located on chromosome 18
  Distance between a terminus base of telomere on chromosomal short arm and 5'-terminus of this base sequence : 52991692
  Distance between 3'-terminus of neighbour sequence of sequence listing upward to telomere on chrosomal short arm and 5'-terminus of this base sequence : 53597
agaagttattcctgagtcctatcttttaccaatatcattatgtttaatgaaatcataagtttcttatccataattctatcacagtgttgatgtgtgtgtgtgtgtgtgtgtgtcttatttcccaaaattggaaaatataatgagacaagagcttctatcattatgaatgatattgaacaatgatattgaataatgatcaatatctttcaaagctatcatttattgaa

SEQ ID NO: 23560 - DNA, 233 bp, Homo sapiens
  chr18.fa.O7frz.56107033
  Located on chromosome 18
  Distance between a terminus base of telomere on chromosomal short arm and 5'-terminus of this base sequence : 53163143
  Distance between 3'-terminus of neighbour sequence of sequence listing upward to telomere on chrosomal short arm and 5'-terminus of this base sequence : 171224
gaatagcaatactttgacctgtaaaatatcctgtaagcaagaattctggcccaacccaactcctacattagatatgacaaaattaaatgcaaaaaaactaatagtgtcagagccagagtttgaacctagcataatattcctactacactgctaactctgtgtgtgtgtgtgtgtgtgtgtgtgtgtgtgtgtgtgtgtgtgtacacaaactaagattagccatgatcgtttca

SEQ ID NO: 23561 - DNA, 390 bp, Homo sapiens
  AP001334.3_45357
  Located on chromosome 18
  Distance between a terminus base of telomere on chromosomal short arm and 5'-terminus of this base sequence : 53163143
  Distance between 3'-terminus of neighbour sequence of sequence listing upward to telomere on chrosomal short arm and 5'-terminus of this base sequence : -233
gaatagcaatactttgacctgtaaaatatcctgtaagcaagaattctggcccaacccaactcctacattagatatgacaaaattaaatgcaaaaaaactaatagtgtcagagccagagtttgaacctagcataatattcctactacactgctaactctgtgtgtgtgtgtgtgtgtgtgtgtgtgtgtgtgtgtgtgtgtgtacacaaactaagattagccatgatcgtttcaggaaaaatgatcaaacattaattaccttttgataacagttctttaatgagttaaaattcttattaattcaccattgataaaaattagttcagaaaacatagcagtgacaacataatatttttaaaatctcagcagggcgtagtggttcacgcctgta

SEQ ID NO: 23562 - DNA, 260 bp, Homo sapiens
  chr18.fa.O7frz.56229895
  Located on chromosome 18
  Distance between a terminus base of telomere on chromosomal short arm and 5'-terminus of this base sequence : 53240161
  Distance between 3'-terminus of neighbour sequence of sequence listing upward to telomere on chrosomal short arm and 5'-terminus of this base sequence : 76628
agacaactagattaattgctgagtcatgcaataacactatgtttaacctttatatacacacacacacactctctctctcacacacacacacacacacacacatatatatatatatagagagagagagagagagacagagacagagagacagagacagagacagacatagacacagacacagtcttgctctgtcacccaggctggagtgcagtggtacaatctcagcttaccgcaacctctacctcctaggttcaagcaat

SEQ ID NO: 23563 - DNA, 406 bp, Homo sapiens
  AC026839.2_52521
  Located on chromosome 18
  Distance between a terminus base of telomere on chromosomal short arm and 5'-terminus of this base sequence : 53375926
  Distance between 3'-terminus of neighbour sequence of sequence listing upward to telomere on chrosomal short arm and 5'-terminus of this base sequence : 135505
caaggacttgacagtcattactagggaagggaagcctcgtgccgtcattgtgagttggcagcctcccttggaagccaatgggaaaattactggtaagcatctccactttctctcccagcatagctctcccttgtcctataattgcttaccccctacatgagctgctcctgcctttcgtgtggcattattctgtccctacatctcagctgactccatgaccctttttgattgtttcttctttccccttttgaccatggaattcttctaatggtgcacacacacacacacacacacacacacacacacacacacacgtcatttgatttgcttcacgaaagatgtgtatttcaattagaatagacctttttgtttttcattctctgaagcattaagaccactttctaat

SEQ ID NO: 23564 - DNA, 406 bp, Homo sapiens; identical to SEQ ID NO: 23563
  AC026839.2_122059
  Located on chromosome 18
  Distance between a terminus base of telomere on chromosomal short arm and 5'-terminus of this base sequence : 53375926
  Distance between 3'-terminus of neighbour sequence of sequence listing upward to telomere on chrosomal short arm and 5'-terminus of this base sequence : -406

SEQ ID NO: 23565 - DNA, 390 bp, Homo sapiens
  chr18.fa.O7frz.56374746
  Located on chromosome 18
  Distance between a terminus base of telomere on chromosomal short arm and 5'-terminus of this base sequence : 53424671
  Distance between 3'-terminus of neighbour sequence of sequence listing upward to telomere on chrosomal short arm and 5'-terminus of this base sequence : 48339
ctatcttaggctcttccatgagtttttggttctggttttaggtttttccattggcctcaggcatgacattacctctgaaagcctgaggtatgggttcataggtggctggtttgacaactgtgtactttacactttgctagaaaagattctccagcaaataatgttcccccttctgttgctaatagctcgctcttgctctctctctctctctctctctctctctccatctctctctctctctgtctgtctttctttaagtcctgtaactctatttgtagatctctagtttaccttccagcactctgaagtgacatgtttagaaagagaacaggggaagatatacatactgaagaaaagtaacatggggtgtagatgcaggctttgtattta

SEQ ID NO: 23566 - DNA, 373 bp, Homo sapiens
  chr18.fa.O7frz.56468511
  Located on chromosome 18
  Distance between a terminus base of telomere on chromosomal short arm and 5'-terminus of this base sequence : 53502130
  Distance between 3'-terminus of neighbour sequence of sequence listing upward to telomere on chrosomal short arm and 5'-terminus of this base sequence : 77069
ggaaatgagttgcctagtaatcccctcacttcaacttctctctctctctctctctctcacacacacacacacacacacacacacacacacacattgtatgtatataaacaggcttttagccaaattggaaacttttcagtcctctattaagccctgaagattgggtagtgtatgcccgaatcattcactgacatgctgagatttctataggaagctcatacattaataccatacattttgagctgttttttcaatggctggagtagctttgtgcctacctcccacccatgcaaattctatcaatgctctcttgagatcaagggtacttatttggcaagattagatatacatctctgatcatagtgctaaggaa

SEQ ID NO: 23567 - DNA, 436 bp, Homo sapiens
  chr18.fa.O7frz.57993788
  Located on chromosome 18
  Distance between a terminus base of telomere on chromosomal short arm and 5'-terminus of this base sequence : 53833874
  Distance between 3'-terminus of neighbour sequence of sequence listing upward to telomere on chrosomal short arm and 5'-terminus of this base sequence : 331371
cgaagtgaggtaaacatttctaagggtagagcaacaacgagcccaacactggacacattcattttgaattgcctaataatagatggcaatttggaaatctggagctgaggcaagaaatcaaagttggaagtacaaaatggtattatggtgatagagctgatagtttagtgtgtgtgtgtgtgtgtgtgtgtgtgtgtgtgtgtgtgtgtgtgtgatggctctaaaaagactttgtaaagtaagaaaaaagttcatcaaaagaactccttcacattctctttaaaaactcacatttgacttcatgagtggcaaggtagtaggggatatttctacttataaagaagccaggctgaggagaaatcttcactcagtttttccaaaatcattagaagaaaggactaaaacccaagcagccttggatactgtgatctgaaga

SEQ ID NO: 23568 - DNA, 394 bp, Homo sapiens
  chr18.fa.O7frz.58095882
  Located on chromosome 18
  Distance between a terminus base of telomere on chromosomal short arm and 5'-terminus of this base sequence : 53935908
  Distance between 3'-terminus of neighbour sequence of sequence listing upward to telomere on chrosomal short arm and 5'-terminus of this base sequence : 101598
aagaccatcagtcattgtacaggaataaacaatactgttaaacttgtcagccttttgatccttcccacatcattttttttagcccagttctaggaaaatttgccaaggctttttttttatggtgttgtatttgccatgccaacaaccaacaatagaatattgaggctatatgattttaggactcaaaaaaatcacataataataaaaagaggagctgagccaaatcctgtgtgtgtgtgtgtgtgtgtgtgtgtgtgtgtgtgtgtgtgtgagtgtgttgacagagacagacatagacagagtgagagagagaggagagtagtgatataaaaaataagaaataaaattcatttttgaaaggagcttagaagtgaactgtctcatacctagctta

SEQ ID NO: 23569 - DNA, 293 bp, Homo sapiens
  chr18.fa.O7frz.58223465
  Located on chromosome 18
  Distance between a terminus base of telomere on chromosomal short arm and 5'-terminus of this base sequence : 54057131
  Distance between 3'-terminus of neighbour sequence of sequence listing upward to telomere on chrosomal short arm and 5'-terminus of this base sequence : 120829
agtgagaacatacaatgtttgattttccattcctgagttacttcacttagaataatagtctccaatctcatctccattaaatgctgttaattcattcctttttatggctgagtagtattccattttgtgtatgtatatatatatatatacacacatacatacatacatacatacatatacacaccacagtttctttatccacttgttgattggtgggcattgggttggttccatgattttgcaattgtgaatcgtgctgctataaacatgcctgtgcaagtatcttattcgaa

SEQ ID NO: 23570 - DNA, 464 bp, Homo sapiens
  chr18.fa.O7frz.58396903
  Located on chromosome 18
  Distance between a terminus base of telomere on chromosomal short arm and 5'-terminus of this base sequence : 54321712
  Distance between 3'-terminus of neighbour sequence of sequence listing upward to telomere on chrosomal short arm and 5'-terminus of this base sequence : 264288
gctaggctacagtaccaaattatttaaccaaacatgcatttaggtgtggctttgaaggtatattggagatatggttgatatcttccactggttgactttaggtaaaagagattacccttgttaatacgggcaggcctcattcaatcagtccaacggtcgtaagagccaacactgagattccctggaggagagattcttccttaagcttgcagcatcaacttcttgcctgaattcatagcctgctggcttgccctatagattttcaatttgctaggccccaccatcacatgagccaatttcttaaatctctctctctctctctctctctctctctgtgtgtgtgtgtgtgtgtgtgtgtgtgtgtgtgtgtgtgtgtgtgtgtatcctatgggttatgattctctggaacataacccgtaagatccagaatgatatcatatctagatccttaattacatcaccaa

SEQ ID NO: 23571 - DNA, 451 bp, Homo sapiens
  HUMUT7024B
  Located on chromosome 18
  Distance between a terminus base of telomere on chromosomal short arm and 5'-terminus of this base sequence : 54477297
  Distance between 3'-terminus of neighbour sequence of sequence listing upward to telomere on chrosomal short arm and 5'-terminus of this base sequence : 155121
tctcaataatcaactcatgcttttcctgaaatcacatgcttggagcctcccaactgtcttctcctgtcttatctccaatgactgctagtttcagaacttcagctctagtcaaaagaaaatggccaggtgtaatggctcatgcctgtaatcccagcattttcagaggccaaggtgggagaatcacttgagcccaagagttcaggagttggaggctgcggtgagttatgatcgcaccactgcactccagcctgggcaacagaatgagactttgtctccaaaaacaaaaacaaaaaaaaaagaggaaggaaggaaggaaggaaggaaggaaggaaggaaggaaggaaggaaggaaggaaagaaggaaggaaggaaggaaggaaggaaggaaggaaggaaggaaggaaggaaggaaaaaaaaaaagaagaaaacatgtatctgaccctgaccttt

SEQ ID NO: 23572 - DNA, 242 bp, Homo sapiens
  Z67115
  Located on chromosome 18
  Distance between a terminus base of telomere on chromosomal short arm and 5'-terminus of this base sequence : 54626663
  Distance between 3'-terminus of neighbour sequence of sequence listing upward to telomere on chrosomal short arm and 5'-terminus of this base sequence : 148915
ttaatggcatcctgtggtgacaatgcaataacaggactattgtggcatcgagcaacatggtctccaagtttacttcctgacagtgactcaatcactgagcatgtgtttgaaatattatgcattcatgcatgcacatgcacatccatgagcatacacacacatctatccatgcacacacacacacacacacacacacacacacacacacacaccccaatcatacctaccaccatgctggtcag

SEQ ID NO: 23573 - DNA, 242 bp, Homo sapiens
  AC018994.3_111068
  Located on chromosome 18
  Distance between a terminus base of telomere on chromosomal short arm and 5'-terminus of this base sequence : 54626733
  Distance between 3'-terminus of neighbour sequence of sequence listing upward to telomere on chrosomal short arm and 5'-terminus of this base sequence : -172
tacttcctgacagtgactcaatcactgagcatgtgtttgaaatattatgcattcatgcatgcacatgcacatccatgagcatacacacacatctatccatgcacacacacacacacacacacacacacacacacacacacaccccaatcatacctaccaccatgctggtcagtacccacagccaaggaaaagtaaaggcctaaaaactaatctagaagatgtaaacgtggtaacagttaatt

SEQ ID NO: 23574 - DNA, 159 bp, Homo sapiens
  D18S1119
  Located on chromosome 18
  Distance between a terminus base of telomere on chromosomal short arm and 5'-terminus of this base sequence : 54650356
  Distance between 3'-terminus of neighbour sequence of sequence listing upward to telomere on chrosomal short arm and 5'-terminus of this base sequence : 23381
cctatcgtacatggtgagtgacccaggcatgaaggtatgaaagttatcctgtcattggcctttgtttgctagtctggattttgctagtctgcgcgcgcgcacacacacacacacacacacacacacacacacacacacacgtcattagttcaaatcaag

SEQ ID NO: 23575 - DNA, 376 bp, Homo sapiens
  U75701.1_112
  Located on chromosome 18
  Distance between a terminus base of telomere on chromosomal short arm and 5'-terminus of this base sequence : 54698371
  Distance between 3'-terminus of neighbour sequence of sequence listing upward to telomere on chrosomal short arm and 5'-terminus of this base sequence : 47856
tcttcgacgtatctagtggataatgcacaccttccctgagtcagagcctgcaaaaagcaaaggaacgaatggagaaagtgcaacaagcagaaagggggctgcaaagctgcctgcctagggctacgtttcctggcaaaacttccgaaagccatttctccaaaagaaggtctagaagaggaggaggaggaggagaaggaggaggaggaggaggagcagcagcagcagcagcagcagcagcagcagcagcagcagcagcagcagcagcagcagcagcagcagcagcagcatgaaagagccccacttggaaggcggtttggattttatttgtgtgttttgtggattctttttattttgctttacaaatgcatcttacacc

SEQ ID NO: 23576 - DNA, 182 bp, Homo sapiens
  D18S1127
  Located on chromosome 18
  Distance between a terminus base of telomere on chromosomal short arm and 5'-terminus of this base sequence : 54840482
  Distance between 3'-terminus of neighbour sequence of sequence listing upward to telomere on chrosomal short arm and 5'-terminus of this base sequence : 141735
tgcccatgaacttagtgtgaccacaccctattcttcaatatacccagttaattgtaatgttctcttctctctgcccgcctgtactgcctgagttttctctctctctctctgtgcctctgtgtgtgtgtgtgtgtgtgtgtgtgtgtgtgtgtgtgtgtgtatgcagtcactctccagggtct

SEQ ID NO: 23577 - DNA, 246 bp, Homo sapiens
  chr18.fa.O7frz.59066695
  Located on chromosome 18
  Distance between a terminus base of telomere on chromosomal short arm and 5'-terminus of this base sequence : 54947255
  Distance between 3'-terminus of neighbour sequence of sequence listing upward to telomere on chrosomal short arm and 5'-terminus of this base sequence : 106591
tttagttcattaaccacgacatttgaagatgtggtacccagttgttactcctttctttgactgtttgctgctgatacatgttttgcaactttgttttgagagttatcatatatatatatatatatatatatgggcagggggatgttttaatctggcattaccttttatgtagaaatactctcccttctgtgttgtgaaccagcttccaaagtggcagcaccattgtaccttccacctatgtaaacc

SEQ ID NO: 23578 - DNA, 353 bp, Homo sapiens
  chr18.fa.O7frz.59299775
  Located on chromosome 18
  Distance between a terminus base of telomere on chromosomal short arm and 5'-terminus of this base sequence : 55141756
  Distance between 3'-terminus of neighbour sequence of sequence listing upward to telomere on chrosomal short arm and 5'-terminus of this base sequence : 194255
gccttgttaagaggttattcacttttatgtggtactatcatagttttcatttttatcttctgattttcctctaattttctattctgtaacaatatagattaacaacgtttaaacttttaatctatgtagaatttaacttttctgtatggtggagggaaacatcttaagttttttttttttctatagagtatcctgttgtcccagttctaataaatgaattgtctattactgtctagaaatgtcttcatggccatatcctagaactgtgtgtgtgtgtgtgtgtgtgtgtgtatgtgtgcacatatatacatattcttaaactttattttgtccaagatctaatgtaacattgt

SEQ ID NO: 23579 - DNA, 219 bp, Homo sapiens
  AC006961.16_27663
  Located on chromosome 18
  Distance between a terminus base of telomere on chromosomal short arm and 5'-terminus of this base sequence : 55384421
  Distance between 3'-terminus of neighbour sequence of sequence listing upward to telomere on chrosomal short arm and 5'-terminus of this base sequence : 242312
acctaggaaggcattaggaagccatgagatgagagtgaggaagtcaaggctataaatgcgtgtgtgtgtgtgtgtgtgtgtgtgtgtgtgtcccaagaaactagactataaaggaaagcggaaagggacaatggcaacaactggaacacaaagaggaagacagatttttttaaagataagaaaaacatgtctatagtttccaaagaagtaatctgttga

SEQ ID NO: 23580 - DNA, 285 bp, Homo sapiens
  AC006961.16_140931
  Located on chromosome 18
  Distance between a terminus base of telomere on chromosomal short arm and 5'-terminus of this base sequence : 55497580
  Distance between 3'-terminus of neighbour sequence of sequence listing upward to telomere on chrosomal short arm and 5'-terminus of this base sequence : 112940
gagaaagatagctggaaagtctccagagtcagaaaccagagtggtgaatgcctcaggaattatttcatggggcgcacactcgagataacttggactgtgaatctggacaagaaaacaatggaggagattaaaaacccaaatgtttgaatgtttttcaagttgcatttctatttatttatttatttatttatttatttatttatttgttttttgagacagagttttgctcttgtcacccaggctggagtgcaatggcacgatctgggctcattgcaacatccactt

SEQ ID NO: 23581 - DNA, 300 bp, Homo sapiens
  chr18.fa.O7frz.59777305
  Located on chromosome 18
  Distance between a terminus base of telomere on chromosomal short arm and 5'-terminus of this base sequence : 55618039
  Distance between 3'-terminus of neighbour sequence of sequence listing upward to telomere on chrosomal short arm and 5'-terminus of this base sequence : 120174
tatcaacttctcaggacatcagtctccttatctcaaataaaaaaataaaaactacttcacaagacagttggtaggagaaatgagggaacatatgttcctatataaggtacctagcatagtgtttgacagataggaggaggtgttttaaacttagttctgtgaccattcctttctctgattttttttaaaaacaaatgttggcatgcatgggtatgtgtacacacacacacacaaacacacacacacacacacacacttaatataaacccaaactccctagactggtaccaaattaagttg

SEQ ID NO: 23582 - DNA, 208 bp, Homo sapiens
  chr18.fa.O7frz.60413931
  Located on chromosome 18
  Distance between a terminus base of telomere on chromosomal short arm and 5'-terminus of this base sequence : 55768959
  Distance between 3'-terminus of neighbour sequence of sequence listing upward to telomere on chrosomal short arm and 5'-terminus of this base sequence : 150620
ttcagcttagaagttgacaaattgcaaaatcaccagattttaaaattccgaattcctttgaggaacccttgaaattctgacagaaaaatgagcgccacagtaagaaatctgctggaaaagaatgcgggacgtgtgtgtttagtgtgtgtgtgtattcaggccgtgtgtgtcttggtgtgtgcgccctgtctccaaactcatttcatgc

SEQ ID NO: 23583 - DNA, 342 bp, Homo sapiens
  chr18.fa.O7frz.60320184
  Located on chromosome 18
  Distance between a terminus base of telomere on chromosomal short arm and 5'-terminus of this base sequence : 55862734
  Distance between 3'-terminus of neighbour sequence of sequence listing upward to telomere on chrosomal short arm and 5'-terminus of this base sequence : 93567
aatgagttaatgcaacagaagtacctaaaacagtgcctgacacatagtaaacactggtaggtgcatgcaaaccgtatcagctatcatcatcatcatcatcatcatcatcatcatcatcatccatctgcatctctgaatatatactacagagagattaaataagatgtagttaatttgctattttcctagggcaaataagtgtcaactaataacatgctaatacataaggaaaatgaatgctcagaatattttaaatttatatattttcaaatacttacaatttacaagtataaacctgataataattgcaaattattttatagcttccatctaaatttgcta

SEQ ID NO: 23584 - DNA, 414 bp, Homo sapiens
  AP001446.3_116291
  Located on chromosome 18
  Distance between a terminus base of telomere on chromosomal short arm and 5'-terminus of this base sequence : 55869064
  Distance between 3'-terminus of neighbour sequence of sequence listing upward to telomere on chrosomal short arm and 5'-terminus of this base sequence : 5988
gatctgacaaatgtaaagcaaggctacttttctcaatatttgttcattttggaaagtatttttcataaaatatttctacatcaatgcaaaatgagtttattttaaataaatcaatatttttaaaatgctcagttttaatttttaaaagatgaaaatatagatacaaccttcataaacaaaaactcaggtcttcaattttgatgagatcctgagaccaaaaagtttgagaaccactactttaaagactgaaaagcatttcgtaatcaaagattgcttgtagccaaagggaaagagagagagagagagagagagagagactttagaaaaccagtgggggcaaaaatcagattccagtagatgaagagagtgggagaggtgacaaactggatgaagtgtaaactccttgtcctggag

SEQ ID NO: 23585 - DNA, 487 bp, Homo sapiens
  AP001841.1_65552
  Located on chromosome 18
  Distance between a terminus base of telomere on chromosomal short arm and 5'-terminus of this base sequence : 56063984
  Distance between 3'-terminus of neighbour sequence of sequence listing upward to telomere on chrosomal short arm and 5'-terminus of this base sequence : 194506
cagttatggttccaatttcacatatttaatgcttaagtatatatacatatatacatacacacacattatatatggcatggcaagaaagactgcttatatatatttgtgtgtgtatatatgtgtatatatacacgtatatatacacatatatacgtgtatatatacacacacatatatacacacatatatacgtatatatacacacatatatatgtatatacatacacacacacacatatacacacacacacacacacacacacacacacacacacacaaagcacaaaacatcctccaagatatactgctgcttacccttccaatttcacctctcaccacaatccctataacttctgccaaatcaaaccacttgtactttcccggaccaaagtgtgtgtgtacatatatacacacaaacatacatatatatgtgactggaaagaaatgtgtgaaaatattaatagtaattacaatcttgtgatggaat

SEQ ID NO: 23586 - DNA, 363 bp, Homo sapiens
  AC007052.4_29151
  Located on chromosome 18
  Distance between a terminus base of telomere on chromosomal short arm and 5'-terminus of this base sequence : 56269260
  Distance between 3'-terminus of neighbour sequence of sequence listing upward to telomere on chrosomal short arm and 5'-terminus of this base sequence : 204789
ttatttgctagtctccaactcaactctagtcaggtttgtctcctcactgtcccacaaacctgctaggcccttctttgcaccacaactgcctgcctagaataaccatcctccacccgcttctcctatccagaaccttcaggcccagctgttcaatgaagttctgcatgctcccactgccggtctcctcgtcccctaaacaacattccattttcatttgcatatacagaaacacacacacacacacacacacacacacacacttcttcatgaatacacacatatgcatatacatgtatatatacattcatgcatgagtgtgttcacatgtatttcaaatgttcctatgagagcatgaactccttg

SEQ ID NO: 23587 - DNA, 421 bp, Homo sapiens
  AC084350.1_91067
  Located on chromosome 18
  Distance between a terminus base of telomere on chromosomal short arm and 5'-terminus of this base sequence : 56481535
  Distance between 3'-terminus of neighbour sequence of sequence listing upward to telomere on chrosomal short arm and 5'-terminus of this base sequence : 211912
gtgacataaatgtcagtgcacatccattcatcatttctacctacaaacacagtgcccacaagagccgggacactgaacccacaccctttcttctgcaggtcttggtctgattgctatttttcagggaatcacctggcctctccattcagttatcccactgtaattgcctgtggttgctaagacagaggaggaagcatgggaggacaggcctaggcatctatcacccagggctggatcaggcatataacttcataccatgccccctctaaactctcaagggccttctcatccatccatccatccatccatccatccatccactcacccatctgtccatctgtctgtccatccatccatccatctatccattcatatatttaattcagcaagtatttatcacttgccttctatgtaacaggta

SEQ ID NO: 23588 - DNA, 474 bp, Homo sapiens
  chr18.fa.O7frz.61622561
  Located on chromosome 18
  Distance between a terminus base of telomere on chromosomal short arm and 5'-terminus of this base sequence : 56894994
  Distance between 3'-terminus of neighbour sequence of sequence listing upward to telomere on chrosomal short arm and 5'-terminus of this base sequence : 413038
gctgagtagaaggtgattgacctgcctgagactttatcagtttggagttcatgttccatgtggtgttggagggagcaatggaggctgtgaaatcagacatcctgctttttgacagggttgtttgatgactcacccaagccattttttattctcggtgcatattctagtttcccttctcccgacagtagcctgatgcacctgtgcttgcactgtccttaagcctgttgctattgttatgtggtgtcactgagcccaacactgcgtgcgtgtgtgtgtgtgtgtgtgtgtgtgtgtgtgttgaaaggggtaggaaagtgaggatgattttcaaccattaaacccttaaggggccatcttctgaagcctggcatcatcatttttgttctcaagaacatttaagtcaaaaataacaaggttccttttgctcatcttcaaattattttacttgtttgatccaactgctaactagaaggt

SEQ ID NO: 23589 - DNA, 385 bp, Homo sapiens
  AC011832.3_127407
  Located on chromosome 18
  Distance between a terminus base of telomere on chromosomal short arm and 5'-terminus of this base sequence : 56958448
  Distance between 3'-terminus of neighbour sequence of sequence listing upward to telomere on chrosomal short arm and 5'-terminus of this base sequence : 62980
aaactcctgacttcaagtgatctgcctgcctcagcctcccaaagtgctggaattacaggcgtgagccaccgtgtctggcctagaatcagggattaaaatagcaccacaaatctctctctctctatctatctatctatctatctatctatctatctatctatctatctatctatctatctgtctgtctatatctatctatctatatctatctgtctgtctatctatctatctatctatctatctatctatctatctatctctgtctgaattctatatgtgcttctttcttcatagcaacttctttctttcctactgtgtcgtgctgcacagtggcgtcctctatatggctgggacctggctattggattctttccttagctccaac

SEQ ID NO: 23590 - DNA, 325 bp, Homo sapiens
  AP001487.3_29196
  Located on chromosome 18
  Distance between a terminus base of telomere on chromosomal short arm and 5'-terminus of this base sequence : 57048956
  Distance between 3'-terminus of neighbour sequence of sequence listing upward to telomere on chrosomal short arm and 5'-terminus of this base sequence : 90123
taggccagtataaatagcacatacacacttgctgcaataaagccaagctacaaagggtttcctgactgctcttaaatattctcaacagcattatggggcagtatttccttgtcctcaatacaagacctgggcctgtggtgaagtcaactgtgaaaggggagtgaggggaaatgagagagggagagggagagggagagagagagagagagagagagagagagggagaaataagccaaaattctaaaacatacaaaaacaattaagaaaggcatccaacaaaatcaacagtcaaaagataaattcattctacatgattgcagtaata

SEQ ID NO: 23591 - DNA, 298 bp, Homo sapiens
  AP001487.3_41125
  Located on chromosome 18
  Distance between a terminus base of telomere on chromosomal short arm and 5'-terminus of this base sequence : 57060914
  Distance between 3'-terminus of neighbour sequence of sequence listing upward to telomere on chrosomal short arm and 5'-terminus of this base sequence : 11633
atgtccacctagacttagcatccattcatgattctcgcctgttccaatttttacctaatgtttgcaaagtgaggatgttttagcttcagcaccctttccacacttatcagttcatctgtagccctggtaaacaagacagccctccctcatctcctctctgtctccctatctatctatctatctatctatctatctatctatctatctatctatctatctaaattcatgaattcctgtttttaaatcgtttgtacatggttttcatgctaaatcattttggtgctcagattgtaccagc

SEQ ID NO: 23592 - DNA, 198 bp, Homo sapiens
  D18S858
  Located on chromosome 18
  Distance between a terminus base of telomere on chromosomal short arm and 5'-terminus of this base sequence : 57187661
  Distance between 3'-terminus of neighbour sequence of sequence listing upward to telomere on chrosomal short arm and 5'-terminus of this base sequence : 126449
agctggagagggatagcattaggagaaatacctaatgtaaatgatgggttgaggggtgcagcaaaccaacatggcacatgtatacttatgtatcaaacctgcacgttgtgcacatgtaccctagaacttaaagtataataataataataataataataataataataaactgtcagattcctactttcatgcaatgca

SEQ ID NO: 23593 - DNA, 356 bp, Homo sapiens
  AC007628.3_41644
  Located on chromosome 18
  Distance between a terminus base of telomere on chromosomal short arm and 5'-terminus of this base sequence : 57187676
  Distance between 3'-terminus of neighbour sequence of sequence listing upward to telomere on chrosomal short arm and 5'-terminus of this base sequence : -183
gcattaggagaaatacctaatgtaaatgatgggttgaggggtgcagcaaaccaacatggcacatgtatacttatgtatcaaacctgcacgttgtgcacatgtaccctagaacttaaagtataataataataataataataataataataataaactgtcagattcctactttcatgcaatgcatagtctagaggataaatgagtgaatgcatgtaaactgttaagcatggtgcctgaaatgtggttagaatataattaaaactgaagctagcagaagttttcactgtgccctaggaacctcagacacttcctagggttcagagaagggaccaaggaggaagtcttattgtccaaag

SEQ ID NO: 23594 - DNA, 431 bp, Homo sapiens
  AC007628.3_46467
  Located on chromosome 18
  Distance between a terminus base of telomere on chromosomal short arm and 5'-terminus of this base sequence : 57192402
  Distance between 3'-terminus of neighbour sequence of sequence listing upward to telomere on chrosomal short arm and 5'-terminus of this base sequence : 4370
gccacagaaatatgatagcaactccaagtcttctggggagagcagaaggtgtgggcatgaggaaaagaaaggtgggagggaagagagtggagaggggaaagagaacgtggaagagactgccttccgggtacacctaagaccttatctttctttctctgggtctctggaatatgcactacctggccatttctggaaacaaacaaactgaatgcatttacacacacacacacacacacacacacacacacacgtatacacacatacatgaatgcacagacttatatgtacacaaacacatatcaaaggcttatgcttccccactaagccaagtgtcctttatctttaccttgtccttcccactatacacaacctaaaatagtccaaaccccaattggaggtagtctgggatcttatctggctttaagccatct

SEQ ID NO: 23595 - DNA, 424 bp, Homo sapiens
  AC007628.3_126108
  Located on chromosome 18
  Distance between a terminus base of telomere on chromosomal short arm and 5'-terminus of this base sequence : 57271971
  Distance between 3'-terminus of neighbour sequence of sequence listing upward to telomere on chrosomal short arm and 5'-terminus of this base sequence : 79138
ctcagcaaactaacacaggaacagaaaaccgaacaccacatgttcccactcataagtgggagttgaacaatgagaacacatggacacagggaggggaacatcacacacctgggtctgttgtggggtggggcgctagtggagggatagcattaggagaaatacctaatgtaaatgacgggttgatgggtgcagcaaaccaccatggcacacataatacctatgtaacacacctgcacattctgcacatgtatcccacaacttaaagtataattaaaaagagagagagacagagagagagagagagagagagagagagagagagagagagaaacataaactccctatccttgctttctcaactcctgaggcagcttccagccctcccaatgcacccttaaaatgacttcaagtgaactagtactgg

SEQ ID NO: 23596 - DNA, 401 bp, Homo sapiens
  AC007628.3_138193
  Located on chromosome 18
  Distance between a terminus base of telomere on chromosomal short arm and 5'-terminus of this base sequence : 57284188
  Distance between 3'-terminus of neighbour sequence of sequence listing upward to telomere on chrosomal short arm and 5'-terminus of this base sequence : 11793
actgagcttctgttcaaatgagatttaagccaacatgaaagatggaatgtgctattttttttctttcctaaggtcctcgatgtcacatccagcaaaagcaggttgcccatattgtggtaattattgtctaagctcttattttgaacaaaaggaaattgtgtgtgtgtgtgtgtgtgtgtgtgtgtgtgtgtgtgtgtgtgacagagagagagagagagagagagagaaagagagcaagagagagagagagagattgacctggggaaggagaggcaaggagggagaaagaaaggaaatagaaagaagagagagacagcagagacagaaagaggaatgatgaagggaaagaaaaaggagttcattccagggaattttttttattaaattccaacacgaggaag

SEQ ID NO: 23597 - DNA, 403 bp, Homo sapiens
  chr18.fa.O7frz.56650290
  Located on chromosome 18
  Distance between a terminus base of telomere on chromosomal short arm and 5'-terminus of this base sequence : 57466573
  Distance between 3'-terminus of neighbour sequence of sequence listing upward to telomere on chrosomal short arm and 5'-terminus of this base sequence : 181984
ccatacattgatgtttaggaagaccaaagctggaattaaaatcctcagcaggggttcccacaatgaatgactatgggtgtgagggtttctcagcatatatgtgtgtgtgtgtgtgtgtgtgtgtgtggtttttgctttttcatccttaccatcctttcatcattcaaggagccatatttcatattctatttgcataagcaaggaaaacattacacaattcctgaagatacaagtaatcaagtgttataccatgaagttctaataataaatattaaagatagggcagtaaaacagtacaaagaaaagctttgtagtgaacacagaacttgtccaggaccttggacaatacgtctggttagagaggtggcaaagcacagaagattaaatacattaaggactccgt

SEQ ID NO: 23598 - DNA, 438 bp, Homo sapiens
  AC009285.3_22147
  Located on chromosome 18
  Distance between a terminus base of telomere on chromosomal short arm and 5'-terminus of this base sequence : 57609110
  Distance between 3'-terminus of neighbour sequence of sequence listing upward to telomere on chrosomal short arm and 5'-terminus of this base sequence : 142134
atagctaccttacaggaagtcatatacacagacttacatataacatatatgtgttatacgatagctgtaatactatgttacttatgtgtgttacatatgtatgttatacttttcatcatgatacctaggtgtattagtctgttctcacaatgctataaataactacctgagactgggtaatttataaaaaaaccggtttaattgactcacagttccacagactgtacaggaagcatggctggggaggcctcaggaaacttaaaatcatggtggcagataaaggggaagcagacatgtcttccatggccagagaaagagagagagagagagagagaagggggaggtgctaccacttttaaaccaccagatctcctgagaactcactcactatcatgagaacagcaagagggaaatctactgccatattacaatcacttc

SEQ ID NO: 23599 - DNA, 316 bp, Homo sapiens
  chr18.fa.O7frz.56783764
  Located on chromosome 18
  Distance between a terminus base of telomere on chromosomal short arm and 5'-terminus of this base sequence : 57634277
  Distance between 3'-terminus of neighbour sequence of sequence listing upward to telomere on chrosomal short arm and 5'-terminus of this base sequence : 24729
taatttatgacaaagatgccactataatagaaacagaaaaatgatcttttcattaaaggtgtttgatcaaaggaatatatatatatatatatatatatatatatatatgaaaaaatttattcctatctcatcccatatacacaaacacaattttagatgaataaggtaaaatcaaagattttataaaagaaagcataaggaagtacctttatgacctttaggtaagaagaagttacatatataagacatttttaaaaacaccataatgagaaaaaaaatagaaaattagacttccttaaccttaagaatttggctc

SEQ ID NO: 23600 - DNA, 361 bp, Homo sapiens
  AC009285.3_92175
  Located on chromosome 18
  Distance between a terminus base of telomere on chromosomal short arm and 5'-terminus of this base sequence : 57678409
  Distance between 3'-terminus of neighbour sequence of sequence listing upward to telomere on chrosomal short arm and 5'-terminus of this base sequence : 43816
tttgagatacaggaagagtgatactaagaggaaagttcacaggattaaatgcctacatcaaaagtctgaaagagcacaaatagacaatctaaagtcacacctcaaggaactagagaaacaagaacaaatcaaactcaaacagagcagaagaaaagaaataagcaagataagggcagaactaaatgaaactgatacacagacacagacacagacacacacacacacacacacacacacacacacacaaaagatgaatgaaatttcagctcttcatttatacctcatttaaaggatggcttcattcaatgaaacagtatctgtgagaacagattataaacttgaaagtgcttataattgtcat

SEQ ID NO: 23601 - DNA, 334 bp, Homo sapiens
  chr18.fa.O7frz.57079585
  Located on chromosome 18
  Distance between a terminus base of telomere on chromosomal short arm and 5'-terminus of this base sequence : 57927686
  Distance between 3'-terminus of neighbour sequence of sequence listing upward to telomere on chrosomal short arm and 5'-terminus of this base sequence : 248916
tagagtatggaacaggattgtaaccttacagtggagaaacttgacagacaccaccttaagcaactagtggagtccaccattcccagtgagaccatgtggatagcaagtacctgatattatgagaagggacttcacctctgtggtattttttccaaaaaaacaaaacaaaacaaaacaaaacaaaacttgtgtcagcctaaacatggggagtggtggcggaaaatcagataaacacaaattgggcaacattctacaaagcacatgactaatactccaacttattaaagttatgaaaattaagactgagaaactgctagactaaatgtaacatggt

SEQ ID NO: 23602 - DNA, 463 bp, Homo sapiens
  chr18.fa.O7frz.57128773
  Located on chromosome 18
  Distance between a terminus base of telomere on chromosomal short arm and 5'-terminus of this base sequence : 58018425
  Distance between 3'-terminus of neighbour sequence of sequence listing upward to telomere on chrosomal short arm and 5'-terminus of this base sequence : 90405
tgagaattcaaggttgcagtgagctatgatccggccactgcactccagcctgggagacagagtcagactgtttcaaaaagaaagaaagaaagaaagaaagaaagaaagaaagaaagaaagaaagaaagaaagaaagaaagaaagaaagaaagaaagaaagaaagaaagaaagaaagagaaagaaggaaggaaggaaggaaggaaggaaggaaggaaggaaggaaggaaggaaggaaggaaggaaggaagggaaagaaagaaagaaaagaaagaaagaaagaaagaaagaaagaaagaaagaaagaaagaaagaaagaaagaaagaaagaaaaaggaaagaagaggaaagaaatggttccccatcctagaaatggttctctttgatgtagcctgggcaattattacataccggctctgtaaagaaatcacgacaaaatgtctgagtatggtaaacttgaatagg

SEQ ID NO: 23603 - DNA, 430 bp, Homo sapiens
  chr18.fa.O7frz.57326307
  Located on chromosome 18
  Distance between a terminus base of telomere on chromosomal short arm and 5'-terminus of this base sequence : 58169026
  Distance between 3'-terminus of neighbour sequence of sequence listing upward to telomere on chrosomal short arm and 5'-terminus of this base sequence : 150138
catttgcttcagctaaatagaagactaccctgaaatgcctaacctttggagacagttcttcacatagaaaaaccacaagaagtataagttttacaggttctcttatttgaagagtcaacccagaagtgagaccaggtgctctaaacctgtgaaatacaaaacctgtgaaattaaccatttatctgtatctctgcttcccggctccttttctcccacaccacgggcccttatttcagtgactgaattataacaccatctaagtgacttgcaaaaaaaaaaattacaggagtgtgtgtgtgtgtgtgtgtgtgtgtatttgtgtataattagttttgttttctctagagtatgttatgattaatactataggtatgtaagaaatgtaaaaccgtattatttttaatccatcctctaggcactagtttaagat

SEQ ID NO: 23604 - DNA, 363 bp, Homo sapiens
  chr18.fa.O7frz.57676645
  Located on chromosome 18
  Distance between a terminus base of telomere on chromosomal short arm and 5'-terminus of this base sequence : 58361493
  Distance between 3'-terminus of neighbour sequence of sequence listing upward to telomere on chrosomal short arm and 5'-terminus of this base sequence : 192037
ttagtcaagatgcgaaatgtaggctgggcacagtggctcatgcctataatcccagcactttgggaggccaacacaggtggattggttgagcccaggagttcaagaccagtctgagcaacatagtgagacctcatccctccaaaaattacaaatattagccaggtatggtggtgtgcacctgtagtcccagttactcaagaggctgagtcaggaggatcacttgagcctgggaggcagaggttgcagtgagccgtgattatgccactgtactccaacctaggcaatagagtgagattctgtctcaaaacaaacaaacaaacaaacaaacaaaaaacaagacaccaaatgctgattgcacttgac

SEQ ID NO: 23605 - DNA, 444 bp, Homo sapiens
  chr18.fa.O7frz.72252158
  Located on chromosome 18
  Distance between a terminus base of telomere on chromosomal short arm and 5'-terminus of this base sequence : 58453810
  Distance between 3'-terminus of neighbour sequence of sequence listing upward to telomere on chrosomal short arm and 5'-terminus of this base sequence : 91954
cataaagattcatgcctacattaggaaaatataggtgatttcaaagcctaaaatccttgtcagccaatttaaactgaattgacttgagatattgccactgagagcacctggggacctgaggtcattaaaagagagagagagagagagagagagagattgagattgctgtagcttaaatagagcaattgcataatatatcagaccaattttatttaaattaatttttgctagatttatatattcatttacatttataaaataatgaaaatagaattgaatttttttctcgtttcatggggacagtgattcgttatcttctcttttctgtttaaacagatttattgaacataaacgttatatgatggctttgtggaattagatattatatgaggatttttcctgagatatacattaagttgactgattacctctgtcaggaaagaa

SEQ ID NO: 23606 - DNA, 337 bp, Homo sapiens
  chr18.fa.O7frz.57549767
  Located on chromosome 18
  Distance between a terminus base of telomere on chromosomal short arm and 5'-terminus of this base sequence : 58555884
  Distance between 3'-terminus of neighbour sequence of sequence listing upward to telomere on chrosomal short arm and 5'-terminus of this base sequence : 101630
tataattgatttcctttaggcttcttgttttctgtttctccttctgtgttttctttgagagtaactgaatatttaaaattctatttaatttatctttggaatgtttagctctgtatctttgtattatatcatgatggttactctacaggttaacatatatatccataagtttgtataatctacttataattaatgttgtggtccttaatgggaaatatcaaaatcttttaatcatatagagttatctacctggtcttgtgtgtgtgtgtgtgtgtgtgtttgtatgtataattctacatacttaccatattcactacaacttgttgctttaaacaat

SEQ ID NO: 23607 - DNA, 328 bp, Homo sapiens
  AP001564.3_174441
  Located on chromosome 18
  Distance between a terminus base of telomere on chromosomal short arm and 5'-terminus of this base sequence : 58641961
  Distance between 3'-terminus of neighbour sequence of sequence listing upward to telomere on chrosomal short arm and 5'-terminus of this base sequence : 85740
tatagatccaagctcctaggactgtgacagattctcatttgatgtcactggccaaggtttctaaagatacagattgcttggtctcaatacaatcctaaagtattgtccaggaatcaagctatctatctatctatctatctatctatctatctatctatctatctatcatctatctatccatctatcagtttatctccaggaatctatctatctatcatctatctatctatctatctatctatctatctatctatctatctccaggaatctatctgtctatctatctatctatctatccatccatctatcactttatctccaggaatct

SEQ ID NO: 23608 - DNA, 350 bp, Homo sapiens
  chr18.fa.O7frz.72042728
  Located on chromosome 18
  Distance between a terminus base of telomere on chromosomal short arm and 5'-terminus of this base sequence : 58642358
  Distance between 3'-terminus of neighbour sequence of sequence listing upward to telomere on chrosomal short arm and 5'-terminus of this base sequence : 69
ctatcagtctatctccatgaatctatctatctatctatctatctatctatctatcaatcatctatctatctatctctctccaggaatctatctatctatctctctatctactctatctatctatctatccattctatcagtttatctccaggaatctatctatctatctatctatctatctatctatctatctatctatttatctatatcttaaagattctgggtgattgtggtatatattcaggtatgaaagctactgtaaaaaatgacaatgttatttagaaaaatacttgatattaaagaatttagacttaaaggctaacaaggtgaaagtgagtcagtatttgagt

SEQ ID NO: 23609 - DNA, 442 bp, Homo sapiens
  chr18.fa.O7frz.71788350
  Located on chromosome 18
  Distance between a terminus base of telomere on chromosomal short arm and 5'-terminus of this base sequence : 58906480
  Distance between 3'-terminus of neighbour sequence of sequence listing upward to telomere on chrosomal short arm and 5'-terminus of this base sequence : 263772
aacctcaaagatctaggtgtaaacaaaaacaattatgactcattttgaagataaaatttaagaataaacattaaacatttttatttgtattctgctttaacattctgtggaaatcacatcaagaaaaaatactctgctagaaaaattaaattatgtaaactgtgttagagacaagatagaaattttatctaaggagagcagctggcttcaccatggtcccgagtcttattctcagttttgcggatccagcgaacgaatgtaccagaagacagaattcaggaaaactgaatcacactctttcaggaatccttttggtcacacacacacacacacacacacaggcacatgatgtttggagttactccaccctagcaatctactcagcactgatatgcatattaaatttgttaaagactacatgtttaaggactgatttattcgc

SEQ ID NO: 23610 - DNA, 297 bp, Homo sapiens
  AC015988.4_25973
  Located on chromosome 18
  Distance between a terminus base of telomere on chromosomal short arm and 5'-terminus of this base sequence : 59101103
  Distance between 3'-terminus of neighbour sequence of sequence listing upward to telomere on chrosomal short arm and 5'-terminus of this base sequence : 194181
cttcagtaggtcttggatgagttagttgttctcattccaaaatgtaaatttctggtgtttagtaggtgctcagtaaagcttgagaaagatgaaagtgagagcccagaactagtataaaaatacggataccaccatagcatggtaattaaaggggtgattgtgaagatgaggtagctgtgcctggatatgtgtgtgtgtgtgtgtgtgtgtgtgtgtgtgttggctggagaaggcttaccagtggtgctggacatgtcgggtagagtgttaatagtaacttaattgactgaatttgga

SEQ ID NO: 23611 - DNA, 392 bp, Homo sapiens
  chr18.fa.O7frz.62268980
  Located on chromosome 18
  Distance between a terminus base of telomere on chromosomal short arm and 5'-terminus of this base sequence : 59305744
  Distance between 3'-terminus of neighbour sequence of sequence listing upward to telomere on chrosomal short arm and 5'-terminus of this base sequence : 204344
acaccagtcatattggatcagggctcaacctaatgacctcatttctttccttttctttccttctttctttctttctttctttctttctttctttctttctttctttctttctttctttcttttcttttcttttcctttctttttttctttctttctctctctctttctttcttctttttctctctctttctttctttccttccttccccccttcctgcctccctccctcccttccttccttctttcttttaaaaatatttttcttttttttcccttccttcctccctcccttccccccttctccttccccttcctccctttcccccttcctccctccttctctccctccctccctccttccctccctcagggtcttgttctgtcatctaggc

SEQ ID NO: 23612 - DNA, 401 bp, Homo sapiens
  AP001851.2_74646
  Located on chromosome 18
  Distance between a terminus base of telomere on chromosomal short arm and 5'-terminus of this base sequence : 59461378
  Distance between 3'-terminus of neighbour sequence of sequence listing upward to telomere on chrosomal short arm and 5'-terminus of this base sequence : 155242
gtatctttcaaccaaagataacacaacatttgatttattatcttagggccactgtttgtatcctgttcagcttaggagggaagtaaaataggaatgggttagtccaaaggagatatagtaaacaaacttaaaaaaaaaaaaacagttatcccccaaaaaggctgattatttacttcaccccaaaaaggaatcatttaactttttcaaatttatttttatttatttatttatttattttaaagatggggtctcactgtgttgcccaggctggattcaaattcttgggcttaagcaatcctcctacctcggcccctcaaagtgctgggattacaggcatgagccaccatgcccggcctttttcacatttctaaatgccttttattactatttcaaatgccagc

SEQ ID NO: 23613 - DNA, 433 bp, Homo sapiens
  chr18.fa.O7frz.62502319
  Located on chromosome 18
  Distance between a terminus base of telomere on chromosomal short arm and 5'-terminus of this base sequence : 59522965
  Distance between 3'-terminus of neighbour sequence of sequence listing upward to telomere on chrosomal short arm and 5'-terminus of this base sequence : 61186
gtctaagccaatgtagtgtcaccaggtgggagcctcatgacagatcagagagggaatgtgctgccaagatgccagcaactaaacaagtttgtcgactaaagacaaggaaaagtctagaaggtagccagaaaaggaggtgtggggaatgtgtgcgtgtgtgtgtgcgcgtatatatgtctgtgtgcgtgtctttgtctttgtttctgtgtctgtgtccctgtgtatgtgtgtgcatgtgtgtctgtgtgtatatctgtgtctgtgtctttgtgtgtctgcctctgtgtgttgtgtgtgtgtgtgtgtgtgtgtgtctaaagagaccttgcctgtttgaaggcagaggggaaggagcctgtgggaaaacaatgagggactaacggcggagtgatgttccagagtggtgagcacccctcgtgaggattcagagttt

SEQ ID NO: 23614 - DNA, 476 bp, Homo sapiens
  AP001491.3_159666
  Located on chromosome 18
  Distance between a terminus base of telomere on chromosomal short arm and 5'-terminus of this base sequence : 59585093
  Distance between 3'-terminus of neighbour sequence of sequence listing upward to telomere on chrosomal short arm and 5'-terminus of this base sequence : 61695
gagtattggccgtattaacaatgtaagtcttctaatccgtgaacatggaatgtcctttcttttgttttttaggtcttctttactttccttcaagaatgttttatagtttgtgtacaaatcataaacttattaaacttattcccaagtattttattctttttgatactactgtatcatggaattgttttattaatttcatttctggatgcttcaatgttcttgtatgtacaagcttgtaaactcaattattagttcaagatttgtgtgtgtgtgtgtgtgtgtgtgtgtgtgtgtgcgcgcgcgcgcgcgccttaggattttctatatacaagatcatgtcaactgtaactacagatacttttctagttatagttctattccaatctccattacaatctcaatgcttttatttatattactattttatttttactaattgtcctagatagaatctccagtacaatgctacatagaag

SEQ ID NO: 23615 - DNA, 204 bp, Homo sapiens
  D18S1117
  Located on chromosome 18
  Distance between a terminus base of telomere on chromosomal short arm and 5'-terminus of this base sequence : 59803157
  Distance between 3'-terminus of neighbour sequence of sequence listing upward to telomere on chrosomal short arm and 5'-terminus of this base sequence : 217588
ctgagacactgaaggtaggaaatttggccaaatgactggtggaattgttcaaacctaaagttcagggtcttttataggtacatagatgtatatttgagccctctcataggcgcgcgcgcacgcgcgcgcgtctgtgtgtgtgtgtgtatgtttggggcccctcagaggtatatatctggcaaaatgcaagtctggtttatctgg

SEQ ID NO: 23616 - DNA, 254 bp, Homo sapiens
  D18S1129
  Located on chromosome 18
  Distance between a terminus base of telomere on chromosomal short arm and 5'-terminus of this base sequence : 59843085
  Distance between 3'-terminus of neighbour sequence of sequence listing upward to telomere on chrosomal short arm and 5'-terminus of this base sequence : 39724
agtcttccaggacgagacatcactggctacacatttccagcaggctgcagatacgagtggacaagtagagtatcatttaaatttttgtgtttcagtgatgagtctgtaggcatgagtgcttgataagatgcccttgattttagggtgggaatgcagtgaaatggacgtgtgtgtgtgtgtgtgtgtgtgtgtgtgtgtgtgtgtgtgtgtgtgtgtgtgtgtttggggaggggagggggaatgcctgtgcagcc

SEQ ID NO: 23617 - DNA, 248 bp, Homo sapiens
  chr18.fa.O7frz.62907107
  Located on chromosome 18
  Distance between a terminus base of telomere on chromosomal short arm and 5'-terminus of this base sequence : 59888953
  Distance between 3'-terminus of neighbour sequence of sequence listing upward to telomere on chrosomal short arm and 5'-terminus of this base sequence : 45614
taaatatgtcagcgttctgaaccagtgaactttgtatacttgattttagtatcataattatgacttaaaatacatatatatatatatatatatatatatatagaaataaaataacttggggaataatctaaacgtattctgccaaccacagtacagtcattaccttagtgttactgcttctagtatgattattattttgataagatttggagtaaatatttcaggttaggagtaaatttaactggcat

SEQ ID NO: 23618 - DNA, 436 bp, Homo sapiens
  chr18.fa.O7frz.63473321
  Located on chromosome 18
  Distance between a terminus base of telomere on chromosomal short arm and 5'-terminus of this base sequence : 60269239
  Distance between 3'-terminus of neighbour sequence of sequence listing upward to telomere on chrosomal short arm and 5'-terminus of this base sequence : 380038
ctattgtcaggcgttgtactaggtcctttatattacattatctcagacaaagatcctatgaagttaggtacttcagccctcattttatagatgaggatactgaggctcagatttttttttctattgctgctgcataaattaagagactcagatatttttaaaaaccatgtgatattgcatcacagagctacaacggaaccccaattctccctagatccctacagaagaataacagttgccaaaaataaatctgtaaaaagccctacattctggacgatgcacacccagccaatcgtgtgtgtgtgtgtgtgtgtgtgtgtgtgtgtgtgtgtgtgtgtgaaatttctgcttcatcccaacaagttgatgatgctttaatcagatggcccaagagcagaggccaggggcttcagcgcagtagcatgaatccgactca

SEQ ID NO: 23619 - DNA, 205 bp, Homo sapiens
  D18S1155
  Located on chromosome 18
  Distance between a terminus base of telomere on chromosomal short arm and 5'-terminus of this base sequence : 60355047
  Distance between 3'-terminus of neighbour sequence of sequence listing upward to telomere on chrosomal short arm and 5'-terminus of this base sequence : 85372
ggctgggctatgtgtcagagagatgagtggtttactgttggaggaaggttctataggaagggacatgtctccaagggagagcagtatttggatacgaggagatgggtgggaagggttaacaagattgtgtgtgtgtgtgtgtgtgtgtgtgtgtgtggtggtggtggtggggagacagcctaagcaaaggcctagaagcagaggg

SEQ ID NO: 23620 - DNA, 300 bp, Homo sapiens
  AP002477.1_130879
  Located on chromosome 18
  Distance between a terminus base of telomere on chromosomal short arm and 5'-terminus of this base sequence : 60660096
  Distance between 3'-terminus of neighbour sequence of sequence listing upward to telomere on chrosomal short arm and 5'-terminus of this base sequence : 304844
caattcatttcaccatttaaagattttcctataaaaaggatttgtggtggctgacaaaaaataaactattgtgtgtgtgtgtgtgtgtgtgtgtacatatgtacacaaagtgtatgtagtatagggcaaaattagacaaagaaattaaggcaaaggaaaaatcaggatcaaacagtaaaataaagctgatgttatgttaattggcagggctgtataagcagaaagtcctgggccacgtttcaagcagatcacaagtcggttctcaaattctcagaagtcaactcaggataattacatgat

SEQ ID NO: 23621 - DNA, 189 bp, Homo sapiens
  D18S64
  Located on chromosome 18
  Distance between a terminus base of telomere on chromosomal short arm and 5'-terminus of this base sequence : 60717965
  Distance between 3'-terminus of neighbour sequence of sequence listing upward to telomere on chrosomal short arm and 5'-terminus of this base sequence : 57569
  misc_feature (1)...(189): n = A,T,G or C
tactnggtggtggttatacaacattgtgaaaatatttagtgccactgaattatgcaataaaaatggttaaaatgatatattttatattttgccacaaaaattaccaataactagagacaggcagaaaaaactacacacacacacacacacacacacacacagttgtgccagtgccgatttcctgatttg

SEQ ID NO: 23622 - DNA, 221 bp, Homo sapiens
  D18S1109
  Located on chromosome 18
  Distance between a terminus base of telomere on chromosomal short arm and 5'-terminus of this base sequence : 60748213
  Distance between 3'-terminus of neighbour sequence of sequence listing upward to telomere on chrosomal short arm and 5'-terminus of this base sequence : 30059
caggaggatcacttgagcccaggagtttgagaccaggctgggcaacatggggagaccctggaaaacacacacacacacacatacacacacacacacacacacacggttgtaggcactcaacaaatgtttgataatgagtgaacatatctactagcatggttaacctatcaccacatcagtttcaactccaaatttctcccttcccctccatgtcagcagtg

SEQ ID NO: 23623 - DNA, 427 bp, Homo sapiens
  chr18.fa.O7frz.63941630
  Located on chromosome 18
  Distance between a terminus base of telomere on chromosomal short arm and 5'-terminus of this base sequence : 60930114
  Distance between 3'-terminus of neighbour sequence of sequence listing upward to telomere on chrosomal short arm and 5'-terminus of this base sequence : 181680
acaattggcattgctgtaccgagcgcaggagaagttgtctgatgtgtagatataatttcagtcatttgagattaaaagggtccaggtgtggtggctcgtttctgtaatcccaccacttcgggaggccgaggtgggcagatcacttaagggcaggagtttgagaccagcctggccaatgtggtgaaaccctgtctctactaaaaatacaaaaattagaggggcgtggtggcaggcgcctgtagtcccagctactcaggaggccaaggcaggagaatcacttgaacccgggaggcggaggttgcagtgagctgagatcgcaccactgcactccagcctgggcaaaagcgtgcgactccattacacacacacacacacacacacacacacacacacacagaaactttaaaaggataatttggagtacttg

SEQ ID NO: 23624 - DNA, 420 bp, Homo sapiens
  chr18.fa.O7frz.64043344
  Located on chromosome 18
  Distance between a terminus base of telomere on chromosomal short arm and 5'-terminus of this base sequence : 61032000
  Distance between 3'-terminus of neighbour sequence of sequence listing upward to telomere on chrosomal short arm and 5'-terminus of this base sequence : 101459
attggtacagcctataaggtaaacagtatagaggttcctccaaaaattaaaaataaaaccactatatgatttagcaatcccacttctgggtatatattgaaaggaaataaagcagtattttcaagagatatctgcactcctatgatcattacagcattaattcacaataaccaagatatagaaacaacctaagtatccattgatggatgaatcgataaagaaaatattttatatatatgtgtgtgtgtgtgtgtgtgtgtgtgtatatatatacgttcacacatataattcagctgtaaaaagaaggaaatcctgtcatttgcaacaacatggaagtatctggaggacgttatgctgaatgaaataagccgggtacagaaaaacaaaaaccacatgatctcactgatgtttggaatctaa

SEQ ID NO: 23625 - DNA, 468 bp, Homo sapiens
  AP001546.3_92173
  Located on chromosome 18
  Distance between a terminus base of telomere on chromosomal short arm and 5'-terminus of this base sequence : 61111043
  Distance between 3'-terminus of neighbour sequence of sequence listing upward to telomere on chrosomal short arm and 5'-terminus of this base sequence : 78623
ggatgctgagtcaaatctagtagtcccttcctttcttatcttctcctttcaatgtctagtctttcctgattttagtagatgttcctcaatttccaccagcctgagcaaatacaagtcaagtcatactggtcagaatggtaaaaagaaattgttgtcacatctttccttcaaggtatggggaaagacattttttggagtttaaatagactcttctcatctttcttcagggaagatgatctatttttgtctgctttttaggtggtgaagcttccttcctttcactccatgccccatacttacttcttggaattgccgactgctcattcaatcctcaagaaccttttcatctcacctctttcttgtgttactgtgtgtgtgtgtgtgtgtgtgtgtgtgtgtgtggtatggttacttgattctgcccttggtagttactgagacgaggcttattaacctccagatgtctcc

SEQ ID NO: 23626 - DNA, 421 bp, Homo sapiens
  chr18.fa.O7frz.64130335
  Located on chromosome 18
  Distance between a terminus base of telomere on chromosomal short arm and 5'-terminus of this base sequence : 61111043
  Distance between 3'-terminus of neighbour sequence of sequence listing upward to telomere on chrosomal short arm and 5'-terminus of this base sequence : -468
ggatgctgagtcaaatctagtagtcccttcctttcttatcttctcctttcaatgtctagtctttcctgattttagtagatgttcctcaatttccaccagcctgagcaaatacaagtcaagtcatactggtcagaatggtaaaaagaaattgttgtcacatctttccttcaaggtatggggaaagacattttttggagtttaaatagactcttctcatctttcttcagggaagatgatctatttttgtctgctttttaggtggtgaagcttccttcctttcactccatgccccatacttacttcttggaattgccgactgctcattcaatcctcaagaaccttttcatctcacctctttcttgtgttactgtgtgtgtgtgtgtgtgtgtgtgtgtgtgtgtggtatggttacttgattctg

SEQ ID NO: 23627 - DNA, 196 bp, Homo sapiens
  DISD22_0011300
  Located on chromosome 18
  Distance between a terminus base of telomere on chromosomal short arm and 5'-terminus of this base sequence : 61310989
  Distance between 3'-terminus of neighbour sequence of sequence listing upward to telomere on chrosomal short arm and 5'-terminus of this base sequence : 199525
gaataataaagtcgtgctggcaatttataatttttcaagcaacttacaagaaatttaaaatagctgtaaatcaaggtaagtttatctctccaagctgtgtctgtatattaatttcaaatgacagaaaaatagatattttttttgctgtactacacacacacacacacacacatatacccaaatacttggctctgct

SEQ ID NO: 23628 - DNA, 323 bp, Homo sapiens
  chr18.fa.O7frz.65739635
  Located on chromosome 18
  Distance between a terminus base of telomere on chromosomal short arm and 5'-terminus of this base sequence : 61422890
  Distance between 3'-terminus of neighbour sequence of sequence listing upward to telomere on chrosomal short arm and 5'-terminus of this base sequence : 111705
agacactcttatctgcataacaaggcaatccttatttactatacatttcctcccctcaccttcccctaacttgtcttccccatacagaagccccaagccccttttcctttgcttaacctaagagggtgtatgaatctcaatctggctgcctccttgagccacattttttttttctgtgattgagagccacatttcttttctctgctgcatacatatataattagaactgttttttgttttttgtttgtttgtttgtttgttttctctcttgttaatctttcatcagtttgatttatgggctttagtcattgaacctagaatga

SEQ ID NO: 23629 - DNA, 171 bp, Homo sapiens
  chr18.fa.O7frz.65815502
  Located on chromosome 18
  Distance between a terminus base of telomere on chromosomal short arm and 5'-terminus of this base sequence : 61528548
  Distance between 3'-terminus of neighbour sequence of sequence listing upward to telomere on chrosomal short arm and 5'-terminus of this base sequence : 105335
tacaggaagcatagttgaagaggcctcaggaaacttacactcactacagaaagcaaacgagaagcagacatcttcttcacaatggtgaatcaggagagagagagagagagagataaaggagaaagtgccatacacttttacacaatcagatctcgtgagaactcactatca

SEQ ID NO: 23630 - DNA, 467 bp, Homo sapiens
  AC026003.3_173905
  Located on chromosome 18
  Distance between a terminus base of telomere on chromosomal short arm and 5'-terminus of this base sequence : 61639835
  Distance between 3'-terminus of neighbour sequence of sequence listing upward to telomere on chrosomal short arm and 5'-terminus of this base sequence : 111116
atgcagtgacatgataggttataagagaaaacaggctcagacaaagaaaggaagaaagaaaatgggagcaagtgaccagtcacagaaacccattttatcttacgtagtattgggatagatagatagatagatagatagatagatagatagatagatagatagatagatagtattgttataaaaattaatcattatatattaggtaaatataccacatcaaatagatattctcagtatataataaaaattgcaattgtctttattgcttttagcactctctcttatatttattgcttttagctctttctctagtaggtcagtgtttccctgaaaatgcacagcagcctgaaaaaagaaaattttgcattttaaaataccagagtgacactgggattaaagctaggcccatttatgccggcatatgagatctgagcctctgttctccaagaatcagaacacctgagttt

SEQ ID NO: 23631 - DNA, 213 bp, Homo sapiens
  D18S1134
  Located on chromosome 18
  Distance between a terminus base of telomere on chromosomal short arm and 5'-terminus of this base sequence : 61684397
  Distance between 3'-terminus of neighbour sequence of sequence listing upward to telomere on chrosomal short arm and 5'-terminus of this base sequence : 44095
gggtagacaaacttgtagaccattgcaaccaactagctaaaactatgttttaagagtgtgtgtgtgtgtgtgtgtgtgtgtgtgtgtaaagcatccacactttaccatgttgctttctttcattctccaatgcctttcctgagtccactctttaagactcaagtcatttatctattcctgaatttacctatccctccccagtctgccctagaa

SEQ ID NO: 23632 - DNA, 448 bp, Homo sapiens
  AC007911.8_73041
  Located on chromosome 18
  Distance between a terminus base of telomere on chromosomal short arm and 5'-terminus of this base sequence : 61773157
  Distance between 3'-terminus of neighbour sequence of sequence listing upward to telomere on chrosomal short arm and 5'-terminus of this base sequence : 88547
catagaattggtcactgatcactttagtaacaacagttacattgtagtgatcaattgaatttagaagtacctactagttaaagaagtacagatgtgggtgtaggctactctttcaaaaactttcgtgctcaatgtatatacacatacacacacacacacacacatatatacacacgcatatacacacacacacatatatatacacacactatatctatccatctatccatctatctatctatctatctatctatctatctatctatctgtctgtctatagagagagagagtgtagttgctagagagagtcagagccaaggacacactgctaggtcttgaggacaaaaaaatattgttgggttttccaaggctgagccacaaatttccattccagtacctgaacactgactgccacatattatttctagtagacatcgttctttagtgg

SEQ ID NO: 23633 - DNA, 252 bp, Homo sapiens
  AC007911.8_67941
  Located on chromosome 18
  Distance between a terminus base of telomere on chromosomal short arm and 5'-terminus of this base sequence : 61778304
  Distance between 3'-terminus of neighbour sequence of sequence listing upward to telomere on chrosomal short arm and 5'-terminus of this base sequence : 4699
accaacttccataggaaataagcatctgagcccagtttgagctccataagccaaatagagtcaaaactatcctgagctggatgtagtcccagctactcaagaggctgaagtgcaaggattgcttgcactcaggagctcaaggccagcctgcacaacatagtgagaccctgtctcaaaaaataaataaataaataaataaataaataaataaataaataaatatggaaactgattcttagccttcaatttgag

SEQ ID NO: 23634 - DNA, 411 bp, Homo sapiens
  AC007911.8_63757
  Located on chromosome 18
  Distance between a terminus base of telomere on chromosomal short arm and 5'-terminus of this base sequence : 61782414
  Distance between 3'-terminus of neighbour sequence of sequence listing upward to telomere on chrosomal short arm and 5'-terminus of this base sequence : 3858
tctatgctttctagacttgcattttccttatccttgcttctcacaccactggacttgcagtcaagcctattccaaacagaccctccaacacaaatttcaagaaaatgctatatgaaggaatagataagtcttacattttcttctaacttgttttcctaatgaaatgctttggcgtgatctgagttccttttatgacacgggagcttttgagaagtttcttatgtgaagttttcagggtccatatcattcattgcctactttattattattattattattattattattattattattataaaagaagaaataggcatcctgtgggataagggaataatcagggagataaaagtggttgcagtaggccaagaaatgcagtgtggattttattagagttccttcaactcaatc

SEQ ID NO: 23635 - DNA, 131 bp, Homo sapiens
  D18S862
  Located on chromosome 18
  Distance between a terminus base of telomere on chromosomal short arm and 5'-terminus of this base sequence : 61782610
  Distance between 3'-terminus of neighbour sequence of sequence listing upward to telomere on chrosomal short arm and 5'-terminus of this base sequence : -215
acgggagcttttgagaagtttcttatgtgaagttttcagggtccatatcattcattgcctactttattattattattattattattattattattattattataaaagaagaaataggcatcctgtgggat

SEQ ID NO: 23636 - DNA, 429 bp, Homo sapiens
  AC007911.8_55137
  Located on chromosome 18
  Distance between a terminus base of telomere on chromosomal short arm and 5'-terminus of this base sequence : 61791098
  Distance between 3'-terminus of neighbour sequence of sequence listing upward to telomere on chrosomal short arm and 5'-terminus of this base sequence : 8357
aggttgtattcactgaccagagcaagacgtcagccaaggaaagcaatggtgcgtggtcactggattcctgccatcctgacaggttccctgcctcctgagctgaatgcaggggatgcttagtttaactgtgactggccatgtagctggctagccatttgactcaacattgtagtacacatctgtaatagggttctcctaagaaagagagccagaactagtaacactgtgtgtgtgtgtgtgtgtgtgtgtgtgtgtataaagtcatgtgccacacaatggagtaccagtcaacaacagaccacatgtatgaagatagtctagaagattataataaagctgaacatttcctattgccatgtgacatcgcagctatcacagggcaatcacttgctttttttttagatttagtttggtctaagtgtacagcgt

SEQ ID NO: 23637 - DNA, 332 bp, Homo sapiens
  AC007911.8_30417
  Located on chromosome 18
  Distance between a terminus base of telomere on chromosomal short arm and 5'-terminus of this base sequence : 61815838
  Distance between 3'-terminus of neighbour sequence of sequence listing upward to telomere on chrosomal short arm and 5'-terminus of this base sequence : 24311
ttgaacatttctgtgaatacgtatattcagggaaatgctctctctctctctctctctctctatatatatatatatatacacacatatatgatatatatacacatatatgatatatatacacacacacatagagcatttatatatatacacacatatatagcatttatgtgtgtgtgtgtgtgtgtgtgtgtgtgtgtatctcattgtctttatccattcatactactgatggacacataggttgtttccatatcttggctattgtgaataatgctgcaattaatataggagttcagataccttttcagcatattgctttaagttcctctgga

SEQ ID NO: 23638 - DNA, 188 bp, Homo sapiens
  AC007911.8_25943
  Located on chromosome 18
  Distance between a terminus base of telomere on chromosomal short arm and 5'-terminus of this base sequence : 61820383
  Distance between 3'-terminus of neighbour sequence of sequence listing upward to telomere on chrosomal short arm and 5'-terminus of this base sequence : 4213
gtttatgaatagctttagccaaactgcaaacttcaatcaaccacttagagctcagatattcactgacgaagcacaagtatctctctctgtcacacacacacacacacacacacacacagacacaaacacacagcttttctatttgtaacgatcatcagaattcagtgaccaagatttactagtcgagt

SEQ ID NO: 23639 - DNA, 337 bp, Homo sapiens
  AC006203.1_105604
  Located on chromosome 18
  Distance between a terminus base of telomere on chromosomal short arm and 5'-terminus of this base sequence : 62099282
  Distance between 3'-terminus of neighbour sequence of sequence listing upward to telomere on chrosomal short arm and 5'-terminus of this base sequence : 278711
gtctacttccagtcactttgaaagcagctgagcaaagcttaaccccagttggatgagaatgaatacacacacacacacacacacacacacacacacacacacacccctatataaataacattattttagaaatacagactgggttgtcacacacacaggtgatctggctgcttcagcagtttcgaaacaacagtctggctgcccagttagggtaaggccttgtctcctctcccctctcaaccatcctatagtgggcaacacaggatacaaccttggttgtgtatgtgaccctcaagcaaatccaacacaatatctcattaaggaaagatttctagca

SEQ ID NO: 23640 - DNA, 148 bp, Homo sapiens
  D18S1148
  Located on chromosome 18
  Distance between a terminus base of telomere on chromosomal short arm and 5'-terminus of this base sequence : 62099312
  Distance between 3'-terminus of neighbour sequence of sequence listing upward to telomere on chrosomal short arm and 5'-terminus of this base sequence : -307
agcaaagcttaaccccagttggatgagaatgaatacacacacacacacacacacacacacacacacacacacacccctatataaataacattattttagaaatacagactgggttgtcacacacacaggtgatctggctgcttcagca

SEQ ID NO: 23641 - DNA, 188 bp, Homo sapiens
  AC006203.1_164686
  Located on chromosome 18
  Distance between a terminus base of telomere on chromosomal short arm and 5'-terminus of this base sequence : 62158404
  Distance between 3'-terminus of neighbour sequence of sequence listing upward to telomere on chrosomal short arm and 5'-terminus of this base sequence : 58944
ataactcactttcaattggttgagacacacacacacacacacacacacacacacacacaccccttagttctcaatcatggtcctgttgacatttgggggtgggtaattctgtgttgttgtggaggggttctcctgtgcactgaaccatgtttagcagcatctctggcctttacgcacgaaatgcagta

SEQ ID NO: 23642 - DNA, 201 bp, Homo sapiens
  chr18.fa.O7frz.64410150
  Located on chromosome 18
  Distance between a terminus base of telomere on chromosomal short arm and 5'-terminus of this base sequence : 62302168
  Distance between 3'-terminus of neighbour sequence of sequence listing upward to telomere on chrosomal short arm and 5'-terminus of this base sequence : 143576
tctgagttacatcactcaggagaattatagtctccaatctcatccaggtcactgcaaatgctgtttattcctttttatggctgcattgtattccatcatatatatatatatatatatatacacacacacacacacacacacacacacacacacacacacatacatacacacacaccacagtttctttatccactcgttgat

SEQ ID NO: 23643 - DNA, 473 bp, Homo sapiens
  AP002454.1_73034
  Located on chromosome 18
  Distance between a terminus base of telomere on chromosomal short arm and 5'-terminus of this base sequence : 62463974
  Distance between 3'-terminus of neighbour sequence of sequence listing upward to telomere on chrosomal short arm and 5'-terminus of this base sequence : 161605
caattgctactttctgtgaaagtgaaaattggcacaggaagtctgacaactttgtcaacaggatagtatcaaagtacaaattttttcccatgggaggttgaaaaagatgagacagaaggatgatagcaggatgaagaatggctttaaaaaatacacacacacacacacacacacacacacacacacacacacacacacagacatatatatatataacttctctctatatactctctctatatacatatatgccatctctatatgtatgtatatatatgtctgtgtgtgtatgtatatatatgtatgtagagagaaaggtgtaatatatgtatttatatgtgtatgtgtgtgtatatgtgtatatatagagaggtgtatacatatatatgtatgtgtatatatgtgtatgtgtgtatctctataggttggaaataaatagtcatggtactaattatggtagaatgattgacagc

SEQ ID NO: 23644 - DNA, 316 bp, Homo sapiens
  chr18.fa.O7frz.64688122
  Located on chromosome 18
  Distance between a terminus base of telomere on chromosomal short arm and 5'-terminus of this base sequence : 62595247
  Distance between 3'-terminus of neighbour sequence of sequence listing upward to telomere on chrosomal short arm and 5'-terminus of this base sequence : 130800
tgtaagtcatgaactatttgacatatatatatgtgtgtgtgtgtgtgtgtgtgtgtgtgtgtgtgtgcgcgtgtgtgtgtgtgtctgtatgtgtgtgtgtattgtatattgagtggtagatttgggagccattggcatttttaaggtaattaaagccatgctggtagctgcatccaccaatgagcagagcacatgtgaaatgagaggcaactgggtagcttgaagacgcagttggatcatggtcacttctgatctcctctgaaagtcgttaaaatttcttgtaaattttaaactagtttcagattctgtaaaacca

SEQ ID NO: 23645 - DNA, 461 bp, Homo sapiens
  chr18.fa.O7frz.65004952
  Located on chromosome 18
  Distance between a terminus base of telomere on chromosomal short arm and 5'-terminus of this base sequence : 62771608
  Distance between 3'-terminus of neighbour sequence of sequence listing upward to telomere on chrosomal short arm and 5'-terminus of this base sequence : 176045
catgaatagtgcgtacataatttaaaaggaagaaatataatgtgaagctctagtgtctcattctttgaacaaacaaaacaaagctaaataaggatcttagaacattagaggaaaagatgagagattggataatgaatacttacctccccacctctgccaacatattttgtagctgaggtctcaaaaggcaaagaggcttgctaaagccaccgagctagataatggcaaaaccagctcggaatgcttttggggtgtgtgtgtgtgtgtgtgtgtgtgtgtgtgttcaggggcaggcatattttaggtttggtgaaatatgtaagggaagggaatgaagatgtacaagctacacagcacaactttcaaattataaaaataaagcaaatccaaatactcattttctcaatgctttaagtcttttgatcttaagctcactactatttaaactgaattccaatcct

SEQ ID NO: 23646 - DNA, 428 bp, Homo sapiens
  chr18.fa.O7frz.66104867
  Located on chromosome 18
  Distance between a terminus base of telomere on chromosomal short arm and 5'-terminus of this base sequence : 62996092
  Distance between 3'-terminus of neighbour sequence of sequence listing upward to telomere on chrosomal short arm and 5'-terminus of this base sequence : 224023
tattaagaacttctgcgtgagtgtagtcatgcaccacataatgatgttttagtcaacaatggactgcatatacatggtggtcccataagatgataacagacctagtgatagcgcagtgtctttgcagcacaaagcattactctcgcttgtttgtggtgatgctggtgtgaacaaacctactgcactgccagtcctataaaagtctggcacacacaattatgtacagtacataatatctgataatgacaataaacaactgttaccagtatctacatttactataccatatttttcatcgttttttagactgtactccttttccatatatatatatatatatatatatatatatatatataaatttaactgtaaaatatcctcaggcaggtccttcaggaggtattctagaaagcactgttgtcatagat

SEQ ID NO: 23647 - DNA, 309 bp, Homo sapiens
  chr18.fa.O7frz.66202606
  Located on chromosome 18
  Distance between a terminus base of telomere on chromosomal short arm and 5'-terminus of this base sequence : 63035256
  Distance between 3'-terminus of neighbour sequence of sequence listing upward to telomere on chrosomal short arm and 5'-terminus of this base sequence : 38736
gtgaatttaggacttgcctaactaggccccacaatcacataagccaatttcttatactacatggcacatgtgtacatatgtaacaaacctgcacattgtgcacatgtaccctagaacttaaagcataataaaaaatatatatataatacatatatatatataaatatgtatatatattatatatatatatagcctggttctatttctctggtttttattaacgtaccaaactcctcactaaataaagtgtaaatgctgtagtccagcatttgaagcctttgattacttcggcctaatctatattgtatt

SEQ ID NO: 23648 - DNA, 157 bp, Homo sapiens
  D18S60
  Located on chromosome 18
  Distance between a terminus base of telomere on chromosomal short arm and 5'-terminus of this base sequence : 63119727
  Distance between 3'-terminus of neighbour sequence of sequence listing upward to telomere on chrosomal short arm and 5'-terminus of this base sequence : 84162
ttgtagcatcgttgtaatgttcctactaaatttacatgatgaaccaattagatcttttatatgtaatattatttgctggaatatacacacactctgtgtgtgtgtgtgtgtgtgtgtgtgtgtgtgtatacactgtatttttgccaggtgagccagg

SEQ ID NO: 23649 - DNA, 462 bp, Homo sapiens
  chr18.fa.O7frz.66382240
  Located on chromosome 18
  Distance between a terminus base of telomere on chromosomal short arm and 5'-terminus of this base sequence : 63153776
  Distance between 3'-terminus of neighbour sequence of sequence listing upward to telomere on chrosomal short arm and 5'-terminus of this base sequence : 33892
gaatcctcaatgctttatgtatactaactcatttaattcttacaaatatcctatggtgcattttcagccacaaggtcatacttcgtttcctattaaatagagagatgttatgcctactatgagcatataatagaaaagcacaactaatttgcttcagacttataggttcccattattactaagaagtattggatttttatttaaataaagctttccactcatgaaccacagcttcttctgtgtatagtaggggtgtgtgtgtgtgtgtgtgtgtgtgtgtgtgtgtgtctgtctgtctgtctgtctgtgttggtcacagaactgaaacagacatggcccaaacctcaaaccttatagtatgagagagacagacaagcaataacactaaggtatgaaaagtagtataataaaataagtccaacttgctttgggaacatgtaatcaaggcactaacctagtctt

SEQ ID NO: 23650 - DNA, 267 bp, Homo sapiens
  DISO7_00018350
  Located on chromosome 18
  Distance between a terminus base of telomere on chromosomal short arm and 5'-terminus of this base sequence : 63304273
  Distance between 3'-terminus of neighbour sequence of sequence listing upward to telomere on chrosomal short arm and 5'-terminus of this base sequence : 150035
gaccatgaggaaccaaggcacccacggtgatggggcctcagatgtgagtccagagaggagagcagactgaggtctccttccttagctgtgcttgttctgtgttgaacacacacacacacacacacacacacacacacaaatacacatacactctctctctcttttgtaacatctgaatcttgtctgtgattctgtaatcttggtgtgctctcttgccagtatcccagagtcccacctcacaagcaaatggtaaagcatgagtctgcc

SEQ ID NO: 23651 - DNA, 443 bp, Homo sapiens
  chr18.fa.O7frz.66844036
  Located on chromosome 18
  Distance between a terminus base of telomere on chromosomal short arm and 5'-terminus of this base sequence : 63522769
  Distance between 3'-terminus of neighbour sequence of sequence listing upward to telomere on chrosomal short arm and 5'-terminus of this base sequence : 218229
agacatagactaggtcattggatataagagtgtggctctcggccgggcgcagtggctcacacgtgtaatcccagcattttgggaggccaaggcagacagatcacctgaggtcaggagtttgagaccagcctggccaacacggtgaaaccccatctctattaaaaatacaaaaattagccaggcatggtggcatgtgcctgtaatcccaactactcaggaggctgaggcacaagaatcacttgaacccaggaagcggaggttgcagtgagctgagattgtgccactgcaccccagcctgaaaaacagagcaagactgtcaaaaagcaaaaacaaaaacaaaacaaaacaaaaaacaaacaaacaaaaaaatatggttctcaagggagtggccgaggctggagagatgccagaggaacatcagcatataggcaacatgcattagg

SEQ ID NO: 23652 - DNA, 429 bp, Homo sapiens
  chr18.fa.O7frz.65992320
  Located on chromosome 18
  Distance between a terminus base of telomere on chromosomal short arm and 5'-terminus of this base sequence : 63560801
  Distance between 3'-terminus of neighbour sequence of sequence listing upward to telomere on chrosomal short arm and 5'-terminus of this base sequence : 37589
tagttccaaatttaccagcttaaaagagtcaaacatttatcatctctcacagttccttgggggttaggaagcagggagtggcttagctaggtggttctggctcagggcctttcatgaggttgcttaggtgtcagctgaggccaccctcttctgaaggcttgactgggactgggtgacctgctctcaagattgttcactcacatggctgctggaaggatgccactgctcctcactggcctgaccagaaggcttcagctctttgccacatgagcccctccacaggtttgcctgaatatcctcacagcatggcagctggcttccccctgagaatctgatgagagacagagacaaaaaaaagagagagagagagagagagagagagagacagcaggaagccatttgtcttttatgacctagtctccaaagttg

SEQ ID NO: 23653 - DNA, 455 bp, Homo sapiens
  AP001562.3_163988
  Located on chromosome 18
  Distance between a terminus base of telomere on chromosomal short arm and 5'-terminus of this base sequence : 63560801
  Distance between 3'-terminus of neighbour sequence of sequence listing upward to telomere on chrosomal short arm and 5'-terminus of this base sequence : -429
tagttccaaatttaccagcttaaaagagtcaaacatttatcatctctcacagttccttgggggttaggaagcagggagtggcttagctaggtggttctggctcagggcctttcatgaggttgcttaggtgtcagctgaggccaccctcttctgaaggcttgactgggactgggtgacctgctctcaagattgttcactcacatggctgctggaaggatgccactgctcctcactggcctgaccagaaggcttcagctctttgccacatgagcccctccacaggtttgcctgaatatcctcacagcatggcagctggcttccccctgagaatctgatgagagacagagacaaaaaaaagagagagagagagagagagagagagagacagcaggaagccatttgtcttttatgacctagtctccaaagttgccaaagttgcacatcaatatttcctc

SEQ ID NO: 23654 - DNA, 441 bp, Homo sapiens
  AC011127.6_73390
  Located on chromosome 18
  Distance between a terminus base of telomere on chromosomal short arm and 5'-terminus of this base sequence : 63756978
  Distance between 3'-terminus of neighbour sequence of sequence listing upward to telomere on chrosomal short arm and 5'-terminus of this base sequence : 195722
aagaactggaacataaactcctcctatctttttgatacgaggtagcttttcaagtgggagcacaacactcactgacgttaggctcccatcctcccacactgaggacatagggcactatctgctttgatgattacatttcaaagaggtggctcctgggtccttgagaaagacattcctgggtggtaaagctggcaagaggagattatatatatatatatatatatatatatatatatatatatatacacacatacacacacacacacacacacacacacacacatatatttacatacatctcaaagaggtagagaaagaccagtgcagctgagaaacaaatgccacccctcaaaggagacgatgacacatcatgcatggaagaagtagactacgctctggctgaggaatgacttctacatgtgttcaatgttctacaattcc

SEQ ID NO: 23655 - DNA, 262 bp, Homo sapiens
  AC011127.6_26821
  Located on chromosome 18
  Distance between a terminus base of telomere on chromosomal short arm and 5'-terminus of this base sequence : 63779673
  Distance between 3'-terminus of neighbour sequence of sequence listing upward to telomere on chrosomal short arm and 5'-terminus of this base sequence : 22254
ttcaagcatacctatttgttaaactgtaaatcttcattgggaagtagagaattaacactttgcctgaaaagtgggtaacttttgaggggtgtgggtgtgtgtgtgtgtgtgtgtgtgtgtgtatgtgtgacagttcagttgctttaaaacatggcttttaaagtaactgaaaatatttctcattaaatatcttatttgcttaaacttattattaaaaaatcgagttgtcttttaatgatgctttcttgatgttattgtgctc

SEQ ID NO: 23656 - DNA, 290 bp, Homo sapiens
  chr18.fa.O7frz.66720294
  Located on chromosome 18
  Distance between a terminus base of telomere on chromosomal short arm and 5'-terminus of this base sequence : 63886285
  Distance between 3'-terminus of neighbour sequence of sequence listing upward to telomere on chrosomal short arm and 5'-terminus of this base sequence : 106350
taacaagtattcttgaagccactctctgatggactgaataaaatgcctacttctttgcatttgtgtgtgtgtgtgtgtgtgtgtgtgtgtgtgtgtgtagatcagatccctttttagcattagtttattatgtcaaggaaattggagtttggaaacccagttgcctattgtccattgtttttagtccttcacttgcttttcatttttattattctttgtcttttcttctctcttacttcttccccacaggaagagagtctgtcatatagtaaggagctcttagactggaa

SEQ ID NO: 23657 - DNA, 322 bp, Homo sapiens
  AC015989.4_8331
  Located on chromosome 18
  Distance between a terminus base of telomere on chromosomal short arm and 5'-terminus of this base sequence : 63946456
  Distance between 3'-terminus of neighbour sequence of sequence listing upward to telomere on chrosomal short arm and 5'-terminus of this base sequence : 59881
ttataaaccgaccactgtagttagtacaatcatcattaaaatattttttagtaatcttaaaatctgtgatgctgtgattctcttccacttatctatgttgaacagctatgaagaaatatctgtagcctcattgaatgcaacggtagcactgaaatattagtttaaaatagaattatttaaaatatttcacaaaatgtgtgtgtgtgtgtgtgtgtgtgtgtgtgtgtgtgtgtgtgtatgttttttttttctttttaaaaccagtcaattttatcttggaatctgggtctgtgtgcatttcatcatttatctggcttacctg

SEQ ID NO: 23658 - DNA, 367 bp, Homo sapiens
  chr18.fa.O7frz.67275754
  Located on chromosome 18
  Distance between a terminus base of telomere on chromosomal short arm and 5'-terminus of this base sequence : 64079755
  Distance between 3'-terminus of neighbour sequence of sequence listing upward to telomere on chrosomal short arm and 5'-terminus of this base sequence : 132977
taatctatcatttcatccacctactcattattccgtcacatccagccagccagtcagtcaaccaaccgtcctttcttccatcccaaacttacttccatttatccatccaaccaacctaagaattcccctgtcttctttctgtcctttgtcttcccttctttcttttctccctccatcccttcttttccacctttttttcattagtgcatcacaatctatcaatctatctgtctgtctatccatccatccatccatccatccatttatcacaaccatccaaaactaattaatatcactggtctaagtactaagctaaataagcattgaaatacagagttaaaatggtcttaccgtcaaacagtttatc

SEQ ID NO: 23659 - DNA, 110 bp, Homo sapiens
  DISD22_0011305
  Located on chromosome 18
  Distance between a terminus base of telomere on chromosomal short arm and 5'-terminus of this base sequence : 64359645
  Distance between 3'-terminus of neighbour sequence of sequence listing upward to telomere on chrosomal short arm and 5'-terminus of this base sequence : 279523
tgtatctatggcagctcctctttttcctgataacacacacacacacacacacacacacacacacacacacacaccagtcatataaatggttctgtgatagaaggtgagtc

SEQ ID NO: 23660 - DNA, 311 bp, Homo sapiens
  chr18.fa.O7frz.67391726
  Located on chromosome 18
  Distance between a terminus base of telomere on chromosomal short arm and 5'-terminus of this base sequence : 64500673
  Distance between 3'-terminus of neighbour sequence of sequence listing upward to telomere on chrosomal short arm and 5'-terminus of this base sequence : 140918
tctatgtttacaggcacagaacatccaggtggagccacacgaagcggtgcttggcaattagtggtcggatttccaaagacaggagttttgatgggactgtcttaaataaataaatctttttttcttaataatgtaaaaaataaatgatatttccctttggcagtaaatagctgattcgacgttttgcctgaagactgttaattgttgtgtgtgtgtgtgtctgtctgtgtgtgtgatgtttatatgtgtgttattttttcttaaacagcctgcagctttgtttcatggtacatcactgacaatgcatatta

SEQ ID NO: 23661 - DNA, 306 bp, Homo sapiens
  HUMUT574
  Located on chromosome 18
  Distance between a terminus base of telomere on chromosomal short arm and 5'-terminus of this base sequence : 64634198
  Distance between 3'-terminus of neighbour sequence of sequence listing upward to telomere on chrosomal short arm and 5'-terminus of this base sequence : 133214
gagccatgttcatgccactgcacttcactctgagtgacaaattgagaccttgtctcagaaagaaagaaagaaagaaagaaagaaagaaagaaagaaagaaagaaagaaagaaagaaagaaagaaagaaaaagagagaggaaagaaagagaaaaagaaaagaaatagtagcaactgttattgtaagacatctccacacaccagagaagttaattttaattttaacatgttaagaacagagagaagccaacatgtccaccttaggctgacggtttgtttatttgtgttgttgctggtagtcgggtttg

SEQ ID NO: 23662 - DNA, 246 bp, Homo sapiens
  chr18.fa.O7frz.67937037
  Located on chromosome 18
  Distance between a terminus base of telomere on chromosomal short arm and 5'-terminus of this base sequence : 64739593
  Distance between 3'-terminus of neighbour sequence of sequence listing upward to telomere on chrosomal short arm and 5'-terminus of this base sequence : 105089
atttagtgcctatttctggatatctatgtatctggatataaatgcacagcgtaaagcatatgagttttcacacacacacacacacacacacacacacacacacacacaccctttgtatcaaccacccagatccagatttggaattgcattaaatctataaattgatttggttaaattgactttgtttttttaagtcatctatctcataaacagggtcgatccctcctcttatttaggtcttcctta

SEQ ID NO: 23663 - DNA, 362 bp, Homo sapiens
  AC036176.2_142914
  Located on chromosome 18
  Distance between a terminus base of telomere on chromosomal short arm and 5'-terminus of this base sequence : 64824883
  Distance between 3'-terminus of neighbour sequence of sequence listing upward to telomere on chrosomal short arm and 5'-terminus of this base sequence : 85044
tagtccacagtgactagttaggatcctttatagtcaactgtgaatggctggaaacgtggacagctaatatgattccactattgtatgggagaggcatcatgtgaattagtgggaatcacctttattagtgaagaaaaaaatcacttgatgatttgtaggaatccggggagaatgctgagaatttgtggctgaaacttctcttaggaaaagagagagattgagtgagagcgagagcgagacagagagagagagagagagagaaagcgagaggcacatgctagaacaaagctcctttcatttgttcctgggagtggctgggtgtgtcaaatcatccctcagcctcgatgctgagtaatcaagta

SEQ ID NO: 23664 - DNA, 356 bp, Homo sapiens
  AF216854.1_3359
  Located on chromosome 18
  Distance between a terminus base of telomere on chromosomal short arm and 5'-terminus of this base sequence : 64941820
  Distance between 3'-terminus of neighbour sequence of sequence listing upward to telomere on chrosomal short arm and 5'-terminus of this base sequence : 116575
aggctagtcttgaactcctgacctcaggtgatccacacgccttggcctcccaaagtgctgggattacaggcatgagcttagctgggtgtggtggcaggtgcttataatcccagctactcggaaggctgaggcagaagaatcgcttgaatccaggaacagaggtttcagtgagccaagatcatgccacttcactccaacctggccaaaagagcaaaactccatcacacacacacacacacacacacacacacacacacacacgaaaaatcagaggtaaacgcagacctttttctgattttgcaaggagataatgtcacctcatataccaccgaggtttctttcagaagcgtccactc

SEQ ID NO: 23665 - DNA, 480 bp, Homo sapiens
  AC015536.4_114938
  Located on chromosome 18
  Distance between a terminus base of telomere on chromosomal short arm and 5'-terminus of this base sequence : 64948295
  Distance between 3'-terminus of neighbour sequence of sequence listing upward to telomere on chrosomal short arm and 5'-terminus of this base sequence : 6119
ctggctaacacggtgaaaccccgtctctactaaaaatacaaaaaattagcctggcgtggttgtgggcgcctgtagtcccagctactcgggaggctgagacaggagaatggcgtgaacctgggaggtggagcttgcagtgagccgagatagcgccactgcactccgcctgggtgacagaacgagactctgtctcaaaattaaataaataaataaataaataaataaataaataaataaataaataaattgtggctagtgtcctgtattttgaaaatgaggagagttttgtttcaaatccctgttcctctagtggctttctgacccttgaagcttcttaacttccttgaacttcaatactttcccatctctgaagagggctccatggtggttaacgtgcagcagtgttggaatgattagagaaacgtagcctagaaggggtctaggacatagaaagcactcaaatgataactgctatcgtct

SEQ ID NO: 23666 - DNA, 125 bp, Homo sapiens
  D18S836
  Located on chromosome 18
  Distance between a terminus base of telomere on chromosomal short arm and 5'-terminus of this base sequence : 65200717
  Distance between 3'-terminus of neighbour sequence of sequence listing upward to telomere on chrosomal short arm and 5'-terminus of this base sequence : 251942
tgtggggatagggtctcatactaaaccacactaatttttttatgcaaattacacacacacacacacacacacacacacacaaagtatttcctccaacatagtgtaaggctactttcaagtgagca

SEQ ID NO: 23667 - DNA, 284 bp, Homo sapiens
  D18S68
  Located on chromosome 18
  Distance between a terminus base of telomere on chromosomal short arm and 5'-terminus of this base sequence : 65223021
  Distance between 3'-terminus of neighbour sequence of sequence listing upward to telomere on chrosomal short arm and 5'-terminus of this base sequence : 22179
atgggagacgtaatacacccggcacttccaactcacataccagagacatggctctagcacccaatggaaatatgctgaatgttgcaggtgcaagacagcaacaaagcagacagaggcacatagacaaggcaccaacagtgtccactataccctgacagtgtggaaagttgtagataggatgaagagaaagaatacacacacacacacacacacacacacacacacacacacacacacacggtagagacttactactcaaagtgtgatcctcagaccagcagcat

SEQ ID NO: 23668 - DNA, 399 bp, Homo sapiens
  HUM575UT02
  Located on chromosome 18
  Distance between a terminus base of telomere on chromosomal short arm and 5'-terminus of this base sequence : 65315515
  Distance between 3'-terminus of neighbour sequence of sequence listing upward to telomere on chrosomal short arm and 5'-terminus of this base sequence : 92210
catgcacacctgattggcgtatctagtggctgttggggaatgcagcataaaattcctctcccaccaatactagtgttgacttcagatgtagttttctttctttctttcttttctttctctttctttctttctttctttctttctttctttctttctttctttctttctttctttctttcctttctttcttctctctctcttctttctttctctctctctcccttccttccttcattgcttccttccttgcttccttccttccttccttccttgcttccttccttccttccttgcttccttccttccttctttccttgcttccttccttccaagacagagtatcgctctgtcacccaggctggagtgcagtggtgcaatctcagctcattgcaacctcca

SEQ ID NO: 23669 - DNA, 269 bp, Homo sapiens
  HUMUT2039
  Located on chromosome 18
  Distance between a terminus base of telomere on chromosomal short arm and 5'-terminus of this base sequence : 65372291
  Distance between 3'-terminus of neighbour sequence of sequence listing upward to telomere on chrosomal short arm and 5'-terminus of this base sequence : 56377
gtatcaacctcatcaattgtcacctcaccattaaaactatctccttccagtcctgaaggttttattgggttcaaaattcctaaaaaagtaagaaagaaagaaagaaagaaagaaagaaagaaagaaagaaagaaagaagaaataaataaataaagaaagaaagaaaggaaggaaggaaggaaggaaaaaagaaagcaagaaagaaaaggaaagaaagaaagaaagaaagaaagaaagaaaatgtgaaaagctttgggagtattcagctt

SEQ ID NO: 23670 - DNA, 385 bp, Homo sapiens
  chr18.fa.O7frz.68409489
  Located on chromosome 18
  Distance between a terminus base of telomere on chromosomal short arm and 5'-terminus of this base sequence : 65471112
  Distance between 3'-terminus of neighbour sequence of sequence listing upward to telomere on chrosomal short arm and 5'-terminus of this base sequence : 98552
aatcaaccaagactttaataggacataactccaaacacttggattacccctgacactgtgtttgcggtgggataaagctttacgtggtgacacattctgcgtggaatgctggctccatctgctttcaacattccacttatactcaaatgtacataaattatatacatatataaatttaaaattatgctcataagttttaattgcccattttatacttattatctatgcatcattggctatcttgcaccactctaggtcttattttcctaagtataaaataagcctacttgatcaagaccctgggggtctgtgtgtgtgtgtgtgtgtgtgtgtgtgtgtgtgtgtacatatgtcatcctttgtccataggattacacttcataca

SEQ ID NO: 23671 - DNA, 162 bp, Homo sapiens
  DISO7_10004380
  Located on chromosome 18
  Distance between a terminus base of telomere on chromosomal short arm and 5'-terminus of this base sequence : 65870232
  Distance between 3'-terminus of neighbour sequence of sequence listing upward to telomere on chrosomal short arm and 5'-terminus of this base sequence : 398735
ggtaacagatgcatatcaaactcaatatttgtatttgtgacatttctttacttggatgaaaacagtagtccagagagtttatgtatgcgtatgaatgtgtgtgtgtgtgtgtgtgtgtgtgtgtgtgtgtgtgtttaattgaatgtgaatattcagcaggtt

SEQ ID NO: 23672 - DNA, 207 bp, Homo sapiens
  D18S1113
  Located on chromosome 18
  Distance between a terminus base of telomere on chromosomal short arm and 5'-terminus of this base sequence : 66131912
  Distance between 3'-terminus of neighbour sequence of sequence listing upward to telomere on chrosomal short arm and 5'-terminus of this base sequence : 261518
gttgactcaagtccaaacctgttctgcgtggcatgtttcttcaacttgatgtgatgctatttatcactgttctttgaagttaagtctctatgtctttgtattctttctgtgtacccagggatatgtttgtgcatgcacacgcataaacacacacacacacacacacacacacagagacagagacagagaacgtctacaatgtctttg

SEQ ID NO: 23673 - DNA, 362 bp, Homo sapiens
  G08003
  Located on chromosome 18
  Distance between a terminus base of telomere on chromosomal short arm and 5'-terminus of this base sequence : 66189233
  Distance between 3'-terminus of neighbour sequence of sequence listing upward to telomere on chrosomal short arm and 5'-terminus of this base sequence : 57114
aacaagtgtttatgggggtgtggagaaaagagaatgttcgaacactcttggttgaaatataagttggtagaaccattatgcaaaacagtatgaatctttatcagtataaaaatagaactagcatatgatccagcaatcccacctctggagatcccacccctatctctctatatctatctatctatctatctatctatctatctatctatctatctatctatctatctgtctgtctatcatctatctatctttctatctatctatctatctttctatctatctatctgtctatctataacggaatatttttcagccataaaaataaggaagtcctgctatttgcaacaaactgggtgaatatg

SEQ ID NO: 23674 - DNA, 428 bp, Homo sapiens
  chr18.fa.O7frz.69092672
  Located on chromosome 18
  Distance between a terminus base of telomere on chromosomal short arm and 5'-terminus of this base sequence : 66270707
  Distance between 3'-terminus of neighbour sequence of sequence listing upward to telomere on chrosomal short arm and 5'-terminus of this base sequence : 81112
ttctactcggaatttgtagatacttaatttttttgtattttattcatattaattgcttaacaaaaccaaatttagaatgtattttactataactattccttttggtatctataaattcattcttaaccacattcaaatatgaatcaatccccaaagtgcaatgaagtttttcaaatacgtcatgtgtcttcatttttttgccatggtagaatcaaggcatccttatggatccttttaacaacacacacacacacacacacacacacacacacacacacacacacacctccctaagggaagttataacagaggaaatacaaaaattacactggcacgcaacaactagaatgactaaaattaaaattatagataatatcaagtgttgacaataatgtggaacaactgaaacttaactacattgcagttgt

SEQ ID NO: 23675 - DNA, 313 bp, Homo sapiens
  AP001398.3_41167
  Located on chromosome 18
  Distance between a terminus base of telomere on chromosomal short arm and 5'-terminus of this base sequence : 66303132
  Distance between 3'-terminus of neighbour sequence of sequence listing upward to telomere on chrosomal short arm and 5'-terminus of this base sequence : 31997
agaaatagtattgcatagcttcagaagttttaaacaaaatggtgggtttggaatagaatttggttatttagtggaataaaatcaaatgtagtaaacatgagaaaatgaaaatacagatgtgtctttatcttatttatgtttgcatgtgtatgaatacacacacacacacacacacacacacacacataaaccaattagagctaaatacttaatgagacatttttagagaattggcaacatgtatatgtatttctattccttccctctctaaccaaatgaagaccacatagtgtatcagaatgctgttccagta

SEQ ID NO: 23676 - DNA, 195 bp, Homo sapiens
  G07990
  Located on chromosome 18
  Distance between a terminus base of telomere on chromosomal short arm and 5'-terminus of this base sequence : 66444015
  Distance between 3'-terminus of neighbour sequence of sequence listing upward to telomere on chrosomal short arm and 5'-terminus of this base sequence : 140570
agttagcagactatgttaatcaggattctccagacaaataataccaaaaggatatagatagatagatagatagatagatagatagatagatagatagatgatagatagatagatgatagatagatacatacatacatagatacatagacatatagatacaaagatagatacatagatacatcaaagatagatgga

SEQ ID NO: 23677 - DNA, 194 bp, Homo sapiens
  D18S868
  Located on chromosome 18
  Distance between a terminus base of telomere on chromosomal short arm and 5'-terminus of this base sequence : 66444038
  Distance between 3'-terminus of neighbour sequence of sequence listing upward to telomere on chrosomal short arm and 5'-terminus of this base sequence : -172
gattctccagacaaataataccaaaaggatatagatagatagatagatagatagatagatagatagatagatagatgatagatagatagatgatagatagatacatacatacatagatacatagacatatagatacaaagatagatacatagatacatcaaagatagatggatatttactacaaggtattggct

SEQ ID NO: 23678 - DNA, 239 bp, Homo sapiens
  D18S465
  Located on chromosome 18
  Distance between a terminus base of telomere on chromosomal short arm and 5'-terminus of this base sequence : 66536178
  Distance between 3'-terminus of neighbour sequence of sequence listing upward to telomere on chrosomal short arm and 5'-terminus of this base sequence : 91946
aaagttaattttcaggcactctatctataatgcttctaaataaagagagtgtgtgtgtgtgtgtgtgtgtgtgtgtgtgtaaaatatgcacatatgtgcatatttaaaaaccatttagagtataaaaacaataacaataaaaaatttagaaaaacactgaacataaaaatgatgattatctcatcacaatcagataaatttattttaaaaaaaccatctgtacttccataggggaatat

SEQ ID NO: 23679 - DNA, 342 bp, Homo sapiens
  chr18.fa.O7frz.68884317
  Located on chromosome 18
  Distance between a terminus base of telomere on chromosomal short arm and 5'-terminus of this base sequence : 66542709
  Distance between 3'-terminus of neighbour sequence of sequence listing upward to telomere on chrosomal short arm and 5'-terminus of this base sequence : 6292
cctgttaacttaggtacagacacttatcctagccttcctgcaaacatatacatggatgaatgtcctcactcccattgtcatggctcagctcacttgatccatcagcaccctgtttagtttacctagtaatgcattgtaaatgtgcatgtagacacacacacacacacacacacacagagagagagagagagagagagagagagagagaaagagactgaaggatagaactatgataagcctaagagcatagtatgctcaccatacaagaaaaactaaaaaatgtgtgaaaaccccctgaggaaggttgagcacaatgtagtgtcctaatcactgctttgttta

SEQ ID NO: 23680 - DNA, 211 bp, Homo sapiens
  D18S483
  Located on chromosome 18
  Distance between a terminus base of telomere on chromosomal short arm and 5'-terminus of this base sequence : 66555158
  Distance between 3'-terminus of neighbour sequence of sequence listing upward to telomere on chrosomal short arm and 5'-terminus of this base sequence : 12107
gaactgagcaaacgagtatgatagtcaaggaaaggcaaatgtgtgtgtgtgtgtgtgtgtgtgtgtgtgtgtgtagattttatatactatatataaaatctatctatcatctatctatctatctatctatctatctatctacctatctatcatctatctatctatctactgaaaaacccagggtaggggaatctattgaaattgtgcagaa

SEQ ID NO: 23681 - DNA, 444 bp, Homo sapiens
  AP001913.2_154684
  Located on chromosome 18
  Distance between a terminus base of telomere on chromosomal short arm and 5'-terminus of this base sequence : 66625809
  Distance between 3'-terminus of neighbour sequence of sequence listing upward to telomere on chrosomal short arm and 5'-terminus of this base sequence : 70440
aataagacagttgtaaccattcagggaaaagcctatgtgttactttggactacaagtttcatcttaaaaatacagagagcaggaaagagcattgtttctacccatacaaataataataataataataataataataataataataataaagagcgagaaactggtcaaattgcaaacatatgattttaaaaacaaacaaaaatcagagaactgaagattctcatatctagggaaagacaaacatttaatctgatatctagggaaagacaagtccctacagggtccaaaaaagaaaaaaattaaaagacttaaccatgtgtgtacctgaccgtgtgtgtacctggggcagactctcctggatgctctctaaggcagagagaagattcagctaagtatttttaatgaattgctaaaggccaagtgtggctaacattaaagtttgaa

SEQ ID NO: 23682 - DNA, 324 bp, Homo sapiens
  chr18.fa.O7frz.69740812
  Located on chromosome 18
  Distance between a terminus base of telomere on chromosomal short arm and 5'-terminus of this base sequence : 66855337
  Distance between 3'-terminus of neighbour sequence of sequence listing upward to telomere on chrosomal short arm and 5'-terminus of this base sequence : 229084
ggacactgattccagaatagtagatattaaaagaaaactaagttaactgtctgggtgggatagatttatgaatattaattcaattcaataagcctttataagactctgctgtgcatgtatcctcaaattaggtactaggtgattaaaataataataataataataataataataataataataataatagcttttgacctagtagaagagggggcaattttttagctaactagaaagcatgtcagattataataaattctgcaattgtaaatataaataaaatatgatggaatcacaaaggagagagtaactaaattggccaag

SEQ ID NO: 23683 - DNA, 157 bp, Homo sapiens
  G10262
  Located on chromosome 18
  Distance between a terminus base of telomere on chromosomal short arm and 5'-terminus of this base sequence : 66914074
  Distance between 3'-terminus of neighbour sequence of sequence listing upward to telomere on chrosomal short arm and 5'-terminus of this base sequence : 58413
gaaattaaacagcacactcctaaacaacgaatagtttaaagaagagatagatagatagatgatagatagatagatagatagatagatagatagataccactgaaaatgcaaacacaaaatagcagaatatatgtgatgcagcaaaggcaattctaag

SEQ ID NO: 23684 - DNA, 299 bp, Homo sapiens
  chr18.fa.O7frz.69817624
  Located on chromosome 18
  Distance between a terminus base of telomere on chromosomal short arm and 5'-terminus of this base sequence : 66924481
  Distance between 3'-terminus of neighbour sequence of sequence listing upward to telomere on chrosomal short arm and 5'-terminus of this base sequence : 10250
gagattccttggtttctaacacaagattttgaagatgcactttgtacagacctgttccacagcaggactccaaatacccctggaaaattttagtggacaattgtatgtagaaaacatacgatggctgctaggcttctttattttactacagtatcctctcaaattctagggccttacagtgggcagtgctaggagatacataaaaaacatgtgtgtgtgtgtgtgtgtgtgtgtgtgtgtgtgtgtatatatatatatacacatatatatatcatatgtgctattgttactaaagccaa

SEQ ID NO: 23685 - DNA, 286 bp, Homo sapiens
  HUMUT822
  Located on chromosome 18
  Distance between a terminus base of telomere on chromosomal short arm and 5'-terminus of this base sequence : 67068770
  Distance between 3'-terminus of neighbour sequence of sequence listing upward to telomere on chrosomal short arm and 5'-terminus of this base sequence : 143990
tccatccatccatccttccacagatacatctatttaaaataacaggaaaaaaagaaagaaagaaggaagaagaagaaagacagaagaagaaagaaagaaagaagaaagaaagaaagaaggaaagaaagaaagaaagaaagaaagaaagaaagaaagaaagagaaagaaagaaagaaagaaagaaagaaagaaagaaagaaagaaagaaagaaagaaagaaagaaagaaaagaaagaaagaaggaaaaagcctgggcatggtggctcacgcctgtaataccagcaca

SEQ ID NO: 23686 - DNA, 170 bp, Homo sapiens
  D18S878
  Located on chromosome 18
  Distance between a terminus base of telomere on chromosomal short arm and 5'-terminus of this base sequence : 67088225
  Distance between 3'-terminus of neighbour sequence of sequence listing upward to telomere on chrosomal short arm and 5'-terminus of this base sequence : 19169
tcaaatttttgagtctcaccagggcttacacacagggccccaatacaggagaaaatatatattttatataatgttagatagatagatacatagatagatagatagatagatagatagatagatagatagatagatatcgtatatcattagggttgttgctttctacagac

SEQ ID NO: 23687 - DNA, 149 bp, Homo sapiens
  G09104
  Located on chromosome 18
  Distance between a terminus base of telomere on chromosomal short arm and 5'-terminus of this base sequence : 67088235
  Distance between 3'-terminus of neighbour sequence of sequence listing upward to telomere on chrosomal short arm and 5'-terminus of this base sequence : -160
gagtctcaccagggcttacacacagggccccaatacaggagaaaatatatattttatataatgttagatagatagatacatagatagatagatagatagatagatagatagatagatagatagatatcgtatatcattagggttgttgc

SEQ ID NO: 23688 - DNA, 348 bp, Homo sapiens
  chr18.fa.O7frz.70075895
  Located on chromosome 18
  Distance between a terminus base of telomere on chromosomal short arm and 5'-terminus of this base sequence : 67194469
  Distance between 3'-terminus of neighbour sequence of sequence listing upward to telomere on chrosomal short arm and 5'-terminus of this base sequence : 106085
gatatgtatttcactgttcctcagtttcactcaacaatctagagcagtcactaaactacttgtaattcctggagagcaacgtaaagttttttccagttcttcaaacctccccctgcctgttgactcccctgcactctgctttcgtgcccccttaccatactcatcttttgagtctaaaaaatccctcctatttttcctttaaacaataaacagaagaagcacagcgcctgtaccagcaagatgcattttttttcaaggaagggagtgtgtgtgtgtgtgtgtgtgtgtgtgtgtgtgtgtgtgtgtattcaatcatgggaactggtctaatcatggaatgtagatgtc

SEQ ID NO: 23689 - DNA, 270 bp, Homo sapiens
  AC007632.4_38077
  Located on chromosome 18
  Distance between a terminus base of telomere on chromosomal short arm and 5'-terminus of this base sequence : 67313179
  Distance between 3'-terminus of neighbour sequence of sequence listing upward to telomere on chrosomal short arm and 5'-terminus of this base sequence : 118362
attcagtgcaccatacgtagttatgagtcctgctttgccaaatattgatcagtgtgtgtgtgtgtgtgtgtgtgtgtgtgtgtgttacactagggctggatactggcatagtaatttctaatacatttcattttgatctcggtgcgtcgttcagtgtgggatggagcaggtgcagcttgttgtttgccagagctccaaaattgaagtaaaacatgaagccctttataaaacaaaaagaaaaattacatctgcttattccaatgatcgtat

SEQ ID NO: 23690 - DNA, 372 bp, Homo sapiens
  AC007632.4_76152
  Located on chromosome 18
  Distance between a terminus base of telomere on chromosomal short arm and 5'-terminus of this base sequence : 67351063
  Distance between 3'-terminus of neighbour sequence of sequence listing upward to telomere on chrosomal short arm and 5'-terminus of this base sequence : 37614
aattgatctggtaagacagatttattgtaataataccacaagaagaaaaagaaaattcctagttttttagttctagcttttgttcagtaattatactgaaataaaaatgttagaggtttaaatatttttcaatatgtgaatgaacacaattacaattcttttactatgtttttacttgtcttattttgatttacgtattttctccattttctactactcattcttatttccccttatttatcattattattattattattattattattattattattattgagatggaaacttgctctgttacccaggctggtgtgcagtggcatgatcttggccccctacaacctccacttcctaagttcaagcaactct

SEQ ID NO: 23691 - DNA, 398 bp, Homo sapiens
  AC007632.4_114998
  Located on chromosome 18
  Distance between a terminus base of telomere on chromosomal short arm and 5'-terminus of this base sequence : 67389934
  Distance between 3'-terminus of neighbour sequence of sequence listing upward to telomere on chrosomal short arm and 5'-terminus of this base sequence : 38499
agtatgtttggtactgaatatggtgagcaagattttgctctcatctcggatatggaaagatcttggaaatcattatacctcatacttacaataagaaagaagctgagcaatttgaaaatcaacaatttcttttgtacctgtcagaaaagtgaagatatattaatcagggttcttcagagaaacataaccaataggacacagatctatatgtctcttttatctatctatctatctatctatctatctatctatctatctatctatctatccatccatccaaacagggaattattttgtgtgattatgcaggctgagaaatcccaagatctgctccctgtaaactagagattcaagaaactgatagtatagttccagtccaagtctaaagaccttagaat

SEQ ID NO: 23692 - DNA, 408 bp, Homo sapiens
  D18S875
  Located on chromosome 18
  Distance between a terminus base of telomere on chromosomal short arm and 5'-terminus of this base sequence : 67389969
  Distance between 3'-terminus of neighbour sequence of sequence listing upward to telomere on chrosomal short arm and 5'-terminus of this base sequence : -363
tgctctcatctcggatatggaaagatcttggaaatcattatacctcatacttacaataagaaagaagctgagcaatttgaaaatcaacaatttcttttgtacctgtcagaaaagtgaagatatattaatcagggttcttcagagaaacataaccaataggacacagatctatatgtctcttttatctatctatctatctatctatctatctatctatctatctatctatctatccatccatccaaacagggaattattttgtgtgattatgcaggctgagaaatcccaagatctgctccctgtaaactagagattcaagaaactgatagtatagttccagtccaagtctaaagaccttagaattaggaaaactgatactataaataccagtgtaagtctgaaagcctg

SEQ ID NO: 23693 - DNA, 320 bp, Homo sapiens
  AC007632.4_123564
  Located on chromosome 18
  Distance between a terminus base of telomere on chromosomal short arm and 5'-terminus of this base sequence : 67398663
  Distance between 3'-terminus of neighbour sequence of sequence listing upward to telomere on chrosomal short arm and 5'-terminus of this base sequence : 8286
ttaggaagtgctatctggtattagtgtataaaataaataggactgagggaagacataaataaataaataaataaataaatagctattttattcaaatacattttatttggcaatggcatggatgaggtgctaggaaaatgagaaaattgtctgtcttttgctttaatgtcaatggaattacatcatctgaaataggcgagtcaagatagaaaagattttttgataatacgggatgtatttattcaattgtaagttcaaaacgtggtaacagagttggaaaagcagttagaattggggtttcattaacagctaaacttctg

SEQ ID NO: 23694 - DNA, 327 bp, Homo sapiens
  AC007632.4_205611
  Located on chromosome 18
  Distance between a terminus base of telomere on chromosomal short arm and 5'-terminus of this base sequence : 67480519
  Distance between 3'-terminus of neighbour sequence of sequence listing upward to telomere on chrosomal short arm and 5'-terminus of this base sequence : 81536
aaacgattagcaagataaatcaagaaggaaataaataaaccaaaatttttaagcatcaggaatgaaaagaagggatatcactacaaaccacacagacatacaaaacattgcatgagtatctcattaacaattttgtatcaatatatttaaaaatttaacaaaatgagaaaaacatttgaaaacacagaaataacataagaaataaaagataattataattaaagaacttacatataccgcgcgcgcacacacacacacacacacacacacacacacacacacacagacacatagtctaggcccaggagctttaactggtgaattcct

SEQ ID NO: 23695 - DNA, 466 bp, Homo sapiens
  chr18.fa.O7frz.70530249
  Located on chromosome 18
  Distance between a terminus base of telomere on chromosomal short arm and 5'-terminus of this base sequence : 67628927
  Distance between 3'-terminus of neighbour sequence of sequence listing upward to telomere on chrosomal short arm and 5'-terminus of this base sequence : 148081
ccaagaaatagtctttccactctaactatatgtctccatatcaagttacatttatacaggggtgtgtgtgtgtgtgtgtgtgtgtgtgtgtgtgtattgcataactcacagttattacacatctggaaaattacttaatcacattacttatcaagaaactactaaaaaaaagacaaacaataattaatgtctacagagtagtaaattagagaaatgtagccccataaaatgtatttccttaagaattgtggcagataaaggtcattacaatgaatcttttgattccctcaagaaaagattaagttcttagggatgcttagaaatgaaaaaggcaaataatgaaagacacggtattaggaaaacacatatttacatccatgccttttttttctggttatacataaaaggttattttttctttctcactgttacttaagaatttaagttgcagactatgtgaatagga

SEQ ID NO: 23696 - DNA, 474 bp, Homo sapiens
  AP001448.3_48021
  Located on chromosome 18
  Distance between a terminus base of telomere on chromosomal short arm and 5'-terminus of this base sequence : 67722563
  Distance between 3'-terminus of neighbour sequence of sequence listing upward to telomere on chrosomal short arm and 5'-terminus of this base sequence : 93170
atactgaacatttgtagtggaaagaaaactttacaaaaattgttaagatcatcctcacaagtataggaaataagattctatttaattgaaaaggtattataatgcaaaaagaaggaataaaaactctgtctatatgtattattaaccaagaaatattattattattattattattattattattattattttgagacggagtctcactctgtcaccaaggctgcaagtgcagtggcacaatcttggatcactacagctttcgccaatcgggctcaagcaattctgccgcagcctcccgagtagctgggactataggcgtgcaccaccacgcccggctaatttttgcatttttagtagagatgggtttcaccatgttggctgggctggtctcaaactcctgatctcaagtgatgcgccagcctctgcctcccaaagtgctgggattacaggcatgagtcactgcaaacttccaag

SEQ ID NO: 23697 - DNA, 359 bp, Homo sapiens
  AP001448.3_62950
  Located on chromosome 18
  Distance between a terminus base of telomere on chromosomal short arm and 5'-terminus of this base sequence : 67849788
  Distance between 3'-terminus of neighbour sequence of sequence listing upward to telomere on chrosomal short arm and 5'-terminus of this base sequence : 126751
tagtgaataactcagccttcatcatgactgggtaatttattgtatacatttgggcaaataagcaactacacataacctcacacaatttgaattttactcattcttaatgaaataggtgtaaaataaggcaatataataaaattacacacacacacacacacacacacacacacacacacaatttccataagacttttctctttactctttgggacaccaggcaagaataactcttacaggagcagaaaattctacaaagtacatgaaatgaaattaatgcagtacataaaccgagagctctgctgttttaccgactgaagttcacgagaagtgtgggaatgaacagtattaatgttgcg

SEQ ID NO: 23698 - DNA, 411 bp, Homo sapiens
  AP001653.2_157859
  Located on chromosome 18
  Distance between a terminus base of telomere on chromosomal short arm and 5'-terminus of this base sequence : 67903229
  Distance between 3'-terminus of neighbour sequence of sequence listing upward to telomere on chrosomal short arm and 5'-terminus of this base sequence : 53082
aaattgtgttgctcaaagtattacatcaactttgaaaaatatataaaagaggactggcacaccatcttttagtttcatttctattttcattgactatacatgtccagtaatatttgaataagtgttataaagataatttcaaaatcagggatagtttccaagaattagttttattactgaatatataaatatgtatatatatatatgtgtgtgtgtgtgtgtgtgtgtatgtatgtatatatatgtgtatggcaagcttaaatattgaatgaattacaaataaatttttttaaatatctattatatattggtgcactcaggtatacatatatattaagttttttagtataactaacaaatactacttagtaattctattttgaactatatccatgtggttagtattgtcat

SEQ ID NO: 23699 - DNA, 478 bp, Homo sapiens
  AP001263.3_66625
  Located on chromosome 18
  Distance between a terminus base of telomere on chromosomal short arm and 5'-terminus of this base sequence : 67950147
  Distance between 3'-terminus of neighbour sequence of sequence listing upward to telomere on chrosomal short arm and 5'-terminus of this base sequence : 46507
taatgaacacctggatatcattaccctgtttcagtaattaccaacacatggtcaatattgtgtcatttctacacgtgctcactttttaatattaaaaccaatttcaaattcatatcattttaaccactgaagccacacacacacacacacacacacacacacaagtatacatgttatgtaagtgtgtatacacacttttaaacatcaaagcttaaaattaagaaaaaattttaatataataaaatattcatacagtgttcaaattaaaaatctttatctttgaattaagatttaaatatgtccacacaatgcagttttttggtacatttctcaattctcatttggtctacaggtttcctccaatttttctttccgtttatatgctgaagagtcaaggttatttgtcctacagagtttcacatagtctgaatgttgctaattgtatcactgttgtgtgattcagtatgtttctttatcc

SEQ ID NO: 23700 - DNA, 435 bp, Homo sapiens
  chr18.fa.O7frz.70942483
  Located on chromosome 18
  Distance between a terminus base of telomere on chromosomal short arm and 5'-terminus of this base sequence : 68058066
  Distance between 3'-terminus of neighbour sequence of sequence listing upward to telomere on chrosomal short arm and 5'-terminus of this base sequence : 107441
accagtagaacatacagtaccaagagtgtgagcatcagctatagactgggtgattatgatgtgtcaatgtaggttcatcaattgtaacaaatgtaccactctggtggggatattaataatggagtgtgtgtgtgtgtgtgtgtgtgtgtgtgtgtgtgtgtgtaggttagggacttttataggaattccctttacttcccattcatttttttgggatcctaaaactactttaaaaaaaaatattaatatcgttataaaacaaaacaaaaatcaaccaaacaaaaaaatcccacagctgtgattaccctaattacaaacaagtgtgcagtgggacttgtgtattttacggacagtgatccttgagaaaaccttaagtttcctactgaccttaaattttatcattctcagcatgtgaggcaaatagtgaataactac

SEQ ID NO: 23701 - DNA, 389 bp, Homo sapiens
  chr18.fa.O7frz.71015259
  Located on chromosome 18
  Distance between a terminus base of telomere on chromosomal short arm and 5'-terminus of this base sequence : 68135248
  Distance between 3'-terminus of neighbour sequence of sequence listing upward to telomere on chrosomal short arm and 5'-terminus of this base sequence : 76747
gttcacacttaatttaagcatcacatacatgtacacacacatctctctctttcactctctctctctgtatatatatatatatatatatatatatatatatatataaaatatatacacacatatatatacacacatatatgtgtgtatttatgtgtgtacatatacacacacaaatacatatacatgtatgtgtatgtatgcatagatagatatacgatttctacattgccttgccttatctaaatagtaatttttctctttcatattgaatcactgtcccagaaaaccagttattcctatatccatgtattagtccattttcaagctgctaataaagtcatacctgagactgggaagaaaaagaggtttaattggacttacagtttcac

SEQ ID NO: 23702 - DNA, 303 bp, Homo sapiens
  AC009891.2_134297
  Located on chromosome 18
  Distance between a terminus base of telomere on chromosomal short arm and 5'-terminus of this base sequence : 68304362
  Distance between 3'-terminus of neighbour sequence of sequence listing upward to telomere on chrosomal short arm and 5'-terminus of this base sequence : 168725
tggcagagtgagacttcatctgaaaacaataataataataataataataataataaaaaataatgagtatatgcaaaagttttttcaaacacaaggaaatagcacacctacaaaacaagttgaagagttgtagataatggtaatttttcaaactcttgtcataaaatgttttggttcatccaaacatggtaaaaccttcccattagttctatagatagatagctagctagatagatgatagatagatagatagatagatagatagatagatagatagatgtaatctggctaagaatactgttg

SEQ ID NO: 23703 - DNA, 246 bp, Homo sapiens
  AC009891.2_134074
  Located on chromosome 18
  Distance between a terminus base of telomere on chromosomal short arm and 5'-terminus of this base sequence : 68304479
  Distance between 3'-terminus of neighbour sequence of sequence listing upward to telomere on chrosomal short arm and 5'-terminus of this base sequence : -186
agttgaagagttgtagataatggtaatttttcaaactcttgtcataaaatgttttggttcatccaaacatggtaaaaccttcccattagttctatagatagatagctagctagatagatgatagatagatagatagatagatagatagatagatagatagatgtaatctggctaagaatactgttgtgtggtataaaatagtgggcaacgttctctgcagttataagtttgatgcaaatgtaattg

SEQ ID NO: 23704 - DNA, 265 bp, Homo sapiens
  AC009891.2_25262
  Located on chromosome 18
  Distance between a terminus base of telomere on chromosomal short arm and 5'-terminus of this base sequence : 68413329
  Distance between 3'-terminus of neighbour sequence of sequence listing upward to telomere on chrosomal short arm and 5'-terminus of this base sequence : 108604
tagctgtagttggcaattaaacctgcttcttggattaaaaccccattcaccttctatgaaaactcaaactgctactactactactactactactactactactactactactactactactacttctaataataataataaacttcctgatctatcatgctgtgtctggtaccatcaccagtctctcctaaatgtggatctccctagtatgtgtacaacatgacacaagaccagctttgtttaaatctacctgatacaaatccat

SEQ ID NO: 23705 - DNA, 343 bp, Homo sapiens
  AC009891.2_977
  Located on chromosome 18
  Distance between a terminus base of telomere on chromosomal short arm and 5'-terminus of this base sequence : 68437625
  Distance between 3'-terminus of neighbour sequence of sequence listing upward to telomere on chrosomal short arm and 5'-terminus of this base sequence : 24031
acgaataactggtagactgcattttgcttaatttatgtcaatcaacctcattgagcactaggaattaaatgcatgtgtgactgtgtgtgtgtgtgtgtgtgtgtgtgtgtgtgcataattacaatattatcatcctaatgtttaatatattttagtgaaatatgataatttgaaaggtaattttaatgaattggtagtaaaaataaaacaatagaactataagaagagtaaaattaaaaatctaaaattaaacagtagaattagagccatctgtactgaatattaaataaatattttgttatttctacaattgtatttactgttatggtacatagctattggc

SEQ ID NO: 23706 - DNA, 222 bp, Homo sapiens
  G12413
  Located on chromosome 18
  Distance between a terminus base of telomere on chromosomal short arm and 5'-terminus of this base sequence : 68546249
  Distance between 3'-terminus of neighbour sequence of sequence listing upward to telomere on chrosomal short arm and 5'-terminus of this base sequence : 108281
tggcacttttggaaatagaattatttaataaattattctagatcaatactaatttaaaaaaaggaaaaaactatctatctatctatctatctatctatctatctatctatctattggttttttctagctggtgagaaacctgcctttcctatcaaatggtgacatcatctcagaaggtcacaacatggctatgatataattatcacttttgtgaacccacct

SEQ ID NO: 23707 - DNA, 436 bp, Homo sapiens
  AC005909.1_31429
  Located on chromosome 18
  Distance between a terminus base of telomere on chromosomal short arm and 5'-terminus of this base sequence : 68597193
  Distance between 3'-terminus of neighbour sequence of sequence listing upward to telomere on chrosomal short arm and 5'-terminus of this base sequence : 50722
aggctttagaatctcagttcagtttatttattattattattattttgagacagtgtctcactctgcttctcaggctggactgcagtagagcaatctctacttactacaacctccacctcctgggctcaagcaattctcccacctcagcctcccaagtagctgggattacagacacaaatcaccaagcctggctaatttttgtattattattattattattattattattatttattattattttggtagtggcagggtttcaccatgttggctaggctggtcttgaagtcctggcctcaagtgatctacccacctcggcctccgaaagtgctgggattaaaggcgtgaaccattgcgccagtcctctcagttcagtttaaataactgagtctagtcttggattttagaggaacacttgatgacaataagtgcaatc

SEQ ID NO: 23708 - DNA, 153 bp, Homo sapiens
  AC005909.1_41548
  Located on chromosome 18
  Distance between a terminus base of telomere on chromosomal short arm and 5'-terminus of this base sequence : 68607486
  Distance between 3'-terminus of neighbour sequence of sequence listing upward to telomere on chrosomal short arm and 5'-terminus of this base sequence : 9857
agaaacctggtcacaaagttaattctctgtgtgtgtgtgtgtgtgtgtgtgtgtgtgtgtgtgtgtgttagggttgtgatggttaattttatatgtcaacttagctgggtcatgttgcccagatatgtggtcaaacattactctggatgtttc

SEQ ID NO: 23709 - DNA, 160 bp, Homo sapiens
  G08015
  Located on chromosome 18
  Distance between a terminus base of telomere on chromosomal short arm and 5'-terminus of this base sequence : 68780189
  Distance between 3'-terminus of neighbour sequence of sequence listing upward to telomere on chrosomal short arm and 5'-terminus of this base sequence : 172550
tacggtaggtaggtagatagattcgatagatagatgatagatatagatagatagatagatagatagatagatagatagatagagatgaaagtaggtttattggcagaattgactcaccttattacaaagattaagtcccatagcaggctatctgcaagct

SEQ ID NO: 23710 - DNA, 413 bp, Homo sapiens
  chr18.fa.O7frz.72335296
  Located on chromosome 18
  Distance between a terminus base of telomere on chromosomal short arm and 5'-terminus of this base sequence : 68981936
  Distance between 3'-terminus of neighbour sequence of sequence listing upward to telomere on chrosomal short arm and 5'-terminus of this base sequence : 201587
ctgcaagatgttatttcttgacaactgttcagcacatcctacagctgaatatctcatcaaaaataatgtttatgtaatgcattctctgctcaccacaaatgtggcttcattatttagctaggtgaccagggtattgtttgttcaatgaagagtaaatgtaaaaacacttttttgaacaccttgctagcagcagtgagcagaagtgtgtgtctgtgtgtgtgtgtgtgtgtgtgtgtgtgtgtgtgtaaggctttaaaaatgagtttttcatgaaggacactgtataggtcattgccagcacttggagcagagtgattacaggcagttgcacatgcctggcacaacctctggcctgcgactatgtttagtgctgatgatgagcaaggtggtaactagaaggatttcatatgtcc

SEQ ID NO: 23711 - DNA, 361 bp, Homo sapiens
  chr18.fa.O7frz.72873380
  Located on chromosome 18
  Distance between a terminus base of telomere on chromosomal short arm and 5'-terminus of this base sequence : 69025299
  Distance between 3'-terminus of neighbour sequence of sequence listing upward to telomere on chrosomal short arm and 5'-terminus of this base sequence : 42950
  misc_feature (1)...(361): n = A,T,G or C
atttatcagatatgaagctcaattactactttgcaacttntttccacagatcttctgttgagagagagagaggaaggaaggaaggaaggaaggaaggaaggaaggaaggaaggaaggaaggaaggagagagaaaaaagagaaataacattaattagtgattaacatttattgttgaactatagggtatgagttatggtgtccagcataaagcattttatggctacttggtgtcagttagtctaaaatccatagagcaagtgacttcaagaagtaattatttagctccaggccagaatgagatgtgacagctgtcacattttaagtgcctctctgatcctgataattcaaaggaacttgcat

SEQ ID NO: 23712 - DNA, 388 bp, Homo sapiens
  chr18.fa.O7frz.73552710
  Located on chromosome 18
  Distance between a terminus base of telomere on chromosomal short arm and 5'-terminus of this base sequence : 69143723
  Distance between 3'-terminus of neighbour sequence of sequence listing upward to telomere on chrosomal short arm and 5'-terminus of this base sequence : 118063
  misc_feature (1)...(388): n = A,T,G or C
ggattatcagaaactatgagtgaacaggtgagaactggaaaaaaaagaagaggatgaggaagaaatncacagagtgtgtgtgtgtgtgtgtgtgtgtngtgcgttggnggcggaggggggggaggagttatatttataattatttatatattttattttaatatattttatttatatatatacacacacacataaaataaggaagacagaactaatcggttttctgttgtctgtctctggatctctctccatctgtgcatttctgaggcctactttctcacatttcccaaaggacatttgagagctccctataccctaaaaaaaacaacaatgaaaacaagaaaacaactttctttaatttgatttagtttaagtggacttctgtcac

SEQ ID NO: 23713 - DNA, 246 bp, Homo sapiens
  AP001402.3_53033
  Located on chromosome 18
  Distance between a terminus base of telomere on chromosomal short arm and 5'-terminus of this base sequence : 69282191
  Distance between 3'-terminus of neighbour sequence of sequence listing upward to telomere on chrosomal short arm and 5'-terminus of this base sequence : 138080
tgataattagtgatgttgagcaccttttcatatacttgatggccatttatatgtcttctttggagaaacatctatttaggtactttgtccattattaaactggtgtgtgtgtgtgtgtgtgtgtgtgtgtgtgtgtgtgtgtgtgtgtgtgtgtttgctattgagttgtagaattccattatataatctggatattaaccccttgtctgactgcctgaactagagttccagatacaattgaggatt

SEQ ID NO: 23714 - DNA, 214 bp, Homo sapiens
  D18S466
  Located on chromosome 18
  Distance between a terminus base of telomere on chromosomal short arm and 5'-terminus of this base sequence : 69290886
  Distance between 3'-terminus of neighbour sequence of sequence listing upward to telomere on chrosomal short arm and 5'-terminus of this base sequence : 8449
aggccaagttatgtgccaccacaggcatgacctgttaatgcagtattgcatagcatattgatggtttggaatgctatatctggtgtgtgtgtgtgtgtgtgtgtgtctgtgtgtctgtgtgtgtgcatgtctatgcgtgtgtgggtaacccaaccaatagagcatcctcagtgctagtgagaactgggtggtggtcaagcctctgctacagtgt

SEQ ID NO: 23715 - DNA, 433 bp, Homo sapiens
  chr18.fa.O7frz.73776361
  Located on chromosome 18
  Distance between a terminus base of telomere on chromosomal short arm and 5'-terminus of this base sequence : 69368264
  Distance between 3'-terminus of neighbour sequence of sequence listing upward to telomere on chrosomal short arm and 5'-terminus of this base sequence : 77164
gttaattggtaggcaagatctcaatgtaccagaatccaattatggcatcttcaaaacactagtgaaataaaagttaatgagacatttaaagacattacaattttatgatactgatttattttgaaaactagcaaggataaatttaagtttaatatgctgaattaaattctctgtcttcactttggaatttcaaccaaaagaaatatcattaaatagtgaatagtaaatatatatatgtagttgtatatgtaaatacatatatatatatatatatatatttgctgtgtttctaattaagagttccttttgttcttttcttttttatattggtgttggaatttggtcagttgtattcttattgccctctgaattatagtaaatgaagggaacaaaacactccaaatcagcaataattgaaacatgactggacata

SEQ ID NO: 23716 - DNA, 436 bp, Homo sapiens
  chr18.fa.O7frz.73944120
  Located on chromosome 18
  Distance between a terminus base of telomere on chromosomal short arm and 5'-terminus of this base sequence : 69532877
  Distance between 3'-terminus of neighbour sequence of sequence listing upward to telomere on chrosomal short arm and 5'-terminus of this base sequence : 164180
cactggcagctgattagatggtgcctacccagactgagggtgggtctgcatcacccagttcactgactcaaatgttaatctcctttggcaacaccctcacagacacacccaggaacaatgctttgcatccttcaatccaatcaagttgacactcaatgttaataatcacataatcatcatatatatatatatatatatatatatatatatagagagagagagagagagagagagagagagagagagagtcattatcataaaataatgaacattattgagaatttgagttagtgatgtggttggctatccagaagccattagtgcttttgacatgagaagttttcctggagtcatgtgaaggagcaatcatggaaagagaaaaaaacactggagatggataagtggataaagaaactgcagaaagctattgtagaag

SEQ ID NO: 23717 - DNA, 219 bp, Homo sapiens
  D18S1131
  Located on chromosome 18
  Distance between a terminus base of telomere on chromosomal short arm and 5'-terminus of this base sequence : 69685748
  Distance between 3'-terminus of neighbour sequence of sequence listing upward to telomere on chrosomal short arm and 5'-terminus of this base sequence : 152435
cagtgccctcagataagttctgcatcatgacctgaatgtgggtcctacagcccagtatcccttgtgtgtgtgtgtgtgtgtgtgtgtgtgtgtgtgtgtgtgtgtgtgtgtgtggtgcgctctctacactgttgattctaagagccatctgatatccttaaataaattgcatccctgactacacaagcagcataaggaactgctatttacaaacaagaa

SEQ ID NO: 23718 - DNA, 449 bp, Homo sapiens
  AC032026.3_108929
  Located on chromosome 18
  Distance between a terminus base of telomere on chromosomal short arm and 5'-terminus of this base sequence : 69824228
  Distance between 3'-terminus of neighbour sequence of sequence listing upward to telomere on chrosomal short arm and 5'-terminus of this base sequence : 138261
gaggtttcagtgtcaattatacattgtttacaagaaacacacattaaataaatggaaagaagtaagttgaaagttaaaagatgaaaatgatatactatgcaagcactaaaagaaagctgatattgttatattaatatcagacaaaataaaacctaagacaagaatttttacaagaggtaaagagggatgttttataataataaaatgcttaattcagatagggtatgttgcaatcttaaatttgtgtgcatttaaaacgtgtgtgtgtgtgtgtgtgtgtgtgtgtgtgtattaagtagagaactaaaaagtaaagtagaaaaatccacaataatagttggacattttaacatagctccttaaacataatgaaacaaaaagacaacataattaacaagtatatagaagatttgaatatcacatttaaaaacttgacctaattggcatat

SEQ ID NO: 23719 - DNA, 451 bp, Homo sapiens
  AC026585.2_47861
  Located on chromosome 18
  Distance between a terminus base of telomere on chromosomal short arm and 5'-terminus of this base sequence : 69874929
  Distance between 3'-terminus of neighbour sequence of sequence listing upward to telomere on chrosomal short arm and 5'-terminus of this base sequence : 50252
aatctgataacggtaacaggacaggatattcaaataatgacacctaattatcaggagcaagctcagaaaaataatggtacctgtagtcatagaaaggaaggtcagtcacaaagaagtagaacatatcccacccaaaacagacatactggttgattgtaaaaaggagttaaatagaaaattatctatagcactgtatatactagtttagcctacatccatacacatgcacacacacacacacacacacacacacacacacacagataaatttttagaaagtaaaacataacttactgagccaagaattgagcatataccatgctgaatacaagaagataaatttcctttttgaccccaaaattattgaaggaaacatctgaatataacaaataaaactataatgagagtaaaaatttgggaacgaaaaatatacatgttgaataaaccttgg

SEQ ID NO: 23720 - DNA, 297 bp, Homo sapiens
  AC026585.2_20338
  Located on chromosome 18
  Distance between a terminus base of telomere on chromosomal short arm and 5'-terminus of this base sequence : 69921171
  Distance between 3'-terminus of neighbour sequence of sequence listing upward to telomere on chrosomal short arm and 5'-terminus of this base sequence : 45791
tcaagctgattcctaattgtatacatggtcattttaagcataatggagctccataatgagctatgatattaaaagctgcatttattccactagcaccaaatatatatacatatatatatatgtatatatatatatatatatgtatatatatatatatatatatgtatatatatatatatatatatatatgtatatatatttgagaagctgttagagacagaacaggagtgttaaaaattgtatcatggacaagacagatctgcaaatacagggtctacaaagtcctaatgtgaagtc

SEQ ID NO: 23721 - DNA, 428 bp, Homo sapiens
  chr18.fa.O7frz.74487012
  Located on chromosome 18
  Distance between a terminus base of telomere on chromosomal short arm and 5'-terminus of this base sequence : 70073907
  Distance between 3'-terminus of neighbour sequence of sequence listing upward to telomere on chrosomal short arm and 5'-terminus of this base sequence : 152439
aatatcatgtagctggttagtgactgaaagaacaagggctcaattgaatattttcttgaattaaattaatcaaaattatcatacagacacaagaatgttcacattaacatacacgacagaagatttatcattattattattattattattattattattattattttataaaatagacacgaggtcttgctatgttgaccgggtcggtctgaaactcctggcctcaagcagtcctcccacctcagcctcccaaggtgctgggattataagcgtgagccacctcatccggccaatacagaagttttaaaccctattcaagtaagacataaaattattcacaaggaatattccactttgattttataaagacttttgaaccttgagctcacttctgccttctggctctgatattgcctggttaactcagt

SEQ ID NO: 23722 - DNA, 149 bp, Homo sapiens
  D18S1092
  Located on chromosome 18
  Distance between a terminus base of telomere on chromosomal short arm and 5'-terminus of this base sequence : 70124740
  Distance between 3'-terminus of neighbour sequence of sequence listing upward to telomere on chrosomal short arm and 5'-terminus of this base sequence : 50405
ctctcaaagtaagagcgatgttgtaactgactgagttgttttgtgaatttttgtttttggagtcagtggagcatgttattagatgtaaatttaaacacacacacacacacacacacacgagaagtaagtgccaagattttctacttcgg

SEQ ID NO: 23723 - DNA, 253 bp, Homo sapiens
  HUMUT6365
  Located on chromosome 18
  Distance between a terminus base of telomere on chromosomal short arm and 5'-terminus of this base sequence : 70299035
  Distance between 3'-terminus of neighbour sequence of sequence listing upward to telomere on chrosomal short arm and 5'-terminus of this base sequence : 174146
gcaaagcagaagtgagcatgtattaaaaagctttagaacagtaaggaaaggaagaaaagaaaagaaggaaagttcaacttggaagagggccaagccggcaacttggcagaaggattgcttgagcccaggagttaagaccagtctgggcaatatagtgagactccatctctgcatgcatacatacatacatacatacatacatacatacatacatacatattgcagggtatgatggcacacgcctgtagtccta

SEQ ID NO: 23724 - DNA, 157 bp, Homo sapiens
  D18S61
  Located on chromosome 18
  Distance between a terminus base of telomere on chromosomal short arm and 5'-terminus of this base sequence : 70305942
  Distance between 3'-terminus of neighbour sequence of sequence listing upward to telomere on chrosomal short arm and 5'-terminus of this base sequence : 6654
atattttgaaactcaggagcatggttatatgtttatataagaggaatttatgctaagatttgaagggtgtgcgtgtgtgtgtgtgtgtgtgtgtgtgtgttgaatgcctgtatttaattcaggaagaagaatgtagtttgggagtgctcttagaaat

SEQ ID NO: 23725 - DNA, 337 bp, Homo sapiens
  chr18.fa.O7frz.74710138
  Located on chromosome 18
  Distance between a terminus base of telomere on chromosomal short arm and 5'-terminus of this base sequence : 70408907
  Distance between 3'-terminus of neighbour sequence of sequence listing upward to telomere on chrosomal short arm and 5'-terminus of this base sequence : 102808
accaaagatattgaacaggaagatgacatgccaacccagccttcagaagaagacccagggaaactggatgggttagagaaagaggctacagctgagagcaggctggagacgttaccaaaaccagggagcagtgatgacagctgctaaagagccagaggtcaaggatgaagagacaagatggagagacactggaaatcctattaacaaggggtgtgtgtgtgtgtgtgtgtgtgtgtgtgtgtggtgcatttggtaacattactgaaggagaggagtgcagatggacatattcacctacccagcaaacatatattaagtatctatgatatgccagaca

SEQ ID NO: 23726 - DNA, 245 bp, Homo sapiens
  Z67555
  Located on chromosome 18
  Distance between a terminus base of telomere on chromosomal short arm and 5'-terminus of this base sequence : 70583887
  Distance between 3'-terminus of neighbour sequence of sequence listing upward to telomere on chrosomal short arm and 5'-terminus of this base sequence : 174643
gagcagggttgggtcggagttaagactcctaaggaaatagttgtgtgcacagatatgtcttttattccctcctgaaatcccattaaaatgacaaaaatgggattgcacacacacacacacacacacaagcctgaaaacgagaaagcagatggatgagaggcaagtgtattaggcttgggaaacttgaattctaagtggtgagtggggaaagctgaaaactaccccaatctatccactgaagtgcc

SEQ ID NO: 23727 - DNA, 397 bp, Homo sapiens
  chr18.fa.O7frz.75351474
  Located on chromosome 18
  Distance between a terminus base of telomere on chromosomal short arm and 5'-terminus of this base sequence : 70930206
  Distance between 3'-terminus of neighbour sequence of sequence listing upward to telomere on chrosomal short arm and 5'-terminus of this base sequence : 346074
gcctagaagcaataggctataccataaagcctaggtaagctatacaatcacagtttgtgtaaatccactctatgtttgctcagtgacaaaatcacctaacgacatatttctcagaacatacctgttgttcagctgcatctattgaattttcagatgtttaatcatttcataaggataattttgtcctctcctttccaatatttatatttatttcttgtctaattcattggctaatatgttgggaataattctaattaataatacaattgatgtcctcgttgctggctttcagcatttcttcattacagctctgattttgtgtgtatatatatatatatatatatgtctattcctattttacaatgggtttggggtgtcaggaattgatgtttagtat

SEQ ID NO: 23728 - DNA, 207 bp, Homo sapiens
  D18S826
  Located on chromosome 18
  Distance between a terminus base of telomere on chromosomal short arm and 5'-terminus of this base sequence : 71040718
  Distance between 3'-terminus of neighbour sequence of sequence listing upward to telomere on chrosomal short arm and 5'-terminus of this base sequence : 110115
atgggaatcatgtaggtctcttctaaaatgtgtgtgtgtgtgtgtgtgtgtgtgaatacatgctttaaatcaaagagaaggtgcatctttcactctctcctctctcatttaacattctgcaactttattaagactccactcattcataatttgttcagatggaatttacatttagagtttacttgggcttaccaagatgattttctg

SEQ ID NO: 23729 - DNA, 251 bp, Homo sapiens
  AC079894.4_167720
  Located on chromosome 18
  Distance between a terminus base of telomere on chromosomal short arm and 5'-terminus of this base sequence : 71149235
  Distance between 3'-terminus of neighbour sequence of sequence listing upward to telomere on chrosomal short arm and 5'-terminus of this base sequence : 108310
cttaaattgttgagtttagctcatttatagttgttgatatgatagatatacttggtcttagttctcttatgttacattcatatattttctggttttatacatgttaaaaagcattttacaatgagatctctgtttccttctgttttcgatgtgtgtgtgtgtgtgtgtgtatgtgtgcgcacacatgtgtgaattgtatagcagttctgataagatttgtatttctctggtttcattctagaggccattac

SEQ ID NO: 23730 - DNA, 393 bp, Homo sapiens
  HUMUT2305
  Located on chromosome 18
  Distance between a terminus base of telomere on chromosomal short arm and 5'-terminus of this base sequence : 71215797
  Distance between 3'-terminus of neighbour sequence of sequence listing upward to telomere on chrosomal short arm and 5'-terminus of this base sequence : 66311
tgtcatggagcttttcacctatactttcttctaggagttttacagtttcaagtcttacattaaagtatttaattcattttatatttttacatatggtatgaattaaggaccaaatttccttccttccttccttccttccttccttccttccttccttccttccttccttccttccttccttccttccttcctctctccctctctgtctctctttctctctctctctctctctctctcttcctctctttctctctttcttgcctgtggatatccaacttccccagcactatttattgaatagactatccttttttcattatttatggtgcctttgtcaaagattggtttatcaaatatgcttgggcttacttatgggctgtccattctgctctg

SEQ ID NO: 23731 - DNA, 457 bp, Homo sapiens
  chr18.fa.O7frz.75887441
  Located on chromosome 18
  Distance between a terminus base of telomere on chromosomal short arm and 5'-terminus of this base sequence : 71401702
  Distance between 3'-terminus of neighbour sequence of sequence listing upward to telomere on chrosomal short arm and 5'-terminus of this base sequence : 185512
cgttaacagacattactggttattctcatgtttatgcttgtctccctagtcatttgctctgttttctccaggggtttaaatgctgctatgcagccactcactcgacaaatgattgaaatatatataactacaaagaaaaccatcacaagacgctttgatggcagtcatcaacagccaggctgaggctgttcttggagtggtgtagatcaggagttctgaaaacaacaacaacaacaacaacaacaataacaacaacaacaacaacgtatggtcaactgatgagactcagaatctctgtgggccaagaagtgagactgtgagtgtccttgaatacctaaatgttttctgctttgacactggtgtgactttagccccacgaccattccttctctcttttcttggcaatcctcccgtgaacttagtgctcacccatgttgataaatctaaattgctcaac

SEQ ID NO: 23732 - DNA, 464 bp, Homo sapiens
  AC074346.2_13172
  Located on chromosome 18
  Distance between a terminus base of telomere on chromosomal short arm and 5'-terminus of this base sequence : 71485359
  Distance between 3'-terminus of neighbour sequence of sequence listing upward to telomere on chrosomal short arm and 5'-terminus of this base sequence : 83200
tgtttcaaagtcatcctagagtaggagaaaagaatgcaggaagtcatcttattaaaaaggtactgcctttctaggctgaggggaaacagtaggaaagctgtcatcatgtaaatagttgttttctttccacactatactaaggaaattcatgtatgattatgaacacggggaaagagaaggtaatcggtaataataaacagaatgactgtgtaacacatcctctacacaacagcacctctgagagtgaaagggggcctatattagcgattatcctggtaaggtgattattgccttagcaaaaggaactgtttctgggcaatctagatggatggctaatcaaccaaattactcacatacatacacacacacacacacacacacacacacacaccccatatgcttaacgttttatctttcctgtttcattgggaaaaaatgatgaagatgacaaattggtaccatta

SEQ ID NO: 23733 - DNA, 418 bp, Homo sapiens
  chr18.fa.O7frz.76089090
  Located on chromosome 18
  Distance between a terminus base of telomere on chromosomal short arm and 5'-terminus of this base sequence : 71561596
  Distance between 3'-terminus of neighbour sequence of sequence listing upward to telomere on chrosomal short arm and 5'-terminus of this base sequence : 75773
catcctactctggttaaatagctatttaaaaaagacaaaaaataagtgctagcaaagatgcagagaaaggaggaaagtgtacactgttggtgggaatataaagtagtacagccgctgtggaaaattgtatggaagtttctcaaaaaactgaaaatagaactatcatatgatccagcaattccactgctgcatgtatatatatacatatgtacacacacacatagtgtatatatatatacacacacacatatatataaacacacatatagtatatatatatatatatatatatacacacacacacatatagggggcacacacacatatagtatatatataaggccattttcatgctgttgataaagacatacatgagactgggaagaaacagagatttaatggagttacacttccacat

SEQ ID NO: 23734 - DNA, 463 bp, Homo sapiens
  chr18.fa.O7frz.75964018
  Located on chromosome 18
  Distance between a terminus base of telomere on chromosomal short arm and 5'-terminus of this base sequence : 71629621
  Distance between 3'-terminus of neighbour sequence of sequence listing upward to telomere on chrosomal short arm and 5'-terminus of this base sequence : 67607
agaccagagctgttcctattaggccatcttctccacatgtcttttaaagcctgaaatgaagacgcttaggtatagaggaaagtaggcaagatcttcctttgcgtgcatacatgtgtgctttgtattaattaaaggttcagcatttcctctttttggattatgaaaggaaaaactgatggacaaaatgaactcagtgaaatcagaaatattctgaagacagtttttattttttcaaaataataatagtcatgtttagtttaaatatagtagccaaaatgtttttgtactacaaattcattatcagtttttcagagctatccaataattttgtgtgtgtgtgtgtgtgtgtgtgtgtgtgtgtgtgtgtgtgtgtgtatgtaccaaactaccctatatgattttggaatagtttagagatgttttgctaccactcaccaagagtagtcctggaatctattgatga

SEQ ID NO: 23735 - DNA, 284 bp, Homo sapiens
  D18S1125
  Located on chromosome 18
  Distance between a terminus base of telomere on chromosomal short arm and 5'-terminus of this base sequence : 71717769
  Distance between 3'-terminus of neighbour sequence of sequence listing upward to telomere on chrosomal short arm and 5'-terminus of this base sequence : 87685
tacaggtctcttggaacttttaagccacacgtttttgaaacatgtacgcttgtgtgtgtgtgtgtacagagagagacagtgtatatatacacacacactctctgtctctgtgtgtgtgtgtgtgtgtgtgtgtgtgtgtgtgtgtgtgtgtgtatgtatgtatatgtataacttgtctctaaaaataggtgcctaagcttattaaggggttatggacttttgatatatctacaactgttattttaattgtcacatgtcaagtgattcaagtgatgctgctttac

SEQ ID NO: 23736 - DNA, 357 bp, Homo sapiens
  chr18.fa.O7frz.76512051
  Located on chromosome 18
  Distance between a terminus base of telomere on chromosomal short arm and 5'-terminus of this base sequence : 72080638
  Distance between 3'-terminus of neighbour sequence of sequence listing upward to telomere on chrosomal short arm and 5'-terminus of this base sequence : 362585
taattccatctaggttgctctaaatgccatggtttaattcccttttatggctgagtagtattccatggtgtgtgtgtgtgtgtgtgtgtatatatatacatatatacatatgtgtgtgtgtatatatatatacacatatatacatatatgtgtgtgtgtgtgtgtgtatatatatatcctaaaaattagtattaaaaacctcccaaaacaaaaaaaaattaattaatgggcttaagactcaaagaggtgctttaaaaatgtatgctcaaatgatgataaacatgtagaagagtgcttagcttcattaatattaaggtaattaaaattaaaattaaatctggtacctttcaaagaact

SEQ ID NO: 23737 - DNA, 200 bp, Homo sapiens
  chr18.fa.O7frz.76640956
  Located on chromosome 18
  Distance between a terminus base of telomere on chromosomal short arm and 5'-terminus of this base sequence : 72209539
  Distance between 3'-terminus of neighbour sequence of sequence listing upward to telomere on chrosomal short arm and 5'-terminus of this base sequence : 128544
tgcactataggattaagctcagtaaatgtgcctagtattcaacacttagcttaggctttgcacatcataaatgagctgagagagagagagagggagagagagggagagggagagagagagagagagagagagaactaaatcctttagaacaagggcttgagaaaacacaaaatggtgttataggttgcataatgcattac

SEQ ID NO: 23738 - DNA, 98 bp, Homo sapiens
  D18S848
  Located on chromosome 18
  Distance between a terminus base of telomere on chromosomal short arm and 5'-terminus of this base sequence : 72256802
  Distance between 3'-terminus of neighbour sequence of sequence listing upward to telomere on chrosomal short arm and 5'-terminus of this base sequence : 47063
ttggtacatatgatacattggatggatagatagatagatagatagatagatagatagatagatagataattagctatcccagtttgttcgcaaaattc

SEQ ID NO: 23739 - DNA, 237 bp, Homo sapiens
  D18S488
  Located on chromosome 18
  Distance between a terminus base of telomere on chromosomal short arm and 5'-terminus of this base sequence : 72390376
  Distance between 3'-terminus of neighbour sequence of sequence listing upward to telomere on chrosomal short arm and 5'-terminus of this base sequence : 133476
atcatgtgagccaattccttataagaactctctctctctctctctgtctctctctgtgtgtgtgtgtgtgtgtgtgtgtgtgtgtgtggtgtgtgtgtgctgtttctctggagaaccctaatacatatgtgatttttacaatattattttttatttgaatgaactactatttcctccctctaaactggatatcatttttatgacatattaagttcccacttggatctgtcttcagaa

SEQ ID NO: 23740 - DNA, 244 bp, Homo sapiens
  D18S1091
  Located on chromosome 18
  Distance between a terminus base of telomere on chromosomal short arm and 5'-terminus of this base sequence : 72442662
  Distance between 3'-terminus of neighbour sequence of sequence listing upward to telomere on chrosomal short arm and 5'-terminus of this base sequence : 52049
cagtctttctaacaaatgatgccagaacatgtaggcgcacacacacacacacacacacacacacacaaaaggttctagacaccgacattagtatttacacaaaaattaactcaaagtagatcacagacatgaatatgagaagcctaactatataatttatagaaaataatctagggaaaaatgtttacagatttgagattggtattcttagttggcattctgggaatgggccttacactatgtt

SEQ ID NO: 23741 - DNA, 409 bp, Homo sapiens
  chr18.fa.O7frz.77421397
  Located on chromosome 18
  Distance between a terminus base of telomere on chromosomal short arm and 5'-terminus of this base sequence : 72694590
  Distance between 3'-terminus of neighbour sequence of sequence listing upward to telomere on chrosomal short arm and 5'-terminus of this base sequence : 251684
cttgaaatatttggtagaactcatcagtgaagttataaaacccagagattttctttgtattttatttggagatgtaaaatctaatactatacttcatttaaagaaataaataaaatgttaacatttttaggtaggcatacattatatctcccttggggcaatcaagactgtgtcctttgcagaagaagtgtgtgtgtgtgtgcgcgtgcgtgtgtgtgtgtgtgtgtgtgtgtgcgcgcgcgcgtgcaccaggagatcttggaatactgatgtaatctccttattaactgtagggccattcagattttctgtttccatgattcaatctcggtaagttatatgtttctaggaattcattcttttcatctagatcacccacttgttggtgtgcaattgttcacagtattct

SEQ ID NO: 23742 - DNA, 178 bp, Homo sapiens
  D18S485
  Located on chromosome 18
  Distance between a terminus base of telomere on chromosomal short arm and 5'-terminus of this base sequence : 72780837
  Distance between 3'-terminus of neighbour sequence of sequence listing upward to telomere on chrosomal short arm and 5'-terminus of this base sequence : 85838
ccacatgaggatatggtgagaagaaaaggaactagtttttttttaatttaatgtttattgttatcaggctgagatatacaaagtccattattactccagacacatacatacagacacacacacacacacacacacacacacacacacgcacttacctttaatacttcataataggggc

SEQ ID NO: 23743 - DNA, 176 bp, Homo sapiens
  D18S1106
  Located on chromosome 18
  Distance between a terminus base of telomere on chromosomal short arm and 5'-terminus of this base sequence : 72804787
  Distance between 3'-terminus of neighbour sequence of sequence listing upward to telomere on chrosomal short arm and 5'-terminus of this base sequence : 23772
atattgacatgcccaaaaaggaagaggaagaagatagcaatatccttgtgctgtgcttaagtgaagaagcctaaaagtgggtcacaggagcaaagaataaaagaaatgaaacacacacacacacacacacacacacacacacacactcacactcatgcaaaccactgggttagtct

SEQ ID NO: 23744 - DNA, 330 bp, Homo sapiens
  chr18.fa.O7frz.77626160
  Located on chromosome 18
  Distance between a terminus base of telomere on chromosomal short arm and 5'-terminus of this base sequence : 72891488
  Distance between 3'-terminus of neighbour sequence of sequence listing upward to telomere on chrosomal short arm and 5'-terminus of this base sequence : 86525
tctggtcgattagacatctataatattcaatacaactatacaatttttaaaaaattattcttagatctcaatgccctatctgatgtaaatctctatgtatttatgttccagcctatgttttcatggaagttcctgtatcacacacacacacacacacacacacacacacatatataatatatatacacacatacaggcaatgtgtgtgtgtgcatgtgtgtgtgtgtatatacacaaacacatatatactatatataacatatattatgtatatatcctgtattatataaatatgtaatacagtaagtttgtcatctaatgagttcttgc

SEQ ID NO: 23745 - DNA, 411 bp, Homo sapiens
  chr18.fa.O7frz.77291190
  Located on chromosome 18
  Distance between a terminus base of telomere on chromosomal short arm and 5'-terminus of this base sequence : 72965884
  Distance between 3'-terminus of neighbour sequence of sequence listing upward to telomere on chrosomal short arm and 5'-terminus of this base sequence : 74066
tgcagttctagaccttcaaacccaacatttcttcttaccctttctccttcacagggtccagaacagcatagcggtctgaaaacatttcccaatgtctccagttccttcatctttttattttccctcccagatgttcaccacaaatacgtgtgtgtgtgtgtgtgtgtgtgtgtgtgtgtgtatacatgtgtgtgctctctctcccttcctttctctttttctgagccacgagtcatgtaaataaaccagaaaaataccaaaccccaaattatcgagaaataatattaataaaacagttttttttcttcttactacatgcaaacatttttggtgtgtattgagtctatacacggtttctcctttcggaagttccattaagcacatatttagaatcttccttattgttcgtac

SEQ ID NO: 23746 - DNA, 287 bp, Homo sapiens
  D18S541
  Located on chromosome 18
  Distance between a terminus base of telomere on chromosomal short arm and 5'-terminus of this base sequence : 73149206
  Distance between 3'-terminus of neighbour sequence of sequence listing upward to telomere on chrosomal short arm and 5'-terminus of this base sequence : 182911
ctcccaaatatggaatggaattagatatggaaaaaaaaaaatatatatatatatatattagatagataggcaggaaggcagacagacagacagacagacagatagatgatagatagatagatagatagatagatagatagatagatagatagatgatagatagataggcagacagacagatagatagatagatatggaagtacacacacacacatatatatatatatttgagatggagttttgctcttgttgcccaggctggagtgcattgatatgatctcagctca

SEQ ID NO: 23747 - DNA, 242 bp, Homo sapiens
  HUMUT5025
  Located on chromosome 18
  Distance between a terminus base of telomere on chromosomal short arm and 5'-terminus of this base sequence : 73195569
  Distance between 3'-terminus of neighbour sequence of sequence listing upward to telomere on chrosomal short arm and 5'-terminus of this base sequence : 46076
aggggctttgtccaacatgtcaatgagggaaggagcgataaacttctttttgtgggcataaacagaaaataagaaatatagctcaggaaaaatagtaaatatcccaacagacaaaggttactacatagactaacaatttgtgatagatagatagatagatagatagatagatagatagatagatatgaaaacagattatacgtgtacatatatattacaaatgtgtgcatatttttggttag

SEQ ID NO: 23748 - DNA, 312 bp, Homo sapiens
  chr18.fa.O7frz.77734934
  Located on chromosome 18
  Distance between a terminus base of telomere on chromosomal short arm and 5'-terminus of this base sequence : 73249867
  Distance between 3'-terminus of neighbour sequence of sequence listing upward to telomere on chrosomal short arm and 5'-terminus of this base sequence : 54056
cttaagtgtatcaccaaactgaagcgctagccaaaataacatttataggagctatgtagatacctctctctctctctctttctctctttctctctctctctctcttttcctctaaatttaaaagactgagtggaggattgggtcccttctttccttttcaattcagattttgaattccatttttgtagtctacacccctaatcagcgatccattcccctcatcacactgtcacttttattgagagcatgaaacacattacaaactttttttctagccacatccagcagtagtctaatcagtacctttctggc

SEQ ID NO: 23749 - DNA, 455 bp, Homo sapiens
  chr18.fa.O7frz.78207384
  Located on chromosome 18
  Distance between a terminus base of telomere on chromosomal short arm and 5'-terminus of this base sequence : 73433285
  Distance between 3'-terminus of neighbour sequence of sequence listing upward to telomere on chrosomal short arm and 5'-terminus of this base sequence : 183106
ttgttaccgagcaatagaatattaatgcaataaaccaagtgtagtaactgtaattgattacagagataagcatcaagggttctgaagattgagcctgcttttatctccaaaaagtaagaataaaatttgataaacgaagtaaaaattttaaataggtaggtaaataccaaaaaaattgtacagttcaagttttaaaatggcatttttatactctcatattttcaacagctactcaggtggactttaaatattttggtacttgtttatatatgccagaaaattattttttattgttatatcaggaattgtgctgtgcacatgtgtgtgtgtgtgtgtgtgtgtgtgtgtgtgtgtgtgtgcttgtgtgttaatattttataaagcattaagatgttctggttccttctccaaaaataaagggaacattgataccgtccaaacggaatattctacat

SEQ ID NO: 23750 - DNA, 367 bp, Homo sapiens
  DISO7_00018394
  Located on chromosome 18
  Distance between a terminus base of telomere on chromosomal short arm and 5'-terminus of this base sequence : 73508068
  Distance between 3'-terminus of neighbour sequence of sequence listing upward to telomere on chrosomal short arm and 5'-terminus of this base sequence : 74328
cagttggcctttagcactttgcctttgtgtgtgtgtgtgtgtgtgtgtgtgtgtgtgtgcgtgctggtaataagatgactcctctaacagacacttccagtctcactggcataacacactcagtcttgtgcaggtctaagggaaggtactccactcaaaacagtcattcatgatccaagttctttccatcttgtgcgttctccatcttttaggatctagagatcttttctggattttttgcttccagcttggagggcctagtggaaggcagacatcacttctacttgcaccccattggatgccctcaatcacgtggtcccatctccttggcaggtgtcacttctactcccactccattggctgtctg

SEQ ID NO: 23751 - DNA, 155 bp, Homo sapiens
  DISD22_0011322
  Located on chromosome 18
  Distance between a terminus base of telomere on chromosomal short arm and 5'-terminus of this base sequence : 73717956
  Distance between 3'-terminus of neighbour sequence of sequence listing upward to telomere on chrosomal short arm and 5'-terminus of this base sequence : 209521
ttacaatctttggcttgcagtgttttaggtagatggaatatgttgtgtatagagtgtgttttgtgtgtgtgtgtgtgtgtgacagagaggagagagagggaaaacgaaatgcaaactatttcataattatatttctgtcttgagcaagtgaaatg

SEQ ID NO: 23752 - DNA, 193 bp, Homo sapiens
  G10153
  Located on chromosome 18
  Distance between a terminus base of telomere on chromosomal short arm and 5'-terminus of this base sequence : 73790275
  Distance between 3'-terminus of neighbour sequence of sequence listing upward to telomere on chrosomal short arm and 5'-terminus of this base sequence : 72164
cttcagttttcccaatagatcgatctatcatccatctatctatctatctatctatctatctatctatctatctattatctatctatcatctatctagcatagttttaatttcagtgtgcatgtgtttattactagtttgtataaatataattgattttgtatacacatcttgtatcatgcaaacttaccaaat

SEQ ID NO: 23753 - DNA, 222 bp, Homo sapiens
  AC009455.8_141745
  Located on chromosome 18
  Distance between a terminus base of telomere on chromosomal short arm and 5'-terminus of this base sequence : 73827974
  Distance between 3'-terminus of neighbour sequence of sequence listing upward to telomere on chrosomal short arm and 5'-terminus of this base sequence : 37506
aacatgccagtgagtctttaaccacacacacacacacacacacacacacacacacacacacacacacgcacgcaatcacacaaaacacttgaattttagaggaaaggaaacaaaagtggtcaataaacatacaaaaacttgcactgcttcattattaatcagggaaatgcaaattaaaaccacatgaggcaatagttcatgctcacagattgacaattacta

SEQ ID NO: 23754 - DNA, 316 bp, Homo sapiens
  chr18.fa.O7frz.78687418
  Located on chromosome 18
  Distance between a terminus base of telomere on chromosomal short arm and 5'-terminus of this base sequence : 73932763
  Distance between 3'-terminus of neighbour sequence of sequence listing upward to telomere on chrosomal short arm and 5'-terminus of this base sequence : 104567
tgataacagaatcttgtaaggaagattgctgtataaattgctatggcaaactctgctataaactaagttgaaaattaggggtgtaagagtgtgtgtgtgtgtgtgtgtgtgtgtgtgtgtcagggtggagggggacatttaaagaaaaccagaaataatgtatttgtagcatattaaaatgtgaagaagtctcaaacattatctcatctaacccttatctctcaaattctatttaatagccctctgtttccacaaggtgaattcgtttgtcaaaggtctagaatctagttcttcgtgacatttgagaaccatctaa

SEQ ID NO: 23755 - DNA, 381 bp, Homo sapiens
  chr18.fa.O7frz.78815531
  Located on chromosome 18
  Distance between a terminus base of telomere on chromosomal short arm and 5'-terminus of this base sequence : 74029378
  Distance between 3'-terminus of neighbour sequence of sequence listing upward to telomere on chrosomal short arm and 5'-terminus of this base sequence : 96299
accgaatagtctccttaatgacatctaattaggacatctgttaagggtacatgatcttacattcttcatttggttttccccattaaattagctctactattttttcactcttttattagaagcttactaatggggctacatatgtgtgtgtgtgtgtgtgtgtgtgtgtatgctctaagaaacttttataatactagaatatgcttcctgattaggttgaacagtcattctttttcatgttaataattggattgaccttattaagaatttagaatctcctgttcccctttctcagaaaaatctctaaattggaggacctccacagaagttccatcattagctagatatatcagctgacagtgattcagtgatcaaagtgat

SEQ ID NO: 23756 - DNA, 199 bp, Homo sapiens
  D18S850
  Located on chromosome 18
  Distance between a terminus base of telomere on chromosomal short arm and 5'-terminus of this base sequence : 74252126
  Distance between 3'-terminus of neighbour sequence of sequence listing upward to telomere on chrosomal short arm and 5'-terminus of this base sequence : 222367
acaactgcaaaaatccacattttattctaaacattctctagtgctttatagatgaggaatccctaaacaaagatgatagatagatagatagatagatagatagatagatagatagacagacagatagatatagatagatagagatggatagatagatagatgatagatagatagatggaaatttgctatcaaggataca

SEQ ID NO: 23757 - DNA, 236 bp, Homo sapiens
  D18S469
  Located on chromosome 18
  Distance between a terminus base of telomere on chromosomal short arm and 5'-terminus of this base sequence : 74332897
  Distance between 3'-terminus of neighbour sequence of sequence listing upward to telomere on chrosomal short arm and 5'-terminus of this base sequence : 80572
attcaaacacgcttgtcaaatgctttgaacattcaaacaaatacacacacacacacacacacactcctactacaatcaccacaagaaacaacaacaataacttaaaatttaaccatgattcatgcttataatgtgtagtcaacatcccttagttcagattcaaaacttggaaatttaggtgtcagaaatttagagtaacaagtaacaaccttctaaaaaatgactgggatgcactt

SEQ ID NO: 23758 - DNA, 175 bp, Homo sapiens
  D18S874
  Located on chromosome 18
  Distance between a terminus base of telomere on chromosomal short arm and 5'-terminus of this base sequence : 74537303
  Distance between 3'-terminus of neighbour sequence of sequence listing upward to telomere on chrosomal short arm and 5'-terminus of this base sequence : 204170
gccccatttcttggagataacagttaccacttttgtgtgtttttccaagtttttctatgctgctcaagcacacacacatacacaaacacatatctatctatctatctatctatctatctatctatatatagatataattgataaatcctttttatgcaaatgacaccacatcgta

SEQ ID NO: 23759 - DNA, 228 bp, Homo sapiens
  D18S879
  Located on chromosome 18
  Distance between a terminus base of telomere on chromosomal short arm and 5'-terminus of this base sequence : 74670633
  Distance between 3'-terminus of neighbour sequence of sequence listing upward to telomere on chrosomal short arm and 5'-terminus of this base sequence : 133155
ggtgctggattacaattggaggcatctatgtggattgaggtaggtaggtaaattttagatagatagatagatagatagatagatagatagatatatagatagaatgagtggagagctagttctgggaatgagtacagtataaatgtgtatgtggtgtgtgtgtgtgtgtgtgtgtgtgtgtgtgtgtttgtgtgttgtgtttacatgcacgtataccctacctctgac

SEQ ID NO: 23760 - DNA, 106 bp, Homo sapiens
  D18S486
  Located on chromosome 18
  Distance between a terminus base of telomere on chromosomal short arm and 5'-terminus of this base sequence : 74967700
  Distance between 3'-terminus of neighbour sequence of sequence listing upward to telomere on chrosomal short arm and 5'-terminus of this base sequence : 296839
catatccatcacctcatgtacttatcgtgtgtgtgtgtgtgtgtgtgtgtctgtgtgtgcggtgagatcacttaagatgtattttcccagcaatcttcaactacac

SEQ ID NO: 23761 - DNA, 149 bp, Homo sapiens
  D18S58
  Located on chromosome 18
  Distance between a terminus base of telomere on chromosomal short arm and 5'-terminus of this base sequence : 75073330
  Distance between 3'-terminus of neighbour sequence of sequence listing upward to telomere on chrosomal short arm and 5'-terminus of this base sequence : 105524
gcaggaaatcgcaggaactttaaatttacaacgtttaaatattatctcttcattaaggacgtgtgtgtgtgtgtgtgtgtgtgtgtgtgtgtgtgtgcgcgcgcgcgcatatatgtaccatttatatataaataaaaccagccgggagc

SEQ ID NO: 23762 - DNA, 210 bp, Homo sapiens
  chr18.fa.O7frz.79975441
  Located on chromosome 18
  Distance between a terminus base of telomere on chromosomal short arm and 5'-terminus of this base sequence : 75157367
  Distance between 3'-terminus of neighbour sequence of sequence listing upward to telomere on chrosomal short arm and 5'-terminus of this base sequence : 83888
ggttacatattcttgaacctcatgcctcctctcttttctttttttctttttcttttccttccttccttctttccttccttccttccttccttccttccttcctttcttccttcctttctttctttctctttctcttttttttttttgagacagggtctcgctctgttgcccaggctggagtacagtgctgtgattatagctcactgtggc

SEQ ID NO: 23763 - DNA, 326 bp, Homo sapiens
  DISO7_00018421
  Located on chromosome 18
  Distance between a terminus base of telomere on chromosomal short arm and 5'-terminus of this base sequence : 75247423
  Distance between 3'-terminus of neighbour sequence of sequence listing upward to telomere on chrosomal short arm and 5'-terminus of this base sequence : 89846
gataactagttcaaggtcaagcacaactgtaacacacacacacacacacacacacacacacacaaacaaaaacagaggcatggaggaacaggagaaaaatggatggagtctcagatcccactcagatggtgaaggcgggattcatgtccaaagtcaatgtccatgaacctggacagcaaattgactatagcaggctgccctgctctgtggggaaaagggagggagaggaggaaattcattaagggagggaagatgaagtcgtgcacttccccttgtcagacccctgctgtcagggccactgtcaggtcagggcatcaggtcagtct

SEQ ID NO: 23764 - DNA, 337 bp, Homo sapiens
  chr18.fa.O7frz.80344221
  Located on chromosome 18
  Distance between a terminus base of telomere on chromosomal short arm and 5'-terminus of this base sequence : 75381568
  Distance between 3'-terminus of neighbour sequence of sequence listing upward to telomere on chrosomal short arm and 5'-terminus of this base sequence : 133819
tgcttatgaactgtttattcctagttggtttaagaaatcttaaatagaaagttactaatgcagtaaaactctttgtgtgtgtgtgtgtgtgtgtgtgtgtgtgtgtgtggcattacctagtttttgtgcattagaagggatctctatgtagatgattataatgtcactttctgacctttgcagcttgaataattgtaaatcattgcttcataacgtgtcagagaatgtctgtactaggcaattaaatggcagaatataatagaccaaattattgcctgtcatgttttcaacaacacagttagtatttgagttacacttaatcattacgtgcattagc

SEQ ID NO: 23765 - DNA, 223 bp, Homo sapiens
  chr18.fa.O7frz.80619261
  Located on chromosome 18
  Distance between a terminus base of telomere on chromosomal short arm and 5'-terminus of this base sequence : 75654640
  Distance between 3'-terminus of neighbour sequence of sequence listing upward to telomere on chrosomal short arm and 5'-terminus of this base sequence : 272735
atggtgaggttgtatgcagcattggttcgaatcgggagtgtgtgtgtgtatgtgtgtgtgtacatgtgtgtgctggtatggtgaagttgtatgcagcattggttcgaatcgggagtgtgtgtgtgtgtgtgtgtgtgcatgtgtgtgctggtatggtgaggttgtatgcagcattggtttgaggaaggagattagcagcatgtgataattagcagtagctgca

SEQ ID NO: 23766 - DNA, 216 bp, Homo sapiens
  D18S1112
  Located on chromosome 18
  Distance between a terminus base of telomere on chromosomal short arm and 5'-terminus of this base sequence : 75868662
  Distance between 3'-terminus of neighbour sequence of sequence listing upward to telomere on chrosomal short arm and 5'-terminus of this base sequence : 213799
tggaaaaatgaactgccaatgaacatgtaaaaatatgagtaacctcattaatgccataacaaacattaatgttttgcgcgcgcacacacacacacacacacacacacacacacacacacacacattgctttgcaggcaggcagagatgaaaagggtgataatatccattgtttgcaaggatatagaaaacggttatgtttgtaggctgttggtggg

SEQ ID NO: 23767 - DNA, 438 bp, Homo sapiens
  chr18.fa.O7frz.80962709
  Located on chromosome 18
  Distance between a terminus base of telomere on chromosomal short arm and 5'-terminus of this base sequence : 76000809
  Distance between 3'-terminus of neighbour sequence of sequence listing upward to telomere on chrosomal short arm and 5'-terminus of this base sequence : 131931
ggcatttcctacgaaagaccagctccagttctttggaaggaaattggccagatgcatgcactgttcagggcttgtcttagtgctaaaatgtagctaacgtgtgtggcaaaggtgaggaagtcctgtgagcttcatagtgggaagcgtctcttctcatctcagggcagtggggatgacgatgggggccttggttctctgttcaacctctgatggggtgtttttggtttctggtgtgtgtgtgtgtgtgtgtgtgtgtgtgtgtgtgtgtgtgtcagagagaaagagagaggtaggtcatatccctgtatcaggtccatcaaaacacaccccagtgcagaactcttgatcccttgattgcctgcaagctcacagcacacagtgataagtgaaatctctgagagtagatttaattttatgagctgtattatccaagaatac

SEQ ID NO: 23768 - DNA, 206 bp, Homo sapiens
  chr18.fa.O7frz.81190069
  Located on chromosome 18
  Distance between a terminus base of telomere on chromosomal short arm and 5'-terminus of this base sequence : 76243985
  Distance between 3'-terminus of neighbour sequence of sequence listing upward to telomere on chrosomal short arm and 5'-terminus of this base sequence : 242738
cagtagacaccaaatctgctagagccttgatcttggactttgcagcctccagaactgagaaataaatgtgtgtgtgtgtgtgtgtgtgtgtgtgtgtgtgtgtatttaatggcatttttgttataggaactaagatggactaagacagagataaaataaaaatcgaaagaaaaaacagtcttaactgactgtacttggaacaaatc

SEQ ID NO: 23769 - DNA, 158 bp, Homo sapiens
  HUMUT576
  Located on chromosome 18
  Distance between a terminus base of telomere on chromosomal short arm and 5'-terminus of this base sequence : 76262259
  Distance between 3'-terminus of neighbour sequence of sequence listing upward to telomere on chrosomal short arm and 5'-terminus of this base sequence : 18068
gcactcattctgggcaacagagtgaaaccctgtctcaaaaatataaataaataaataaataaataaataaataaagaaagaaagaaagaaagaaagaatttacaagaggggagttttagtggttgaaaaatcattcactcattccaggagcaagagcc

SEQ ID NO: 23770 - DNA, 376 bp, Homo sapiens
  chr18.fa.O7frz.81307101
  Located on chromosome 18
  Distance between a terminus base of telomere on chromosomal short arm and 5'-terminus of this base sequence : 76416743
  Distance between 3'-terminus of neighbour sequence of sequence listing upward to telomere on chrosomal short arm and 5'-terminus of this base sequence : 154326
ctgaccagaatgattaggaataagaaggtaggaaggagggactgatctcagtgtgtctgcgggttatacctgggggtactgtgttatcccttgcggtgtgtgtgtgtgtgtgtgtgtgtatttgtggctgagccttccttctttgctgttccttacacgctttccttccttgcgtccctccctggttttacgctatccatgtggatggagattcttgctgctggcctgcgtttctttggagtttgttttcaaggcccttcccgcacacactggtgcctctcctttctatttgccggtgacgtgagcgttggaaacacaccaggcactggtttccatggggaagagctgacttcctctatggatcttcgttagttcg

SEQ ID NO: 23771 - DNA, 256 bp, Homo sapiens
  HUMUT7934
  Located on chromosome 18
  Distance between a terminus base of telomere on chromosomal short arm and 5'-terminus of this base sequence : 76496330
  Distance between 3'-terminus of neighbour sequence of sequence listing upward to telomere on chrosomal short arm and 5'-terminus of this base sequence : 79211
ttcccagttcagtatcttgtctttttgatgaaattacagtatgtctatttttgtcttaaccaattttacctatagagaaggatatatatatgtaaagtgcctcatcatttatattgatgagcaaacattttcaagagttgtatttttagatttctgcttgtcatttttatattatctatctatctatctatctatctatctatctatctatctatctgtctatctatctgtctacctatctatcatctccattgcc

SEQ ID NO: 23772 - DNA, 348 bp, Homo sapiens
  chr18.fa.O7frz.81496608
  Located on chromosome 18
  Distance between a terminus base of telomere on chromosomal short arm and 5'-terminus of this base sequence : 76606256
  Distance between 3'-terminus of neighbour sequence of sequence listing upward to telomere on chrosomal short arm and 5'-terminus of this base sequence : 109670
gagtttaattaccaggcatgtgaggggcggcggtgacaggcaccagctctagcagagaccagttcttttgggacaaccactattaaaaaaaaaaaaggctaaggtgtgtgtgtgtgtgtgtgttagaaggctaaggggcaaaacagagagacctaaagttaagagtgcatcaaccaaagagaaatgaaacattaagaaaccctgcagctgcaataaactctaaaaagttttggtttcaagatgtaaagttttaggaattatagtaataaagcattctttcataaaaggttatctttcatattatgcttgaaacatcactggttgagtgtaacatgaggtttctacact

SEQ ID NO: 23773 - DNA, 358 bp, Homo sapiens
  chr18.fa.O7frz.81830378
  Located on chromosome 18
  Distance between a terminus base of telomere on chromosomal short arm and 5'-terminus of this base sequence : 76919010
  Distance between 3'-terminus of neighbour sequence of sequence listing upward to telomere on chrosomal short arm and 5'-terminus of this base sequence : 312406
tcgctttattacatctacaaagactctatttccaaataaggtcacatgcacaggtacaggggttaggacatcaacttctctcttggaagaacagaattcaactgatacaacactggaggggtgaaaacaagacagagagagagagagagagagagagagagatgaggggcccgcacatgccctgctcatctcaaaacttctcgagaagcaaatctaacttgcaggaactttgagaaaggcaggagaagcaaaaaagcaaaatgagattgttttcataacttaaagaggctgaaaatgatgaaactgggctgagatgtgttacaggagcctacacagctagaaggatagattcgaggtc

SEQ ID NO: 23774 - DNA, 148 bp, Homo sapiens
  D18S1009
  Located on chromosome 18
  Distance between a terminus base of telomere on chromosomal short arm and 5'-terminus of this base sequence : 77284481
  Distance between 3'-terminus of neighbour sequence of sequence listing upward to telomere on chrosomal short arm and 5'-terminus of this base sequence : 365113
ctggtgtgggagacaaataataaactatacctatgtgtgtttgtgtgtgtgtgtgtgtgtgtgtgtgtgtgtgtgtgtgtatgaatgacacatagtggcaagtactagaaagaaaaacagcagacaagtggatagagcatgataaggg

SEQ ID NO: 23775 - DNA, 383 bp, Homo sapiens
  chr18.fa.O7frz.82199842
  Located on chromosome 18
  Distance between a terminus base of telomere on chromosomal short arm and 5'-terminus of this base sequence : 77505224
  Distance between 3'-terminus of neighbour sequence of sequence listing upward to telomere on chrosomal short arm and 5'-terminus of this base sequence : 220595
ctcctgaacctaaaatacaagttaaaagaggccgggcgcagtggctcacacctgtaatcccagcactttgggaggccgaggcaggcggatcacgaggtcaggagatcgagaccatcctggctaacacaatgaaaccccgtctctactaaaaatacaaaaaattagccgggcgtgttggtgggcgcctgtagtcccagctactcgggaggctgaggcaggagaatggtgtgaaccccgggggcggagccttgcagtgagccaagatctcaccattgccctccagcctgggcaacaacgaggctccgtctcaaaaacaaacaaacaaacaaacaaagttaaaagaaaccttctcttagacagtagtgatggcttcatttaaatta

SEQ ID NO: 23776 - DNA, 405 bp, Homo sapiens
  chr18.fa.O7frz.82274578
  Located on chromosome 18
  Distance between a terminus base of telomere on chromosomal short arm and 5'-terminus of this base sequence : 77592816
  Distance between 3'-terminus of neighbour sequence of sequence listing upward to telomere on chrosomal short arm and 5'-terminus of this base sequence : 87209
gactgattagtgaggctgaacatttttttcatatacctgttggccatttgtatgtcttcttttgagaaatgtctattcaggtccctagctcatattaaaatctggttatttgttttccgggagtggaattgtttgagtttattttattttattattattattattattattattattattattattttgagatggagtcttgctctgttgcccaggctggagtgcagtggcgcaatcttggctcactgcaagctctgcctcctgggttcacgccattctcctgcctcagcctcccgagtagctgggactacaggtgcccgccaccatgcccagctaattttttgtatttttagtagagatggggtttcattgtgttagccaggatggtctcgatctcctgacctc

SEQ ID NO: 23777 - DNA, 380 bp, Homo sapiens
  chr18.fa.O7frz.82496147
  Located on chromosome 18
  Distance between a terminus base of telomere on chromosomal short arm and 5'-terminus of this base sequence : 77796260
  Distance between 3'-terminus of neighbour sequence of sequence listing upward to telomere on chrosomal short arm and 5'-terminus of this base sequence : 203039
gatgactgattcagactgtcatctgaacctgtgaaaataagacaaactgtaatcattaatttgtgaaatgatgatttctacagtgttattgatgattattgaatattctttaaattataatttaagaattaattatcctttgtaggtaatatttctcttttcttatgtgacagtgataatttttcctaagtctttggacttttgaaactaaattatatttttcagtacatgtagttaaaaattgtatgactctaaatacatatgcctacacacagagagacacaggtgcgcacacacacacacacacacagggacatacacccactcttattttttctgtaggcgtctttagctcagtctcatttagttactcgtactgc

SEQ ID NO: 23778 - DNA, 205 bp, Homo sapiens
  D18S1097
  Located on chromosome 18
  Distance between a terminus base of telomere on chromosomal short arm and 5'-terminus of this base sequence : 77995917
  Distance between 3'-terminus of neighbour sequence of sequence listing upward to telomere on chrosomal short arm and 5'-terminus of this base sequence : 199277
aagagccctatctggaaaccctccatcccgtgtgtgtgtgtgtgtgtgtgtttgtgtgtgtgtgtatccattcccatccctgggcagacaggaggggatgggtgggtaaggtccccaccaaccaatgtttacggcattgtttctacaattcaatgctgtctggtgtgattaacagataaaaaacacacgggttattggactcaca

SEQ ID NO: 23779 - DNA, 210 bp, Homo sapiens
  DISD22_0011342
  Located on chromosome 18
  Distance between a terminus base of telomere on chromosomal short arm and 5'-terminus of this base sequence : 78120671
  Distance between 3'-terminus of neighbour sequence of sequence listing upward to telomere on chrosomal short arm and 5'-terminus of this base sequence : 124549
tttgcctcaggtctgtattcttttctttcttttctttctttctttctttctttctttctttctttctttctttctttctttccttctttcttttctctttctttctttctttctttctctctctttcttccttccttccttcctttctttccttcctttctttttttaataaatagcaacactgaaaaagctgaagctcattaattcctg

SEQ ID NO: 23780 - DNA, 338 bp, Homo sapiens
  chr18.fa.O7frz.71479107
  Located on chromosome 18
  Distance between a terminus base of telomere on chromosomal short arm and 5'-terminus of this base sequence : 78310464
  Distance between 3'-terminus of neighbour sequence of sequence listing upward to telomere on chrosomal short arm and 5'-terminus of this base sequence : 189583
tattccgattcctaacttagtttcttctttgaccaatacagtgttttgaaatgtgtctcaatttcaaaacacaggaaattttgggttatctttttgctattttctttctttcttttctttctttctttctttctttctttctttctttctttctttctttctttctttcttctttcttcctttctttctttcttcttctttctttctgtctctttctttctttccttctttctttctctctctctctttccttctttccttccctccctccctctccctctccctctttctctctctttctctctttctttcttttcttctttcattctgtcacggag

SEQ ID NO: 23781 - DNA, 394 bp, Homo sapiens
  chr18.fa.O7frz.71551697
  Located on chromosome 18
  Distance between a terminus base of telomere on chromosomal short arm and 5'-terminus of this base sequence : 78351859
  Distance between 3'-terminus of neighbour sequence of sequence listing upward to telomere on chrosomal short arm and 5'-terminus of this base sequence : 41057
tattgactgtcaagagtcctagagtaagatcacacacacacacacacacacacacacacacacacacaaatcaggtaagaaaaagaaaggtttatttcagactgacattatctcaaccttctagaagttaatagatagtgtgtttgccactggcacttaggtactcaatcagaaaaagcgagtcaaaaattagtaatatgaggtgagtgggcagattaattaagatcccttagtttttggaaagatagtttaagtctaagcaatttagagagtaagtacaatctgagggaaattacatttttcagtttagtttcatcaagaaaatacaagagtagagtcaacgattttcaactttattatgcaaggattgtggtcttaacctgttacgtgacaa

SEQ ID NO: 23782 - DNA, 361 bp, Homo sapiens
  U90660.1_398
  Located on chromosome 18
  Distance between a terminus base of telomere on chromosomal short arm and 5'-terminus of this base sequence : 78491759
  Distance between 3'-terminus of neighbour sequence of sequence listing upward to telomere on chrosomal short arm and 5'-terminus of this base sequence : 139506
ggttaacacttaaagcagatgtagtatccatttttgatctcatgaaaatatacataaaattagcttaggatgtattttaaaatgctggattccttttgtgttgtaatcaatgaatttccttccttcttcttctcccttaccgcctcctcctcctcctcctcctcctcctcttcttcttttctagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttat

SEQ ID NO: 23783 - DNA, 143 bp, Homo sapiens
  D18S1115
  Located on chromosome 18
  Distance between a terminus base of telomere on chromosomal short arm and 5'-terminus of this base sequence : 78493800
  Distance between 3'-terminus of neighbour sequence of sequence listing upward to telomere on chrosomal short arm and 5'-terminus of this base sequence : 1680
ggtccaggatgcagtcagtcaagactgcaccactgcacttcagcctggatgacagagtaagactctgtctaaaatatatatatatatgtgtgtgtgtgtgtgtgtgtgtgtgtgtgtgtaatgtacctctgtgccaaatcagc

SEQ ID NO: 23784 - DNA, 214 bp, Homo sapiens
  D18S554
  Located on chromosome 18
  Distance between a terminus base of telomere on chromosomal short arm and 5'-terminus of this base sequence : 78554634
  Distance between 3'-terminus of neighbour sequence of sequence listing upward to telomere on chrosomal short arm and 5'-terminus of this base sequence : 60691
gctgcatttggcttgggggttgtagtttgctgaccctaccctcaatttctgttttcatcttacctacttgattgagagatgtgttaaagtgttttactactattgggcacatttatatttttggtcaaagagagaatgaggcagtgtgtgtgtgtgtgtgtgtgtgtgtgtgtgtgagagagagagagagaatcacgactcatggtcttagtta

SEQ ID NO: 23785 - DNA, 185 bp, Homo sapiens
  D18S462
  Located on chromosome 18
  Distance between a terminus base of telomere on chromosomal short arm and 5'-terminus of this base sequence : 78662880
  Distance between 3'-terminus of neighbour sequence of sequence listing upward to telomere on chrosomal short arm and 5'-terminus of this base sequence : 108032
agagtccatccagaacacactgggcagttcctcacaaagttaaacatatattcaccatgcacacagcaatcctatttctagatattcattcagaagcagatttgaacattggaaaatctgtgttcacacacacacacacacacacacacacacacacacccctaacggtgaatgtttatagcagc

SEQ ID NO: 23786 - DNA, 477 bp, Homo sapiens
  chr18.fa.O7frz.83670935
  Located on chromosome 18
  Distance between a terminus base of telomere on chromosomal short arm and 5'-terminus of this base sequence : 78814592
  Distance between 3'-terminus of neighbour sequence of sequence listing upward to telomere on chrosomal short arm and 5'-terminus of this base sequence : 151527
aattgtgaatcttatccaaagtattgtaaaaaattatatatttaaaataataactggccaggcatcgtggctcatgcttataattccagcacttggaggggtcagtgcaggaggatgacttgaggctaggagttcaagaccagcctgggcaacatagcagaccccatctcaacaaaatagttttttaaaaattagccaagcatggagatgtgtacctgtagtcctaactactcaggaggctgaggtgagaggatctcttaagcctaggtgttcaaggctgcagtgagctgtgattatactactgcactccagcctgggtgacagagcaagactccatctctaaaataaacaaacaaacaaacaaacaaaataactaaagatagtttcatcaaattgctaaaaatacaagaattgtatcttgttctttataaatgttccattatgtctgtaaacacatagagcgactgaagtaactat

SEQ ID NO: 23787 - DNA, 444 bp, Homo sapiens
  chr18.fa.O7frz.83466315
  Located on chromosome 18
  Distance between a terminus base of telomere on chromosomal short arm and 5'-terminus of this base sequence : 78897959
  Distance between 3'-terminus of neighbour sequence of sequence listing upward to telomere on chrosomal short arm and 5'-terminus of this base sequence : 82890
gaggtcaggagatcgagaccacggtgaaaccccgtctctactaaaaatacaaaataagttagccaggcgtggtggcgggtgcctgtagtaccagctactcaggagactgaggcaggagaatggcgtgaacccgggaggcggagcttgcagtgagccgagatcacgccactgcactccagcctgggctacagagcaagactccgtctcaaaaaaaaaataataattaataataataataataataatagcaaaaccctgaataccagcttttggctcagctgctatctatcagaacttctttttctccatgcatgctgcgggctagatctttagatgtcccccaaggttttctgtgccatgacacacacacgtgccatcagttctaggggctggggattcaaacagattttactcctatgatcaggttatatcttaaggcaccat

SEQ ID NO: 23788 - DNA, 360 bp, Homo sapiens
  chr18.fa.O7frz.83373103
  Located on chromosome 18
  Distance between a terminus base of telomere on chromosomal short arm and 5'-terminus of this base sequence : 79030098
  Distance between 3'-terminus of neighbour sequence of sequence listing upward to telomere on chrosomal short arm and 5'-terminus of this base sequence : 131695
ccatgaagtaaattgatttgtaactaaagacctcctgaaaagaagtattcatgtctatatggtttcaccagagatttttactaaacatataaaggtgaattaatatccaaatatagatagatgatagatgatagatagatagatagatagatagatagatagatagatagatagatagatgatagatagatagataggaaatgcaaaacaaaaacatagacaagtgtgtctcatgaacctagacacaaaactcctcaataaaatattagcagattaaatccagccatgtacacaaagtatggtataattcatcatataaaaatgggactcttcctagcattcaaggctagttcaagactt

SEQ ID NO: 23789 - DNA, 283 bp, Homo sapiens
  DISD22_0011344
  Located on chromosome 18
  Distance between a terminus base of telomere on chromosomal short arm and 5'-terminus of this base sequence : 79217289
  Distance between 3'-terminus of neighbour sequence of sequence listing upward to telomere on chrosomal short arm and 5'-terminus of this base sequence : 186831
ccattgtctaaattcagtggctttggggggaagaaagagaattccccacccccaacacacacacacacacacacacacacacacacacacatgcacatacacacatgtgcacacgtgcacacacgtacacacacgtatgcaaacatacacacaaatgcacacacgtatacacacatgcacacacacatacacacatacacacacagatacacacatacacacaaacacacacacaaatccgtaattctccttttattcttttaggacctcagaccatagagga

SEQ ID NO: 23790 - DNA, 203 bp, Homo sapiens
  DISD22_0011349
  Located on chromosome 18
  Distance between a terminus base of telomere on chromosomal short arm and 5'-terminus of this base sequence : 79300952
  Distance between 3'-terminus of neighbour sequence of sequence listing upward to telomere on chrosomal short arm and 5'-terminus of this base sequence : 83380
gacctttgttgtgacgactgaagatattttgggggagaaatatataaagccctaccccctttttaaatggtaaacgtttctctatttctctctctgtccctctcccaatcttcctctctctctttctctttctctctctctctctctctctctgtcttggtctctctttccccacccaccctgcctcctggaggctctcattt

SEQ ID NO: 23791 - DNA, 398 bp, Homo sapiens
  chr18.fa.O7frz.85158307
  Located on chromosome 18
  Distance between a terminus base of telomere on chromosomal short arm and 5'-terminus of this base sequence : 79434185
  Distance between 3'-terminus of neighbour sequence of sequence listing upward to telomere on chrosomal short arm and 5'-terminus of this base sequence : 133030
tgaaggcatacaaactaagactctttcctgtgaattagtttgcatgccggcatgtaaatattcatttttcccatatgcccacgtgtaggtgcatgtacgcatctctgtatatgtgtaccttcctttattcactcttgtgatgcttcctggcctcctgcaatgggtcagacactctcccaatcatggcacagacgaaatcagagctgaaccctcagaggggccacgatgggggaaagcagtcactcagcccagcccagtgctcaaaaggaccccagatcacaaagagaaggtctgcaccgttgaaccagtggggatgaatttatgcgttcattcattcattcattcattcattcattcattcattcagcaaacattaattaagtgcctacgatattctg

SEQ ID NO: 23792 - DNA, 469 bp, Homo sapiens
  chr18.fa.O7frz.84918160
  Located on chromosome 18
  Distance between a terminus base of telomere on chromosomal short arm and 5'-terminus of this base sequence : 79767354
  Distance between 3'-terminus of neighbour sequence of sequence listing upward to telomere on chrosomal short arm and 5'-terminus of this base sequence : 332771
tgagttacggtaaccagatattagatgctgagaagcagcagccgtgtgtggggattatgatgggaaaggaggggaaagctggaactgaggtgcgttaaggacaagtttgcaagcatttggtagtggttgaaacgtgtctctaagccagggactgggaagttgcagatcccaggcagggaaggtggtagggaaccgagaccacaggagaatcactcatcatttgcagatgaaagggttgcttacttaggaaacacacacacacacacacacacacacacacacacacacacacacacacaacatcacctaacaatgttataaattgtgaaataattcagtaaggtaaaaagtacaacattaacatcagtacagttccataaataatcaactaccggatgaatacaatgagggaaaagttaacatgatacaacaggacaggcgtgaagatatctttagaacttggctgaat

SEQ ID NO: 23793 - DNA, 364 bp, Homo sapiens
  HUMUT471
  Located on chromosome 18
  Distance between a terminus base of telomere on chromosomal short arm and 5'-terminus of this base sequence : 79767543
  Distance between 3'-terminus of neighbour sequence of sequence listing upward to telomere on chrosomal short arm and 5'-terminus of this base sequence : -280
gaaccgagaccacaggagaatcactcatcatttgcagatgaaagggttgcttacttaggaaacacacacacacacacacacacacacacacacacacacacacacacacaacatcacctaacaatgttataaattgtgaaataattcagtaaggtaaaaagtacaacattaacatcagtacagttccataaataatcaactaccggatgaatacaatgagggaaaagttaacatgatacaacaggacaggcgtgaagatatctttagaacttggctgaatgcttcaagtggaaatttttctgcattaaaagttaaaaactttaaaaaattaaaacactctgaggggctcccatgatggctgact

SEQ ID NO: 23794 - DNA, 371 bp, Homo sapiens
  chr18.fa.O7frz.84842172
  Located on chromosome 18
  Distance between a terminus base of telomere on chromosomal short arm and 5'-terminus of this base sequence : 79909275
  Distance between 3'-terminus of neighbour sequence of sequence listing upward to telomere on chrosomal short arm and 5'-terminus of this base sequence : 141368
tcttcataatcactataattagcgtcataatctgagctgggtgagcttggggcagcttcctggcagagtaactcactttttaaataataataataataataataataataattggcattgcagggccttttcatccaagtttagacggccttatggagatcaaccgagtctggattgcaccctgccagagaggaacctgagacactttgcaaggagctgggtgcgaagcaacctggcccgggtcacagggaggtgccggtacggaggccggcgtccagtgagattggattcacaggttctgggcccatggcagcctatacggaatgcctgagaccttcgatacaatggactgatgttaactgaaggcataa

SEQ ID NO: 23795 - DNA, 306 bp, Homo sapiens
  DISO7_00003932
  Located on chromosome 18
  Distance between a terminus base of telomere on chromosomal short arm and 5'-terminus of this base sequence : 80016066
  Distance between 3'-terminus of neighbour sequence of sequence listing upward to telomere on chrosomal short arm and 5'-terminus of this base sequence : 106420
gcagactaacagaaattcttatggatagggctgtgtgtgtgtgtgtgtgtgtgtgtgtgtgtgtgcgcatgcatgtaagacagagagtgtgtgtattcttttagttcttacttctcagagttcagccactgcagggctgctggtaatctgtagcaactttcctgctctggtgcatcagtagacactttctgccagcatggcttattcatgagaactcccctcccacctcccatgccttttcaagcccagcaccagctcctacacttgcttctccttgcttctcaccttcttgcaaggtaactgagc

SEQ ID NO: 23796 - DNA, 225 bp, Homo sapiens
  DISO7_10004389
  Located on chromosome 18
  Distance between a terminus base of telomere on chromosomal short arm and 5'-terminus of this base sequence : 80132980
  Distance between 3'-terminus of neighbour sequence of sequence listing upward to telomere on chrosomal short arm and 5'-terminus of this base sequence : 116608
ctcttgcactggctctccattttaactttaattaacctaaattcccaaatatatatatatatatatatagcctaaattcccaaatatatatatatattaaaaaacctaaattcccaaatatatatatatatatatattcggagttcagtgatgcagtctcggctcactgcaagctctgcctcccaggttcacgcccagatatttttcaatagcacagacaagggc

SEQ ID NO: 23797 - DNA, 352 bp, Homo sapiens
  chr18.fa.O7frz.84097301
  Located on chromosome 18
  Distance between a terminus base of telomere on chromosomal short arm and 5'-terminus of this base sequence : 80394053
  Distance between 3'-terminus of neighbour sequence of sequence listing upward to telomere on chrosomal short arm and 5'-terminus of this base sequence : 260848
aactcctgacctcgtgatccgcccacctcggcctcccaaagtgctgggattacaggtgtgagccaccgcgcccagtcagctagtataaatttttttaaaggcagactctgattctcttgcttaggtgttctgctttatttatttatttatttatttatttatttatttattattttttgagacagggtcttgctctgttgcccaggctggagtgcagtggtacaatcatggctcactgcggcctctacctctcgggctcaagcaatccttctgcctgagcctcctgagtagctggcatagtgccagccactgtgcctagcttgtgtgagtataattaaagcaacatctccag

SEQ ID NO: 23798 - DNA, 101 bp, Homo sapiens
  DISO7_10004387
  Located on chromosome 18
  Distance between a terminus base of telomere on chromosomal short arm and 5'-terminus of this base sequence : 80466479
  Distance between 3'-terminus of neighbour sequence of sequence listing upward to telomere on chrosomal short arm and 5'-terminus of this base sequence : 72074
atgtggccatatagactcaggagtggttataaacacacacacacacacacacacacacacactcactctcaagtgggtagatacactcaggtgtggccata

SEQ ID NO: 23799 - DNA, 402 bp, Homo sapiens
  chr18.fa.O7frz.85803930
  Located on chromosome 18
  Distance between a terminus base of telomere on chromosomal short arm and 5'-terminus of this base sequence : 80881402
  Distance between 3'-terminus of neighbour sequence of sequence listing upward to telomere on chrosomal short arm and 5'-terminus of this base sequence : 414822
cagtaagaacttcaggacgacatctgcacaggacacggaacactgtcctggccccgccccacagtcatcatgaacctccagagagtggccagggggcagccacgggcctccagtgtgtggctctgagggacagccctggggaggcagcagcctcctgggctgacgggacacactcctgcaaaaacagacgatgagggctgcgggcttcatgggacacactacctcaagttcacacacacacacacacacacacacacacacacacacaaccagggctgcgggctccatgggacacactaccgcaaacacacacacaccagggctgtgggctcaagagcttaatattttgggggctaaaatatttgcatgcatcctccttaaaaagcttgtagccttcagtca

SEQ ID NO: 23800 - DNA, 339 bp, Homo sapiens
  chr18.fa.O7frz.86323482
  Located on chromosome 18
  Distance between a terminus base of telomere on chromosomal short arm and 5'-terminus of this base sequence : 81427362
  Distance between 3'-terminus of neighbour sequence of sequence listing upward to telomere on chrosomal short arm and 5'-terminus of this base sequence : 545558
atgttctaacctccaccttaagaaaaagagtaaattaaaaccaaagcaagcataaggaatgaaagaatattggagtgaaataaaacacagaatagaaaaacaataaagaaaatgaacaaaaccaaaaattggttctctgataggcaatgtggatgtgttgtgttaaaaaaagaaagaaagaaagaaagaaaagaaaaagaaacaccttttaaaaagttggttatttgaccagaacaaaaaattgacaaatttttagctagactgaccaaaaaaagaaaggaaaggaggggatcaaattactaaagtcaggaataaaagaggaaccattactaatgactt

SEQ ID NO: 23801 - DNA, 195 bp, Homo sapiens
  Z17140.1_62
  Located on chromosome 18
  Distance between a terminus base of telomere on chromosomal short arm and 5'-terminus of this base sequence : 81711669
  Distance between 3'-terminus of neighbour sequence of sequence listing upward to telomere on chrosomal short arm and 5'-terminus of this base sequence : 283968
cattccattgccattcaaggctgaactctaccggcctctctcccagaaagatctccctgaacacacacacacacacacacacacacacacacacagtcaaaatatggtaggtacttcttgacattcccaaaacattgtgtgtgtctcctgctgccctcaccacgttgtttactgttatctgctcactgcttgtct

SEQ ID NO: 23802 - DNA, 455 bp, Homo sapiens
  chr7.fa.O7frz.579448
  Located on chromosome 19
  Distance between a terminus base of telomere on chromosomal short arm and 5'-terminus of this base sequence : 271450
  Distance between 3'-terminus of neighbour sequence of sequence listing upward to telomere on chrosomal short arm and 5'-terminus of this base sequence : 0
cagtaaactgagtaaagatgacctgcccttagcagtgtgggcaagcatcacgcaagctttgaaggccagaatacaacaaaacggcagaggaaaggcacatttgcttcctcttctataacagcaatatccatcttctcttcccctgaggagctccagtttttgagcgtttggatgccaggacttacaccattgactcttctggttcttagtcttcagactcattgaattacatcactggctttcctggttctccagcttgcagatggcatagcatgggactttttgtcttccataattgtgtgagccaatttccacaataaattttctttatttatctctttttgtctctctctctctctctgtctctatccttctgtctctctgtgtgtttgtgtgtgtgtgtgtgtgtgtgtgtgtgtgtgtgtgtgtgtgtcctattgattctgtttctatga

SEQ ID NO: 23803 - DNA, 244 bp, Homo sapiens
  D3S3550
  Located on chromosome 19
  Distance between a terminus base of telomere on chromosomal short arm and 5'-terminus of this base sequence : 282721
  Distance between 3'-terminus of neighbour sequence of sequence listing upward to telomere on chrosomal short arm and 5'-terminus of this base sequence : 10816
tgcacttatgggaagtatttgtgaatttgttaaggtaaaacttcttcaagtatttgtttcctaccccaggtgtatttttttttctaattacgtaaaacacacacacacacacacacacacacacacacacacacacacacacacgcagacacaggaaaagaatttaccctggaaataggctttatcttaaaactcaaaacaaaactgaagcaacttgcaataaatggaaatcttgctgctgctg

SEQ ID NO: 23804 - DNA, 246 bp, Homo sapiens
  DISO7_10004424
  Located on chromosome 19
  Distance between a terminus base of telomere on chromosomal short arm and 5'-terminus of this base sequence : 463748
  Distance between 3'-terminus of neighbour sequence of sequence listing upward to telomere on chrosomal short arm and 5'-terminus of this base sequence : 180783
acaacacgaatgaaagcgctggcgactccgcagcgccggccggtccccagccatcacccgcgccgtcccgatggcgccgctcgcgttgctcctttctcggcgccaggatctctccccaggaaccagcgcagatccggaggccacgctgcgctgcgctgcgctgcgctgcgctgtcaggacgcgcagttcccgccccgctgaagggacaccgttttacaacacgccgcgtagaccgtgacagggaag

SEQ ID NO: 23805 - DNA, 109 bp, Homo sapiens
  DISD22_0011552
  Located on chromosome 19
  Distance between a terminus base of telomere on chromosomal short arm and 5'-terminus of this base sequence : 822326
  Distance between 3'-terminus of neighbour sequence of sequence listing upward to telomere on chrosomal short arm and 5'-terminus of this base sequence : 358332
gtgaatggttcatgaagggatttgtaaatggatggatgagtggatgatggatggatggatggatggatggatggatggatggatggaacggttgataggtagaaggaaa

SEQ ID NO: 23806 - DNA, 191 bp, Homo sapiens
  AC004449.1_1458
  Located on chromosome 19
  Distance between a terminus base of telomere on chromosomal short arm and 5'-terminus of this base sequence : 1051042
  Distance between 3'-terminus of neighbour sequence of sequence listing upward to telomere on chrosomal short arm and 5'-terminus of this base sequence : 228607
accattgattcatctccagacccttggttttcatgttgatttttcaaaaatcacctgatagtctgaccgaatgtagctttccactggtgtgtgtgtgtgtgtgtgtgtgtgtgtgtgtgtgagagagagatggagtctcgctctgtcacccgggctccagtgcagttgtgtgatcttggttcactgtaacc

SEQ ID NO: 23807 - DNA, 146 bp, Homo sapiens
  DISD22_0011553
  Located on chromosome 19
  Distance between a terminus base of telomere on chromosomal short arm and 5'-terminus of this base sequence : 1414198
  Distance between 3'-terminus of neighbour sequence of sequence listing upward to telomere on chrosomal short arm and 5'-terminus of this base sequence : 362965
aatacagcgaagttccgggtccagcgcttccgtggggctgacgcggccacacggcggcgcccttgccacacacacacacacacacacacacacacgcgcgcgaaggcccgccaggcatgggtgtcccctcctggtctggctcatac

SEQ ID NO: 23808 - DNA, 379 bp, Homo sapiens
  AC005379.1_1354
  Located on chromosome 19
  Distance between a terminus base of telomere on chromosomal short arm and 5'-terminus of this base sequence : 1486164
  Distance between 3'-terminus of neighbour sequence of sequence listing upward to telomere on chrosomal short arm and 5'-terminus of this base sequence : 71820
gaggcaagttctattactttgatgcccattatacagatttggggtttttttgttttgttttgttttgttttgagatggagtctcactctgttgcccaggctgcagtgcagttgtgccatctctgctcactgcaacctccacctccctggctcaaccgagtctcctgcctcagcctcccgagtagctgggattataggcgcccaccaccacgcctggttaatttttgtattttcagtagagacggggtttcaccatgttggcaggctggtcttgaactcctgaccttaagtgatccgcctgcctcagcctcccaaagtgctgggattacaggcatgagctaccacgcccggccctcattatacagatttgtaaaccaagg

SEQ ID NO: 23809 - DNA, 158 bp, Homo sapiens
  D19S886
  Located on chromosome 19
  Distance between a terminus base of telomere on chromosomal short arm and 5'-terminus of this base sequence : 1578192
  Distance between 3'-terminus of neighbour sequence of sequence listing upward to telomere on chrosomal short arm and 5'-terminus of this base sequence : 91649
attttactggctggcacttggcattttattcatttcatggaggatttttttcctacctctccaacgctggctccaaaaggagatgacgtttggggtgtgtgtgtgtgtgtgtgtgtgtgtgtgtgtgtgtgtgagaaaatcgccggagtgtagatcca

SEQ ID NO: 23810 - DNA, 243 bp, Homo sapiens
  AC004528.1_43408
  Located on chromosome 19
  Distance between a terminus base of telomere on chromosomal short arm and 5'-terminus of this base sequence : 1604414
  Distance between 3'-terminus of neighbour sequence of sequence listing upward to telomere on chrosomal short arm and 5'-terminus of this base sequence : 26064
tcagaataacagaaatggtcagcactggtctaaaatgacatgggtcggccaggtgcagtggttcaagcctgtaatcacagtactttgggaggctgaggcgggtggatcacctgaggtcaggggttcgagaccagcctggccaacatggtgaaaccccatctctactaaaaataaaataaaataaaataaaataaaataaaataaaataaaataaaataaaatgtgtcaaactcctattgatgc

SEQ ID NO: 23811 - DNA, 437 bp, Homo sapiens
  chr2.fa.O7frz.56454496
  Located on chromosome 19
  Distance between a terminus base of telomere on chromosomal short arm and 5'-terminus of this base sequence : 2209414
  Distance between 3'-terminus of neighbour sequence of sequence listing upward to telomere on chrosomal short arm and 5'-terminus of this base sequence : 604757
agctttctagaatcttctagaatgttctagcccagcgttgttcaatagaactttctacaatgatgaaaacgattatgggaatggtctaaatctgcactgtgtgatacaaagccaccagctgtgcatgatttgtcacctgaaatgcgaggacaactgggaagctgaattttttattctactaagcttgaattttatttatttatttatttatttatttatttgagacaggttattgctctgtcacccaggttggagtgcactggcttgatcacggctcactgcaacctccacctcccggggctaaagcgattctcctgcctcagcctcctgagtagctgggattacaggcacctgccaccacgcccggctagtttttgtatttttagtagagacggggttttaccatgttggccaggctagtttcgaactcctgacct

SEQ ID NO: 23812 - DNA, 316 bp, Homo sapiens
  AC006274.1_4445
  Located on chromosome 19
  Distance between a terminus base of telomere on chromosomal short arm and 5'-terminus of this base sequence : 2446032
  Distance between 3'-terminus of neighbour sequence of sequence listing upward to telomere on chrosomal short arm and 5'-terminus of this base sequence : 236181
aaatcgtacagatgaagaacagattggtgattcctgggcttaaagaaggtgcatgtctcaaaactgcacagaactacacacacacacacacacacacacacacacacacacgcacgcgtacacacacgcacgcagacacagacgcagacacgcacacacgcgcagacgcacagacacgcacgcgcagacgcacacacacgtgcgcacacacgcacgcacacgcacagacgcgcacacgcacagacacacacccgcacgcacacacagacacacacacgtgcgtgtaaagccggtggaatctgatcaggatctgtgg

SEQ ID NO: 23813 - DNA, 298 bp, Homo sapiens
  AC005619.1_9556
  Located on chromosome 19
  Distance between a terminus base of telomere on chromosomal short arm and 5'-terminus of this base sequence : 2496897
  Distance between 3'-terminus of neighbour sequence of sequence listing upward to telomere on chrosomal short arm and 5'-terminus of this base sequence : 50549
ccaacatattccaacgatttacttggcaagcatttgttaagtgcctgctgtctaccaggcccatctggctggtccggcttcatggatgtgtagcccagtggttcagggtttcatgtttggcttaatgctctggtgtctgtcaccatcttgatgcttttgctaatttgatctttgaacttgtgtgtgtgtgtgtgtgtgtgtgtgtgtgtgtgtgtgtttgtttgtttttaatgcagtctcgctctgtcacccaggctggagtgcagtggtgtgatctcagcttactgtaatctttgcc

SEQ ID NO: 23814 - DNA, 448 bp, Homo sapiens
  AC005619.1_17921
  Located on chromosome 19
  Distance between a terminus base of telomere on chromosomal short arm and 5'-terminus of this base sequence : 2505119
  Distance between 3'-terminus of neighbour sequence of sequence listing upward to telomere on chrosomal short arm and 5'-terminus of this base sequence : 7924
gtacttaaatggcaagaacaattgagtgaaggtggggtggaaattcaaatccagctgcagtatcagtattttccaaaatgtctacaattttcacttgttaccttgggcgaggcacagtggctcttgtctataaacccagctactcaggaggttgaagcgggaggatcgcttgagcctggaggttgaggctgcagtgagctgagatcacaccaccgcattccagtctgggcgacagacggaaaccctgtatctaaagagaagagaagagaagagaagagaagagaagagaagagaagagaagagaagagaagagaagaagaggaagagaagagaagagaagagaagagaagagaagagaagagaagagaagagaagagaagagaagagaaaagagaagagaagagaagaagacaccacaggccaggcgcagtggctcatgcgtataatc

SEQ ID NO: 23815 - DNA, 395 bp, Homo sapiens
  AC004755.1_11949
  Located on chromosome 19
  Distance between a terminus base of telomere on chromosomal short arm and 5'-terminus of this base sequence : 2581565
  Distance between 3'-terminus of neighbour sequence of sequence listing upward to telomere on chrosomal short arm and 5'-terminus of this base sequence : 75998
ttagctatgctgaactgtggtcagatcaggtcaagcctcttggtcacagaagtggcccagcagcactttgggaggccgagacaggaggatcgcttgaggccaggagtttgagaccagcctgggcaacacagcaagaccccacttctacaaaaaaaaataaataaagtggcccaggactcctggatccttttcagatatcttcgtatcacacacacacacacacacacacacacacacacacacacacacacacccctacctgtttccggaccccaccccaaacttggccagacccccacagaaggctctatccccgacctgcccgccggcccctcaggccctctcctgcctccccgcatgcccacttggctgtcacataccaaagagcatgcgtt

SEQ ID NO: 23816 - DNA, 211 bp, Homo sapiens
  D19S878
  Located on chromosome 19
  Distance between a terminus base of telomere on chromosomal short arm and 5'-terminus of this base sequence : 3258374
  Distance between 3'-terminus of neighbour sequence of sequence listing upward to telomere on chrosomal short arm and 5'-terminus of this base sequence : 676414
gcctgggcgacagagaatgagaccctgtctcaaaacacacacacacacacacacacacacacacacacaaaatggttacaccagtgccctagaaaacgccctcagcacctcgcccccagggctgtcctgggcacacccctccctgcgccctgtcctgagtcacctgcccaggtgggcccacctgcccacagcgcccactctgcgggcaacc

SEQ ID NO: 23817 - DNA, 168 bp, Homo sapiens
  D19S565
  Located on chromosome 19
  Distance between a terminus base of telomere on chromosomal short arm and 5'-terminus of this base sequence : 3652294
  Distance between 3'-terminus of neighbour sequence of sequence listing upward to telomere on chrosomal short arm and 5'-terminus of this base sequence : 393709
gtgattgcaccacgggcactccagcctgggtgacagagtgagaccctatgtcacacacacacacacacacaaatcgacgacaactgagaagaaataaacctgcagatggaaaaggtgtgttctggaagcatcactacaggaatgatcacggccaacccaatgacttga

SEQ ID NO: 23818 - DNA, 295 bp, Homo sapiens
  chr19.fa.O7frz.1641885
  Located on chromosome 19
  Distance between a terminus base of telomere on chromosomal short arm and 5'-terminus of this base sequence : 3708187
  Distance between 3'-terminus of neighbour sequence of sequence listing upward to telomere on chrosomal short arm and 5'-terminus of this base sequence : 55725
gttgtacaaacatcatgcctacctagttcttgtacattctctctctctctctctctctctttttttgttttgagacagggtctcactccatcttccaggctggagtgcagtggtgcgatcttggctcaccgcaacctctgcctctcaggttcaagcaatcctcctgccttagcctcccgagtagctgggattacaggcatgcaccaccacacctggctaatttttaatttttcgtagagatgggggtctcactatgttgccaaggctggtcttgaactcctagcctcatgatcct

SEQ ID NO: 23819 - DNA, 95 bp, Homo sapiens
  D19S591
  Located on chromosome 19
  Distance between a terminus base of telomere on chromosomal short arm and 5'-terminus of this base sequence : 4105105
  Distance between 3'-terminus of neighbour sequence of sequence listing upward to telomere on chrosomal short arm and 5'-terminus of this base sequence : 396623
gcaactgaggaaatgcatctttcatctcatttttatctatctatctatctatctatctatctatctacagcttgtcactgctacctaggctggaa

SEQ ID NO: 23820 - DNA, 141 bp, Homo sapiens
  D19S424
  Located on chromosome 19
  Distance between a terminus base of telomere on chromosomal short arm and 5'-terminus of this base sequence : 4276803
  Distance between 3'-terminus of neighbour sequence of sequence listing upward to telomere on chrosomal short arm and 5'-terminus of this base sequence : 171603
agctggttatcttgagggaggaaagaaacccctccccattccccatctcttttcaaaaccaaccatcacacacacacacacacacacacacacacacacacaaaattgggcctgaaaaatctaactcctccatgtggccta

SEQ ID NO: 23821 - DNA, 275 bp, Homo sapiens
  DISO7_00018594
  Located on chromosome 19
  Distance between a terminus base of telomere on chromosomal short arm and 5'-terminus of this base sequence : 4350769
  Distance between 3'-terminus of neighbour sequence of sequence listing upward to telomere on chrosomal short arm and 5'-terminus of this base sequence : 73825
gcaatagggagctagtgagtactacacacacacacacacacacacacacacacacacacacacacacaattgtatctttatcccaggctgtgtctcttttcctcccttcccagagctgcccaacctcatcgttcaggtctcatctccaaggctaccctcccccaagggtcctctcccagacaccccacataagcaggtttgcttttgttcatctctatcactgccctctaaactcttcctctgtctgtacaaatagtcccataattaccaagctg

SEQ ID NO: 23822 - DNA, 122 bp, Homo sapiens
  DISD22_0011581
  Located on chromosome 19
  Distance between a terminus base of telomere on chromosomal short arm and 5'-terminus of this base sequence : 4578016
  Distance between 3'-terminus of neighbour sequence of sequence listing upward to telomere on chrosomal short arm and 5'-terminus of this base sequence : 226972
attcacaaatccatggccccgtctgattgcaccaacggctgctgcacacacacacacacacacacacacacacacacacacacggcctgtgacagcctcgccgggctgtgggtggtcactta

SEQ ID NO: 23823 - DNA, 291 bp, Homo sapiens
  chr5.fa.O7frz.170425641
  Located on chromosome 19
  Distance between a terminus base of telomere on chromosomal short arm and 5'-terminus of this base sequence : 4729749
  Distance between 3'-terminus of neighbour sequence of sequence listing upward to telomere on chrosomal short arm and 5'-terminus of this base sequence : 151611
ctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaa

SEQ ID NO: 23824 - DNA, 433 bp, Homo sapiens
  chr19.fa.O7frz.2740341
  Located on chromosome 19
  Distance between a terminus base of telomere on chromosomal short arm and 5'-terminus of this base sequence : 4993475
  Distance between 3'-terminus of neighbour sequence of sequence listing upward to telomere on chrosomal short arm and 5'-terminus of this base sequence : 263435
acgcctgtaattctagctacttgggaggctgaggcacgagaattgctggaacccaggaggcggaggttgcagtgagctgagattgtgtcactacactccagcctgggtgacagagtgacactctgtctcaaaagaaaaaaaaaaaatatatatatatatatatataaaataataaaataggcaggagtgataggggatcagagaagactggttagctaggtggtcagggaggacttcctgaggaggtggcatttgagcctagacctcagtggcaggggccagccaggcaggaatcccgtgaaacatgtcccagattcaggggacagatggggtaaaggtttggaggtgaactaagatgaggtgggctgtgaggttaggcttaatccctcaggcactgtggagctctggagggtttagacaaagcttctggttt

SEQ ID NO: 23825 - DNA, 237 bp, Homo sapiens
  AC005786.1_35136
  Located on chromosome 19
  Distance between a terminus base of telomere on chromosomal short arm and 5'-terminus of this base sequence : 5188622
  Distance between 3'-terminus of neighbour sequence of sequence listing upward to telomere on chrosomal short arm and 5'-terminus of this base sequence : 194714
ccagaactgtgaaacaataaatttctcttgtttaagcccctcagtttgtcgtaattattacctagcaaaccaatgcagtgtggtgtgcgtgtgtgtgtgtgtgtgtgtgtgtgtgtgtgtgagtgtggctaggaaaaattttaaaaagagatgcggccgggtacagtggctcacgcctgtaatctcagcactttgggaggccaaggtgggcggatcatctgaggtcaggagttcaag

SEQ ID NO: 23826 - DNA, 294 bp, Homo sapiens
  DISD22_0011589
  Located on chromosome 19
  Distance between a terminus base of telomere on chromosomal short arm and 5'-terminus of this base sequence : 5535339
  Distance between 3'-terminus of neighbour sequence of sequence listing upward to telomere on chrosomal short arm and 5'-terminus of this base sequence : 346480
tcagtgagggatctgcactgtggcgtgtgtgtgtgactgcatgtacattacagcatgtatgtgagtgtgtgtgaccctgtgtgtgattgtgagcgtgtgactgcatgtgcattatggcttgtgagtgtgtgtgaccctgtgtgtgtgtgtgtgtgtgtgtgtacccaggcctggccattcctccagcccctcctccccgaaggcaggagggaggtggccagcgtgggggagggtgccaggcctggaggaggaaatgcctccgggaaatggaaatggcttagaaacagaggctct

SEQ ID NO: 23827 - DNA, 177 bp, Homo sapiens
  chr19.fa.O7frz.1995840
  Located on chromosome 19
  Distance between a terminus base of telomere on chromosomal short arm and 5'-terminus of this base sequence : 6078264
  Distance between 3'-terminus of neighbour sequence of sequence listing upward to telomere on chrosomal short arm and 5'-terminus of this base sequence : 542631
gtaagcaatttgtctgagtcacagagacaggatgtggtgcagggggtattgcagctgtgtactgctgaccccaaatctcactctgtgcatgaccatacacgtctaccgtgtgtgtgtgtgtgtgtgtgtgtgtgtgtgtgtgtgtgtgtgtgtgtgatgtttaaaatggtcttgtaa

SEQ ID NO: 23828 - DNA, 287 bp, Homo sapiens
  AC027272.4_33357
  Located on chromosome 19
  Distance between a terminus base of telomere on chromosomal short arm and 5'-terminus of this base sequence : 6169465
  Distance between 3'-terminus of neighbour sequence of sequence listing upward to telomere on chrosomal short arm and 5'-terminus of this base sequence : 91024
gcgattagctcaaggtcacacagcaaggatgatataaccaaacggaattcaagcccctgtcacctgtctgctgcgtcgttgctcttaaattctggctctggaagacctcggttttgttgttgttgttgttgttttagtttgtttgtttttgttgttgtttatttgttttgcagtggagtctcgctctgtcacccaggctggagtgcagtgacgcgatctcggcttactgcaacctctgcctccagggttcaagcgattctcctgcctcacttcctgagtagctgaga

SEQ ID NO: 23829 - DNA, 346 bp, Homo sapiens
  AC008616.6_72013
  Located on chromosome 19
  Distance between a terminus base of telomere on chromosomal short arm and 5'-terminus of this base sequence : 6226190
  Distance between 3'-terminus of neighbour sequence of sequence listing upward to telomere on chrosomal short arm and 5'-terminus of this base sequence : 56438
ttgaaatacctgaagatttacagaaaagttccaaagatagtacagataattctcacctaccccctcaccaacttccccgaatattagcatcttatataaccagggtacatctgtcacagtaagatactaagggtggggccaggcatggtggcttactcccagcgctttgagaaggcaaggcaggaggattgctggggaccagaagttcaagactagcctgggcaacatagtgagaccctgtccgtgtctacacacacacacacacacacacacacacacacacacacaaattttaattaaaaaaagaaactaaaggtggaatgttaccattaacattgtaggctgt

SEQ ID NO: 23830 - DNA, 162 bp, Homo sapiens
  D19S894
  Located on chromosome 19
  Distance between a terminus base of telomere on chromosomal short arm and 5'-terminus of this base sequence : 6436273
  Distance between 3'-terminus of neighbour sequence of sequence listing upward to telomere on chrosomal short arm and 5'-terminus of this base sequence : 209737
ttacttggacccaggaagcggaggttgcagtgacctgagatcggcccgctgcactccagcctgggacagagcaagactccgtcacacacacacacacacacacacacacacacacacacacacacacacacacaaaagatcattccatgtttatggcttaac

SEQ ID NO: 23831 - DNA, 309 bp, Homo sapiens
  AF190465.1_42337
  Located on chromosome 19
  Distance between a terminus base of telomere on chromosomal short arm and 5'-terminus of this base sequence : 6445216
  Distance between 3'-terminus of neighbour sequence of sequence listing upward to telomere on chrosomal short arm and 5'-terminus of this base sequence : 8781
atgcttctagaatgcaattcagggccaggggcggtggctcacgcctgtaatcccagcactttgggaggcctaggtgggcggatcacgaggtcaggagattgagaccatcctggctaacacggtgaaaccctgtctctactaaaaaatagaaaaaattagccggacgtggtggcgggcgcctgtggtcccagctactagggactccgtctcaagaaaaaagaaagaaagaaaggaaggaaggaaggaaggaaggaaggaaggaaggaagaaagaaagaaagaaaacctgtttctacactcacaggctgac

SEQ ID NO: 23832 - DNA, 274 bp, Homo sapiens
  AC011498.4_15816
  Located on chromosome 19
  Distance between a terminus base of telomere on chromosomal short arm and 5'-terminus of this base sequence : 6658890
  Distance between 3'-terminus of neighbour sequence of sequence listing upward to telomere on chrosomal short arm and 5'-terminus of this base sequence : 213365
catagtcaacttgacattgcttacttacgagttggttgatattagcagaattattattattattattattatttgagatggagtcttgctcttttgcccaagctggagtgcagtggcgcgatcttggctcagtgcaatctccgccttctggattcaagcgattctcctgcctcagcctcccgggtcgctgggattacaggcacccgccaccatgcctggccaggagaatgatatcacgggagaaacaaccatagtgaacacagttaggtttggt

SEQ ID NO: 23833 - DNA, 281 bp, Homo sapiens
  AC005783.1_22018
  Located on chromosome 19
  Distance between a terminus base of telomere on chromosomal short arm and 5'-terminus of this base sequence : 6762966
  Distance between 3'-terminus of neighbour sequence of sequence listing upward to telomere on chrosomal short arm and 5'-terminus of this base sequence : 103802
gtcaggtgatcgagaccatcctggctaatgtggtgaaaccccgtctctactaaaaatacaaaaattagccaggtgtggtgacacgcacctgtactcccagctacttgggaggctgaggcagaagaatcgcttgaacccgggagatggaggttgcagggagccaagatcgtgccactgcactccagcctgggtaacagagcaagactccgtcttaaataaataaataaataaataaataaataaataaataaataaaaatggactcagtgaggttgaatggc

SEQ ID NO: 23834 - DNA, 175 bp, Homo sapiens
  AC006537.1_29223
  Located on chromosome 19
  Distance between a terminus base of telomere on chromosomal short arm and 5'-terminus of this base sequence : 6808054
  Distance between 3'-terminus of neighbour sequence of sequence listing upward to telomere on chrosomal short arm and 5'-terminus of this base sequence : 44807
ctctatagtaacggctgaggaaggggctgcgtgtgtgtgtgtgtgtgtgtgtgtgtgtgtgtgtgtgtgtgtacgcgcacatacagggaggaggaatcacccaaggcccttattcctagacttttcttttctaccctgatgagctattaattaatactcattgctggcttgttat

SEQ ID NO: 23835 - DNA, 309 bp, Homo sapiens
  AC005523.1_12405
  Located on chromosome 19
  Distance between a terminus base of telomere on chromosomal short arm and 5'-terminus of this base sequence : 6823148
  Distance between 3'-terminus of neighbour sequence of sequence listing upward to telomere on chrosomal short arm and 5'-terminus of this base sequence : 14919
tttacttgttatgaggaagcagacatcctgggcaacatagtgagaccccgtctctacaaaaaataaacaattagccaggcatggtgatgcacctgtaatcccagctacttaggaggctgaggtagaaggaaagattgcttggccctgggaggtcaaggctgcagtgatctatgattgtaccactgcactccatccagcctgggcaacagagtgagatcttgtctcaaaaataaataaataaataaataaataaataagagagagaaaaagcaggtatgcctgctactccataacatttctgttagaagg

SEQ ID NO: 23836 - DNA, 165 bp, Homo sapiens
  AC027319.5_116400
  Located on chromosome 19
  Distance between a terminus base of telomere on chromosomal short arm and 5'-terminus of this base sequence : 6880566
  Distance between 3'-terminus of neighbour sequence of sequence listing upward to telomere on chrosomal short arm and 5'-terminus of this base sequence : 57109
gcctaggcaacatagcaagacccacatctgtgtgtgtgtgtgtgtgtgtgtgtgtgtgtgtgtataatttagctgagtgtggtggtgcacgcctgtagttcccagatactcaagaggatgaggtggggccagatgtggtggctcacacctgtaacctcagtactt

SEQ ID NO: 23837 - DNA, 428 bp, Homo sapiens
  AC027319.5_3672
  Located on chromosome 19
  Distance between a terminus base of telomere on chromosomal short arm and 5'-terminus of this base sequence : 6993134
  Distance between 3'-terminus of neighbour sequence of sequence listing upward to telomere on chrosomal short arm and 5'-terminus of this base sequence : 112403
gttggtagaaatacaaattggaaccatctttctggaaatctcttctgcctgtttgtatgaagagctttataaatgatctattcttgtcactctaactccgctttgaaaaatgtctttaggagacctctggctaggtaaaaatgtaagatgtaatgtttttcataccattatctaaaacaattggcacatagacacacacacacacacacacacacacacacactctcacaaagtcagtaactaagtacctaaaaaagacatgggccatgggtggtgtgtcacatgcctgtcgttccagtactttgggaggctgaggtgggaggattgcttgaggctaggagtttgagacctacttgtgcaacataaaattatgaaaaattaaaattacaaaaaagaatttcaaaaaagttagctggttatggtcgtgt

SEQ ID NO: 23838 - DNA, 185 bp, Homo sapiens
  D19S216
  Located on chromosome 19
  Distance between a terminus base of telomere on chromosomal short arm and 5'-terminus of this base sequence : 6993215
  Distance between 3'-terminus of neighbour sequence of sequence listing upward to telomere on chrosomal short arm and 5'-terminus of this base sequence : -347
tcttgtcactctaactccgctttgaaaaatgtctttaggagacctctggctaggtaaaaatgtaagatgtaatgtttttcataccattatctaaaacaattggcacatagacacacacacacacacacacacacacacacactctcacaaagtcagtaactaagtacctaaaaaagacatgggcc

SEQ ID NO: 23839 - DNA, 185 bp, Homo sapiens
  Z16743.1_130
  Located on chromosome 19
  Distance between a terminus base of telomere on chromosomal short arm and 5'-terminus of this base sequence : 6993250
  Distance between 3'-terminus of neighbour sequence of sequence listing upward to telomere on chrosomal short arm and 5'-terminus of this base sequence : -150
taggagacctctggctaggtaaaaatgtaagatgtaatgtttttcataccattatctaaaacaattggcacatagacacacacacacacacacacacacacacacactctcacaaagtcagtaactaagtacctaaaaaagacatgggccatgggtggtgtgtcacatgcctgtcgttccagtac

SEQ ID NO: 23840 - DNA, 130 bp, Homo sapiens
  DISD22_0011604
  Located on chromosome 19
  Distance between a terminus base of telomere on chromosomal short arm and 5'-terminus of this base sequence : 7110433
  Distance between 3'-terminus of neighbour sequence of sequence listing upward to telomere on chrosomal short arm and 5'-terminus of this base sequence : 116998
ggacataaagcatgtaagtaccagatatatatgcgtgtgtgtgtgtgtgtgtgtgtgtgtgtgtgtgtgtgcgcgcgcgcgcgtatgttagcaaatgactctccggctgtcccctgtgtacctcgatgtc

SEQ ID NO: 23841 - DNA, 442 bp, Homo sapiens
  chr19.fa.O7frz.5150035
  Located on chromosome 19
  Distance between a terminus base of telomere on chromosomal short arm and 5'-terminus of this base sequence : 7527483
  Distance between 3'-terminus of neighbour sequence of sequence listing upward to telomere on chrosomal short arm and 5'-terminus of this base sequence : 416920
aggatcatgaggtcaggagattgagaccaccctggctaacatggtgaaaccccgtctctactaaaaatacaaaaaattagccgggtgtggtggctggcacctgtaatcccagctactcgggaggctgaggcaggaggatcgcttgaatctgggaggcggaggttgcagtgagccgagactgcgccaccgcactccagcctgggcgacagagtgagactctgtcacaaaaaattaattaattaaaataaataaataaataaataaataaataaataaataaataaaaattagccaggtcaggcacagtggctcatgcctgcaatcccagcactttgggaggccaaggcgcttcagcccatctttcttttttttctgagacaaggtctggctctgttgcccaggctgagtgcagcggtgcaatcagtttccatagttgtacgac

SEQ ID NO: 23842 - DNA, 185 bp, Homo sapiens
  HUMUT1057
  Located on chromosome 19
  Distance between a terminus base of telomere on chromosomal short arm and 5'-terminus of this base sequence : 7735759
  Distance between 3'-terminus of neighbour sequence of sequence listing upward to telomere on chrosomal short arm and 5'-terminus of this base sequence : 207834
ttggggtcctagaatcaggcctggcacatagcaggtgctcaggaaacactgaatgaatgaatgaatgaatgaatgaatgaatgaatagcagagctgggattcagacccaagctggtggatgccagagccccccactcgcagccctgggctcggagggggggacttctgctgccctttatgtccct

SEQ ID NO: 23843 - DNA, 371 bp, Homo sapiens
  AC004611.1_21785
  Located on chromosome 19
  Distance between a terminus base of telomere on chromosomal short arm and 5'-terminus of this base sequence : 7844744
  Distance between 3'-terminus of neighbour sequence of sequence listing upward to telomere on chrosomal short arm and 5'-terminus of this base sequence : 108800
cacctcatggtatgctttaaagaagggtttttaggctggtcgcggtggctcatgcctgtaatcccagcactttgggagaccaaggtaggcggatcacaaggtcaggagttcgagaccaccctggccaacattgtgaaactccgtctctactaaaaatacaaaaaaatttagccaggcgtggtggcgcatgcctgtaatcccagccactcgggaggctaaggcaggagaattgcttgaacccaggaggtggaggttgcagtcagccgagatggcgccactgcactccagcctggcaacagagagagactccatctcaaaataaataaataaataaataaataaataaataagaaggacctttagatcctgag

SEQ ID NO: 23844 - DNA, 176 bp, Homo sapiens
  DISO7_10004411
  Located on chromosome 19
  Distance between a terminus base of telomere on chromosomal short arm and 5'-terminus of this base sequence : 8164265
  Distance between 3'-terminus of neighbour sequence of sequence listing upward to telomere on chrosomal short arm and 5'-terminus of this base sequence : 319150
taatccctgccactctgcctctcccggccgaggaggagctggggagtagcaaagaggaaggggagaagcgctcagttggcggccattttgaggagcagggccaaggggcggggcggggcggggcggggcggggcaatgcggggacggacggtgctgccaaggctgtgatggagact

SEQ ID NO: 23845 - DNA, 101 bp, Homo sapiens
  DISO7_10004409
  Located on chromosome 19
  Distance between a terminus base of telomere on chromosomal short arm and 5'-terminus of this base sequence : 8280119
  Distance between 3'-terminus of neighbour sequence of sequence listing upward to telomere on chrosomal short arm and 5'-terminus of this base sequence : 115678
tgtatattccatcggcctgcccatccatccatccatccatccatccatccatccatccaacaaaataagacctttcactacaccaggcatatgtctacatg

SEQ ID NO: 23846 - DNA, 394 bp, Homo sapiens
  chr19.fa.O7frz.6157741
  Located on chromosome 19
  Distance between a terminus base of telomere on chromosomal short arm and 5'-terminus of this base sequence : 8383486
  Distance between 3'-terminus of neighbour sequence of sequence listing upward to telomere on chrosomal short arm and 5'-terminus of this base sequence : 103266
ggttatgtagattgaacactgaacaacccaagacaaagatgtacttggtactgaaagtaaagagtgtgtgtgtgtgtgtgtgtgtgtgtgtgtgtgtgtgtgtttataagtcagtattcccaaatctaaaaagctccaaaaaacaggagtttttggcagcaaagtctgatctgaattgataagatgttgtttgtggtcttcattttattccacttactgggattatgcatatatttgtagaatttttataccaccttttcttgacttataccctttaagtattatcttttgcctttctattgtggtgaggatttagctcccttcctctcccgtcttctcatttctccttccccattctctcaacataaattattcttagttaactgagccaagt

SEQ ID NO: 23847 - DNA, 364 bp, Homo sapiens
  AC021153.6_48897
  Located on chromosome 19
  Distance between a terminus base of telomere on chromosomal short arm and 5'-terminus of this base sequence : 8560210
  Distance between 3'-terminus of neighbour sequence of sequence listing upward to telomere on chrosomal short arm and 5'-terminus of this base sequence : 176330
ttgattttgtcatccgtatgtacgcagttttctttctttctttctttctttctttctttctttctttctttctttctttctttctttctttctttctttctttctttctttctttctttctttctatttttttttttttgagacagagtcttgctctgtcacccaggctgcaatgtagtggcacaatcacagctcgctgcagcctccgcctcccgggttcaagcgattctcctgcctcagcctcctgagtaactgggattacaggtgtgcaccaccatgcccagcttacttttttctatattcttggtagagatggggtttcaccatgttggccaggctggtcttgaactcttgacctcaagtg

SEQ ID NO: 23848 - DNA, 216 bp, Homo sapiens
  D19S905
  Located on chromosome 19
  Distance between a terminus base of telomere on chromosomal short arm and 5'-terminus of this base sequence : 8582711
  Distance between 3'-terminus of neighbour sequence of sequence listing upward to telomere on chrosomal short arm and 5'-terminus of this base sequence : 22137
acctgctgggctttgcatctgcaggcccctctgcctacaacgccatcaccccttcctccagcaaactcctgcacatctgcactctcagcccagatcccctttctcctttcccaatgccatcctccctggtccagacacactcttaatccgggccatgtggtgtgtgtgtgtgtgtgtgtgtgtgtgtgttgtatctggtgaccctgacccccgtgt

SEQ ID NO: 23849 - DNA, 179 bp, Homo sapiens
  D19S912
  Located on chromosome 19
  Distance between a terminus base of telomere on chromosomal short arm and 5'-terminus of this base sequence : 8784443
  Distance between 3'-terminus of neighbour sequence of sequence listing upward to telomere on chrosomal short arm and 5'-terminus of this base sequence : 201516
atctgggtgttaagtgtgcccattgttactggggtatgtggctcccaggtcctcttagtagataaatgggaacacacacacacacacacacacacacacacacacacaaacttatttctatatttatctttatattttgaaaaccatgaattcacctcagtacctccaattcaataggg

SEQ ID NO: 23850 - DNA, 116 bp, Homo sapiens
  DISD22_0011616
  Located on chromosome 19
  Distance between a terminus base of telomere on chromosomal short arm and 5'-terminus of this base sequence : 8869158
  Distance between 3'-terminus of neighbour sequence of sequence listing upward to telomere on chrosomal short arm and 5'-terminus of this base sequence : 84536
gagcttacaccagggtggcaaggacaggaagttggtccctgctcgggtgtgtgtgtgtgtgtgtgtgtttgtgtgtgtgtgtgtgtgttgtgtgatttcttctgcagcctccagag

SEQ ID NO: 23851 - DNA, 112 bp, Homo sapiens
  DISD22_0011622
  Located on chromosome 19
  Distance between a terminus base of telomere on chromosomal short arm and 5'-terminus of this base sequence : 9114621
  Distance between 3'-terminus of neighbour sequence of sequence listing upward to telomere on chrosomal short arm and 5'-terminus of this base sequence : 245347
ctgccttaatgggatactcccctctctgtctctgtctgtctgtctgtctgtctgtctctctctcatccccttttctttcctctgttcccccacccccacctctgatgcagtt

SEQ ID NO: 23852 - DNA, 112 bp, Homo sapiens
  D19S873
  Located on chromosome 19
  Distance between a terminus base of telomere on chromosomal short arm and 5'-terminus of this base sequence : 9275257
  Distance between 3'-terminus of neighbour sequence of sequence listing upward to telomere on chrosomal short arm and 5'-terminus of this base sequence : 160524
ttggcaactaagcaagtttctgtctcaacaataacacacacacacacacacacacacacacagacacacacacacacacagaaacaagaaggtctgagtctggaattgggtc

SEQ ID NO: 23853 - DNA, 345 bp, Homo sapiens
  AC021153.6_11032
  Located on chromosome 19
  Distance between a terminus base of telomere on chromosomal short arm and 5'-terminus of this base sequence : 9281720
  Distance between 3'-terminus of neighbour sequence of sequence listing upward to telomere on chrosomal short arm and 5'-terminus of this base sequence : 6351
cgtgtatgctcagaagtgagtggggtttggccaggcacagtggctcatgcctgtaatcccagcactttctgaggccaaggccagaggtttgcttgagtccaggagtttgataccagcctgggcaacatagcgacaccccatctcaaaaaagagagacagagggagagagaaaggaaagaaggaaggaaagaaggaagaagagagagaaggaaggaaaagaaggaaggaaggaaagaaagaaagaaagagagagagagagaaagaaagaaagaaagaaagaaagaaagaaagaaagaaagaattgaagttagctgagtgtggtggtgcatctgtaattccagctac

SEQ ID NO: 23854 - DNA, 220 bp, Homo sapiens
  HUMUT757
  Located on chromosome 19
  Distance between a terminus base of telomere on chromosomal short arm and 5'-terminus of this base sequence : 9281843
  Distance between 3'-terminus of neighbour sequence of sequence listing upward to telomere on chrosomal short arm and 5'-terminus of this base sequence : -222
aacatagcgacaccccatctcaaaaaagagagacagagggagagagaaaggaaagaaggaaggaaagaaggaagaagagagagaaggaaggaaaagaaggaaggaaggaaagaaagaaagaaagagagagagagagaaagaaagaaagaaagaaagaaagaaagaaagaaagaaagaattgaagttagctgagtgtggtggtgcatctgtaattccagct

SEQ ID NO: 23855 - DNA, 389 bp, Homo sapiens
  DISO7_00018752
  Located on chromosome 19
  Distance between a terminus base of telomere on chromosomal short arm and 5'-terminus of this base sequence : 9525538
  Distance between 3'-terminus of neighbour sequence of sequence listing upward to telomere on chrosomal short arm and 5'-terminus of this base sequence : 243475
gatgaaatcatagtgcctgggggtggagaggatgaccctcagatatgttttccaactcgtgtttttcttctagatgcaggaccccagatgcagagccccagggcatagaggattccagattcttgcaggggactggaggaggctcggctgaaaggagtcagggctgcgagggtaggggacagattcgagtagtttctccatttcacagcaataattactgccccccaccacacacacacacacacacacacacacacatgcacacacatgatatatgcatacacctgtctgtgctgcaagttccccttttgctcagacttagggttttgcagacacttctaaggaaacaaagatgttcccttttatttttgtctacttgctcctgaagc

SEQ ID NO: 23856 - DNA, 452 bp, Homo sapiens
  chr19.fa.O7frz.7699148
  Located on chromosome 19
  Distance between a terminus base of telomere on chromosomal short arm and 5'-terminus of this base sequence : 9878926
  Distance between 3'-terminus of neighbour sequence of sequence listing upward to telomere on chrosomal short arm and 5'-terminus of this base sequence : 352999
cttaataggcattcctcaaaagaagacacacgaatggctaacaggtgtgtgaaaacatgcccaacgtcattaatcatcagggaaatgcaaattaaaaccacagcgagatatgactgtggtgataattttagcatataggtgtatcaaagcatcacatttccttccttctttctttctttctttctttctttctttctttctttctttctttctttctttctttctttctttctttctttctttttctttcctttttttgagacggagtctcgctctgttgcccaggctggagtgcagtggcacgatctcggctcgctgcaacctctgcctcctgggttcacgccattctcctgcctcagcctcccaagcagctaggactacatgcgcccgccaccacacccggctaatttttcgtatttttagtaaagacagggtttcaccatgttagccag

SEQ ID NO: 23857 - DNA, 390 bp, Homo sapiens
  chr19.fa.O7frz.7846308
  Located on chromosome 19
  Distance between a terminus base of telomere on chromosomal short arm and 5'-terminus of this base sequence : 10024394
  Distance between 3'-terminus of neighbour sequence of sequence listing upward to telomere on chrosomal short arm and 5'-terminus of this base sequence : 145016
ctcatccattcatctatccactcatccatccatccatccatccatccatccatccatccatctgctcatccattcatccatccactcatctatccatccatccatccatccatccatccatctacccatccacccacccatctatccatccatccatccatccatccatccatccatccatccacccacccatccacccacccatccatccatccattcatccattcatccatccactcatctatccatccatcctctcatccatccatccatccatccatccatccatccattcaaccacccactcattcacccactcatccgtccatccactcatccatccatccatccatccatccactcatttatccatctatcagtctatccatc

SEQ ID NO: 23858 - DNA, 293 bp, Homo sapiens
  AC008576.6_117929
  Located on chromosome 19
  Distance between a terminus base of telomere on chromosomal short arm and 5'-terminus of this base sequence : 10025297
  Distance between 3'-terminus of neighbour sequence of sequence listing upward to telomere on chrosomal short arm and 5'-terminus of this base sequence : 513
cgtctactcatctatccattcatctacccatccatccattcattcatccatccatttatctgtttaactatccatccatccatccatccatccatccatccatccatccatccatccatccagcaatgacaaggtctgccaggccctgttcttggtgctggggacagtgggaatagcacacacacacaaaaacccctgttgttgaggagcctgcattctagtgggggaggctgacagtgaagaaataagacaatgtataagtcatcaggaggtggtatgtactgctctggaga

SEQ ID NO: 23859 - DNA, 293 bp, Homo sapiens
  AC020954.6_1105
  Located on chromosome 19
  Distance between a terminus base of telomere on chromosomal short arm and 5'-terminus of this base sequence : 10036446
  Distance between 3'-terminus of neighbour sequence of sequence listing upward to telomere on chrosomal short arm and 5'-terminus of this base sequence : 10856
tagcattatccttcgttgaacatgattctttttattttattattattattattattattattattattattattttgagactgagtcttgctctgttgcccaggctggagtgcagtggcacaatctcggctcagtgcaacctccacctcctgggttcaagtaattcttgtgcctcagcctccctagtagctgggattacagacaggtaggtgccaccacacctggctaatttttgtatttttagtagagacggggtttcaccagattggccaggctggtcttgaatgacctca

SEQ ID NO: 23860 - DNA, 262 bp, Homo sapiens
  AC008576.6_106318
  Located on chromosome 19
  Distance between a terminus base of telomere on chromosomal short arm and 5'-terminus of this base sequence : 10103835
  Distance between 3'-terminus of neighbour sequence of sequence listing upward to telomere on chrosomal short arm and 5'-terminus of this base sequence : 67096
tactcaccagtccattaattcatccatccatccatccgaccaccatccactcacccttccaatcaccattcaccaacccaagtatccatccacccattcatctatctatctatctatctatctatctatctatctatctatccattcattatctatctacctatctatccacctacccatcaatccaataatccatccattcatctatccatccagccaaaaaatattcagtaagtatctactgtgtgccaggaactgttct

SEQ ID NO: 23861 - DNA, 284 bp, Homo sapiens
  AC020895.5_126338
  Located on chromosome 19
  Distance between a terminus base of telomere on chromosomal short arm and 5'-terminus of this base sequence : 10144693
  Distance between 3'-terminus of neighbour sequence of sequence listing upward to telomere on chrosomal short arm and 5'-terminus of this base sequence : 40596
accatccagcatttggtaggaaaatcaagtcaaagctggctgggtattgaatgtaggtactcccccaccccccatttttttttaaatctggtttaactatatattttaagtggagtattaggtcatttctgttcaaggttaatattgatatgtgggggtgttgttactgtcacagcattgctagctagtgttgctagcaaacatgattttcttccttccttccttccttccttgctacttccccacccttcctctctttgatcatgtaaataattcctggtcac

SEQ ID NO: 23862 - DNA, 180 bp, Homo sapiens
  DISO7_10007260
  Located on chromosome 19
  Distance between a terminus base of telomere on chromosomal short arm and 5'-terminus of this base sequence : 10303400
  Distance between 3'-terminus of neighbour sequence of sequence listing upward to telomere on chrosomal short arm and 5'-terminus of this base sequence : 158423
tctgattctattcctcatcccctgacctgtttggagagaggctttttgatatagaatagaatagaatagaatagaatagaatagaatagaatagaatagaatagatccaggtgtgtttgtaccagggaagggtaagtctcgttttgtgcaacttttgtttctgtatgatacacatctgga

SEQ ID NO: 23863 - DNA, 151 bp, Homo sapiens
  chr19.fa.O7frz.8198777
  Located on chromosome 19
  Distance between a terminus base of telomere on chromosomal short arm and 5'-terminus of this base sequence : 10414334
  Distance between 3'-terminus of neighbour sequence of sequence listing upward to telomere on chrosomal short arm and 5'-terminus of this base sequence : 110754
tcaggtacgattgtaccactaccctctaacctgggctgcagagtgagatcctatctctctctctctctcacacacacacacacacacacacacacacacacacagacacacaaattgttttaagccattctgtttgtgataatttggtctg

SEQ ID NO: 23864 - DNA, 370 bp, Homo sapiens
  AC010323.6_80371
  Located on chromosome 19
  Distance between a terminus base of telomere on chromosomal short arm and 5'-terminus of this base sequence : 10603115
  Distance between 3'-terminus of neighbour sequence of sequence listing upward to telomere on chrosomal short arm and 5'-terminus of this base sequence : 188630
atcctggctaacatggtgaaaccccgtctctactaaaaaatacaaaaaatcagccgggtggggcggcgggcgcctgtagtcccagctactcgggaggctgaggcaggagaatagcgtgaacccggcaggcggaggttgcagtgagccgagatcactccactgcactccagctgggcgacagagcgagactccgtctctaaataaataaataaataaataaataaataaataaataaataaataaaatatcattcgccactaaaatgaaccagggctcttcggaaaaatggttgagtccaggcctggggcaggcaaaagacaagacaagtcagcctggaagagtttgttgagccagttagtaaggaaatgc

SEQ ID NO: 23865 - DNA, 331 bp, Homo sapiens
  AC010323.6_172052
  Located on chromosome 19
  Distance between a terminus base of telomere on chromosomal short arm and 5'-terminus of this base sequence : 10700452
  Distance between 3'-terminus of neighbour sequence of sequence listing upward to telomere on chrosomal short arm and 5'-terminus of this base sequence : 96967
gtattctgtggattcagtggagtccaggtcagcccagatcctgtgtgtgtgtgtgtgtgtgtgtgtgtgtgtgtgtgtgtgagtggggggaacacataagggcctgaacacccttttgagactatctcaaaaacattatttatttatttatttatttatttatttatttatttttgagacggagccttgctctgtctacctggctggagtgcagtggtgcaatctcggctcactgcaacctctgtctcccgggttcaagcgattctcccgtctcagcctcctgagtacctgggactacaggcctgcactaacacatcaggcgaatttgttt

SEQ ID NO: 23866 - DNA, 331 bp, Homo sapiens; identical to SEQ ID NO: 23865
  AC010323.6_229657
  Located on chromosome 19
  Distance between a terminus base of telomere on chromosomal short arm and 5'-terminus of this base sequence : 10700452
  Distance between 3'-terminus of neighbour sequence of sequence listing upward to telomere on chrosomal short arm and 5'-terminus of this base sequence : -331

SEQ ID NO: 23867 - DNA, 194 bp, Homo sapiens
  DISD22_0011650
  Located on chromosome 19
  Distance between a terminus base of telomere on chromosomal short arm and 5'-terminus of this base sequence : 11231969
  Distance between 3'-terminus of neighbour sequence of sequence listing upward to telomere on chrosomal short arm and 5'-terminus of this base sequence : 531186
gggctcagcgtagaattaacaaggtgtggtgtgtgtgtgtgtttgtgtgtgtgtgtgcatgtgtgtgtgtgtgtatgtgtgtgtatgtgtgtatgtgtgtgtgtgtgtgtatgtatgtgtgtttgttgtgggggggacttggtggcctgagtggggtccagccacctgctctgggggatgtagggactcaggtg

SEQ ID NO: 23868 - DNA, 379 bp, Homo sapiens
  AC008734.5_149117
  Located on chromosome 19
  Distance between a terminus base of telomere on chromosomal short arm and 5'-terminus of this base sequence : 11407080
  Distance between 3'-terminus of neighbour sequence of sequence listing upward to telomere on chrosomal short arm and 5'-terminus of this base sequence : 174917
agcctttggttcacttctagacttctggaaaaattgatttggactattttggccaatgttctcattgattttatgggtattcagaagttgttaccccaacattccagaaatgttctccctgtggctattactttatttatttatttatttatttatttatttgagacggagtctccctctgttgcccaggctggagtgcagtggcgcaatctcagctcactgcaacctccgcttcccaggttcaagcgattctcctgcctcagcctcccaagtagctgggattatggatgtgcaccaccacaccggctaatttttgtgtttttagtagagatggggtttcactgtgttggccaggctggtctcgaactcctgatctcaa

SEQ ID NO: 23869 - DNA, 301 bp, Homo sapiens
  AC008734.5_75702
  Located on chromosome 19
  Distance between a terminus base of telomere on chromosomal short arm and 5'-terminus of this base sequence : 11455661
  Distance between 3'-terminus of neighbour sequence of sequence listing upward to telomere on chrosomal short arm and 5'-terminus of this base sequence : 48202
tgcaacttaattgtatttccaagtacagtacatatgttcagatttctttttctaaccttatttagtgatagaggtgtggtaaactcttccattatgtttatgtattaacactgtaattttgtcatttttatatattttgatgttatgtaactagatgcatacaggattaggtattttcttctgtattcctttttatgtggagatgatatttttacatagcaaagtattgtaatgcattaataataaatggtcaaacatttatttatttatttattttagatggagtttcactcttgtcatc

SEQ ID NO: 23870 - DNA, 344 bp, Homo sapiens
  DISO7_00018832
  Located on chromosome 19
  Distance between a terminus base of telomere on chromosomal short arm and 5'-terminus of this base sequence : 11515535
  Distance between 3'-terminus of neighbour sequence of sequence listing upward to telomere on chrosomal short arm and 5'-terminus of this base sequence : 59573
tctgcagtttcaaggcaggtcctgcagagttgttggtgcagaagccttccccaccatcccaaagggccacaatgcctgaaaccaggggaaatgccagtcctagaacagttctagggtggaccattggccctgagggttggcaagtgtggcttctctaccagaccagggtgggacatgatcacccattagccagaaatcataacttagtggtgaaggggagtctgtttgtgtgtgtgtgtgtgtgtgtgtgtgtgtgtgtgtgtgtgtatgtgtgtgtgtgtgtgtgaagcaaatcttgaatatctattacagtgtttggagatgtgtgaaatgctgatgcaaga

SEQ ID NO: 23871 - DNA, 383 bp, Homo sapiens
  AC011464.5_147742
  Located on chromosome 19
  Distance between a terminus base of telomere on chromosomal short arm and 5'-terminus of this base sequence : 11604848
  Distance between 3'-terminus of neighbour sequence of sequence listing upward to telomere on chrosomal short arm and 5'-terminus of this base sequence : 88969
gtgcctggcttgtagtttaatttttatttatttatttatttatttatttatttatttttggagatgaagtcttgctctgtcacccagtctggagtgcagtggcacaatctcggctcactgcaacccccacctctcaggttcaagcgattcccctgcctcagcctcccaagtagctgggattacaggcgtgcaccatcatgcctggttaatttttgtatttttagtagagatggggtttcgccatgttggccaagctggtcttgaactcctggccttaagtgatctgcctgccttggcctcccaaactgctgggattacaggcgtgagccactgcaccaggccaattaacttctcctaatctgtaactaaggtctgagtcctga

SEQ ID NO: 23872 - DNA, 425 bp, Homo sapiens
  chr19.fa.O7frz.10392910
  Located on chromosome 19
  Distance between a terminus base of telomere on chromosomal short arm and 5'-terminus of this base sequence : 11719041
  Distance between 3'-terminus of neighbour sequence of sequence listing upward to telomere on chrosomal short arm and 5'-terminus of this base sequence : 113810
tatccaggtgaaattacattctacttctttcttctttcttctcttcttctccttctccttctccttgttcttcttcttcttctttttcttcttcttttttgagatggattctcgctcttttgcccaggctggagtgcagtggtgtgatctcagttcactacaacctctgcctcccgggttcaagcaattctcctgcctcagcctcctgagtagctgggactacaggcacccaccaccatgcttggctaatttttgcagttttagtagagacggggtttcaccatgttggctaggctggtctcaaactcctgaccttgtgatccacctgcctcagcctcccaaagtgctgggattacaggcgtgagccaccgcacctggccacatctctcttcttgtatacagttaagtcctcacataatgttgat

SEQ ID NO: 23873 - DNA, 233 bp, Homo sapiens
  AC006271.1_90041
  Located on chromosome 19
  Distance between a terminus base of telomere on chromosomal short arm and 5'-terminus of this base sequence : 11806489
  Distance between 3'-terminus of neighbour sequence of sequence listing upward to telomere on chrosomal short arm and 5'-terminus of this base sequence : 87023
attgcaagatgagtggatttaggttttcaaggaaggaaagaggaagggagggagggaaggaggaaggaagggaaggaaggaaagaaggaaggaaggaaaggaagaaaggaaggaaggaaggaaggaaggaaggaaggaaggaaggaaggaaggaagggttacttgttgccttaagtcccacttggaattatggtggcagccaaattctgattcaaataggtcatgacattacc

SEQ ID NO: 23874 - DNA, 449 bp, Homo sapiens
  AC008567.4_33847
  Located on chromosome 19
  Distance between a terminus base of telomere on chromosomal short arm and 5'-terminus of this base sequence : 11972814
  Distance between 3'-terminus of neighbour sequence of sequence listing upward to telomere on chrosomal short arm and 5'-terminus of this base sequence : 166092
agtacagaccagatgaaaccagaaggggtaaaactagtaaacttactgcctgcttggtggtactttgaacgctgatttttttttccatctccctgctgctatttacttttcagattcttcaaatagctgatgcattctgtccaggtgggacattcagtgggacagacaggataactgcatttactccacctttccctaaaccagaaccaattttgccaagtcatacacacacacacacacacacacacacacacacacacacacacataaaatataggatgcattctcttgttacttctggtttctttcacaacatcatgtttgtgagattcatccacgttagggggtttacctgtatagtaggcagaattctgagatggtgcttatgagtcctgcactctggtatgccttggtataatcccctcctgttgagtgttggtaggataaac

SEQ ID NO: 23875 - DNA, 419 bp, Homo sapiens
  chr19.fa.O7frz.10797723
  Located on chromosome 19
  Distance between a terminus base of telomere on chromosomal short arm and 5'-terminus of this base sequence : 12049378
  Distance between 3'-terminus of neighbour sequence of sequence listing upward to telomere on chrosomal short arm and 5'-terminus of this base sequence : 76115
tcttacatttagcagaccaaagattgaaaagaggccaggtgtggtggctcatgcctgtaatcccagcactttgggaagccaaggtgggcagatcacttcagaccatgagttcgagaccaccctgaccaacatgatgaaaccccagctctactaaaaatacaaaaattagctgagcatggtggtacgtgcctgtaatcctagctactccagaggctgagagaggagaaatgcttgaacccaggaggcagaggttgcagtgagccaagatcatgccattgtactcaagcctgggcaacagagggagactgtgtctcacacacacacacacacacacacacacacacacacacacactacacagacagaaaacatttcattccttacattcataaggtttctttccattgtaactctgaaca

SEQ ID NO: 23876 - DNA, 244 bp, Homo sapiens
  D19S586
  Located on chromosome 19
  Distance between a terminus base of telomere on chromosomal short arm and 5'-terminus of this base sequence : 12220705
  Distance between 3'-terminus of neighbour sequence of sequence listing upward to telomere on chrosomal short arm and 5'-terminus of this base sequence : 170908
ttcctaagcatgaatttttacctatcatctatctatctatctatctatctatctatctatctatctatctatctatctatctaatctgtttatttatttctatataaagacagggtcccactgtgtcacacaggcacaatcgctgcttactgcaccttcgatctcctgggctgaagttcccctcccaccccagcctcctgagtagctggaattacaggcatgagccactgcacactgcttacac

SEQ ID NO: 23877 - DNA, 293 bp, Homo sapiens
  DISO7_00003939
  Located on chromosome 19
  Distance between a terminus base of telomere on chromosomal short arm and 5'-terminus of this base sequence : 12377966
  Distance between 3'-terminus of neighbour sequence of sequence listing upward to telomere on chrosomal short arm and 5'-terminus of this base sequence : 157017
acagattgatcctggcctgggaaatgttagtctgcctgcccatccttgtttgtaacaaaagccacaaactcaaaaggagctctgagcgtgtgtgtgtgtgtgtgtgtgtgtgtgtgtgtgtgtgtgatctctctgaggacctgatacagatgtgatggacacacccacacccagccctaatctcggtgtgaggatgtggctccccagcactcagcatagtgtggacacagattgtggacctcagcagcctcaattctccaccttactttaggagaatccagtatctaaggccg

SEQ ID NO: 23878 - DNA, 233 bp, Homo sapiens
  D19S583
  Located on chromosome 19
  Distance between a terminus base of telomere on chromosomal short arm and 5'-terminus of this base sequence : 12474462
  Distance between 3'-terminus of neighbour sequence of sequence listing upward to telomere on chrosomal short arm and 5'-terminus of this base sequence : 96203
atgtgcacaaaagacacacgctgtggccgggtgcagtggctcatgcctgcaatcccagcactttgggaggccaaggcgggaggatgggttgagcccaagagttccagaccagcctgggcaacagggcaagacctcctctctataaaataataataataataataataataataataataataataataaaactacctggtcatggtgatttgcgccttctatttgggaggatg

SEQ ID NO: 23879 - DNA, 214 bp, Homo sapiens
  AC010077.1_39262
  Located on chromosome 19
  Distance between a terminus base of telomere on chromosomal short arm and 5'-terminus of this base sequence : 12707351
  Distance between 3'-terminus of neighbour sequence of sequence listing upward to telomere on chrosomal short arm and 5'-terminus of this base sequence : 232656
aggaaaggataatttaagtagcagtgaatgtaaacaagtgtcagagaacaaggaaacacatgtgtttccttcatcatcatcatcatcatcatcatcatcaggcaatgaggacagctggggatcttgctgcctccctggtcacagacaagttactaggaggagacatttttctagaggctaggatgctgagaactgacttacctcggataattct

SEQ ID NO: 23880 - DNA, 369 bp, Homo sapiens
  AC011511.7_144999
  Located on chromosome 19
  Distance between a terminus base of telomere on chromosomal short arm and 5'-terminus of this base sequence : 12728235
  Distance between 3'-terminus of neighbour sequence of sequence listing upward to telomere on chrosomal short arm and 5'-terminus of this base sequence : 20670
agccaagtctttctacttatccacgctcctgctaccccagcccaaactgccatcatcactcacctggacttcattctagaagcctcctccctgacctcccagctgccctggagagtcccttccaaacgcttcggctagaaagctttattttatttatttatttatttatttatttatttagagacagagtcttactctgtcacccaggctggagtgcagtggcacaatctcagcccactgcaacctctgcctcccggattcaagcagttcacctgcctcagcctcccaagtagctggaattacaggcacttgccaccatgcccggctaatttttgtatttttagtaaatacaaggcttcaccatgttag

SEQ ID NO: 23881 - DNA, 191 bp, Homo sapiens
  AF069489.1_6169
  Located on chromosome 19
  Distance between a terminus base of telomere on chromosomal short arm and 5'-terminus of this base sequence : 12986156
  Distance between 3'-terminus of neighbour sequence of sequence listing upward to telomere on chrosomal short arm and 5'-terminus of this base sequence : 257552
ggatcaagcatctgaaatgtagctgtgtctttggatatgggtctgaggatgtttctgcaatggtgtgtgtgtgtgtgtgtgtgtgtgtgtgtgtgtgtgtgtgtatttttgcatctgtgagtatatttccttatggatttgtcgggatatgtttgtgtccaagggcagtggatatttgcaatggttggaaa

SEQ ID NO: 23882 - DNA, 258 bp, Homo sapiens
  HUMUT5187
  Located on chromosome 19
  Distance between a terminus base of telomere on chromosomal short arm and 5'-terminus of this base sequence : 13119343
  Distance between 3'-terminus of neighbour sequence of sequence listing upward to telomere on chrosomal short arm and 5'-terminus of this base sequence : 132996
tcgagactacagtgagctgtggtcatactactgcactccagcccgagcaacagagtgagaccctgtcaaaaaaagaaagaagaaaagaaagaaagaaagaaggaaagaaggaaagaaggaaagaaagaaagaagaaaaaaagaaagaaagaaagaaagaaagaaagaaagaaagaaagaaagaaagaaagaaagaaagaaagaaagaaagatgacagttcatatgattgtgcctggtagtcaggaagacacccataat

SEQ ID NO: 23883 - DNA, 281 bp, Homo sapiens
  HUMUT8091
  Located on chromosome 19
  Distance between a terminus base of telomere on chromosomal short arm and 5'-terminus of this base sequence : 13425870
  Distance between 3'-terminus of neighbour sequence of sequence listing upward to telomere on chrosomal short arm and 5'-terminus of this base sequence : 306269
cagcctgggcgatagagagagaatgtcgaaagaaagagaaaggaaggaaggaaagaaagaaaggaaggaaggaaggagagaagagaagagaaggaaagaaagaaagagaaagaaagaaagaaagacagaaagaaagaaagaaagacagacagaaagaaagaaagacagacagacagacagaaagaaagaaagaaagaaagaaagaaagaaagaaagaaagaaagaaattttaggatattatactaattaaaatcagccagccccaggtgcagtggtttaca

SEQ ID NO: 23884 - DNA, 95 bp, Homo sapiens
  D19S914
  Located on chromosome 19
  Distance between a terminus base of telomere on chromosomal short arm and 5'-terminus of this base sequence : 13557224
  Distance between 3'-terminus of neighbour sequence of sequence listing upward to telomere on chrosomal short arm and 5'-terminus of this base sequence : 131073
ttgggacacacaatcctcccccagattctgaacgtatacacacacacacacacacacacacacacacacacacacacaaccactccaccaagaaa

SEQ ID NO: 23885 - DNA, 199 bp, Homo sapiens
  D19S221
  Located on chromosome 19
  Distance between a terminus base of telomere on chromosomal short arm and 5'-terminus of this base sequence : 13786141
  Distance between 3'-terminus of neighbour sequence of sequence listing upward to telomere on chrosomal short arm and 5'-terminus of this base sequence : 228822
catagagatcaatggcatgaaattgaaattccagaaataggcccatatatgtgtgtgtgtgtgtgtgtgtgtgtgtgtgtgtgtgtgtgtgtgtgtgtatatagtgaactgagtttcaaaaacggtgccaggaatcgggaaataatattattttctttttttacttttttcttttttttttgttgagtcagagtcttgc

SEQ ID NO: 23886 - DNA, 362 bp, Homo sapiens
  chr19.fa.O7frz.14469893
  Located on chromosome 19
  Distance between a terminus base of telomere on chromosomal short arm and 5'-terminus of this base sequence : 14049126
  Distance between 3'-terminus of neighbour sequence of sequence listing upward to telomere on chrosomal short arm and 5'-terminus of this base sequence : 262786
ggtcactgattgacatttaaacattagtcccttcaccagaatgaagtgtcctgtggaaagcacactgtaaacatcacaacgagatgtcctggagccccatcatggcagcactagagttcatagccaaactcctgagagaccccactgccaaactggaggaaaatacatgtgcatggctgcctgcaacagaggtagtggggagaagtccagctggtcctatgctgaatgttgaaatggccacaattaaccacagtttaccatccaaatcattttctggaattttcaaggcttcaatagactgtagtgtgttgttttgttttgttttgttttgttttgttttgagatggagtctcagtcttgtt

SEQ ID NO: 23887 - DNA, 417 bp, Homo sapiens
  chr19.fa.O7frz.14983740
  Located on chromosome 19
  Distance between a terminus base of telomere on chromosomal short arm and 5'-terminus of this base sequence : 14090174
  Distance between 3'-terminus of neighbour sequence of sequence listing upward to telomere on chrosomal short arm and 5'-terminus of this base sequence : 40686
aagtgctaggtgataggatatctctctttctctctctctctctctctctctctctctgtgtgtgtgtgtgtgtgtgtgtgtgtctttgtgtgatttttgaaggcaagagtatcatttatttgttagctataatcagatatcatttcttttccttattttccaaacatgcccatttttcctgtctggaaacactaccatttttacaaattgaataaagattttatttcatcgaatgacacctgatgtttgactcctttcttttttagccattagttccagcttccagttcatggtggttttaggttttctacttttgcttcatagaaatatggggaaaccctcatgttttcaaattcattccctaatgtttcggcttccgattggagcttttaagtcattaacatttaaagtcttgaa

SEQ ID NO: 23888 - DNA, 398 bp, Homo sapiens
  chr19.fa.O7frz.12008971
  Located on chromosome 19
  Distance between a terminus base of telomere on chromosomal short arm and 5'-terminus of this base sequence : 14210619
  Distance between 3'-terminus of neighbour sequence of sequence listing upward to telomere on chrosomal short arm and 5'-terminus of this base sequence : 120028
atgtatgaaactgaacatggatgtctgtctacaagtgtttctttgtatttgcaaggatgtttgcaaaaatgtcagccctgggtgctaggatttgggacttctttttccgtgtgtgtgtgtgtgtgtgtgtgtgtgtgtgtgtgatttgcttgaagttttatactgtttacaatgagcacatagcattttttattaaaaaaacaaacagttttttaaaatcagaggagcaagaccaaatgcagtggctcacgcctataatccgtgggaggccaagggggcctgatcacttgagcccaggagttcaagaccagcctgggcaacatggtgaaaccccatctctactaaaaatacaaaaattatccaggtgtggtggcatgtgcctgtagtcctagctactt

SEQ ID NO: 23889 - DNA, 154 bp, Homo sapiens
  chr10.fa.O7frz.99111235
  Located on chromosome 19
  Distance between a terminus base of telomere on chromosomal short arm and 5'-terminus of this base sequence : 14369677
  Distance between 3'-terminus of neighbour sequence of sequence listing upward to telomere on chrosomal short arm and 5'-terminus of this base sequence : 158660
aaagtgctaggattacaggaatgagccaccacgcccagcgcaatcttaggtggattttctccattttacttgtactcgtgtgtgtgtgtgtgtgtgtgtgtgcgcgcgcgcgcgcgtgtgtagtaaattgtatacaatttgcttcctatgtagg

SEQ ID NO: 23890 - DNA, 298 bp, Homo sapiens
  DISO7_10002941
  Located on chromosome 19
  Distance between a terminus base of telomere on chromosomal short arm and 5'-terminus of this base sequence : 14477360
  Distance between 3'-terminus of neighbour sequence of sequence listing upward to telomere on chrosomal short arm and 5'-terminus of this base sequence : 107529
cttgcctaatccagagcagggtgttttatggcccatgccaggctgtttaaaaaggttttatgaggccaggtccagtggctcacacctgtaatcccagcactttgggaaactgaggcaggaggctcacttgagcctgggaggtcgaggctgcagtgagccgtgatagcaccactgcactccagcctgggcaacagagcaagaccctgtctttaaaaaaaaaaaaaaaaatatatatatatatatatatatatatatatatatatatgaaagagcaaagatctttcacagtcaggaagaa

SEQ ID NO: 23891 - DNA, 425 bp, Homo sapiens
  AC020561.3_8580
  Located on chromosome 19
  Distance between a terminus base of telomere on chromosomal short arm and 5'-terminus of this base sequence : 14680288
  Distance between 3'-terminus of neighbour sequence of sequence listing upward to telomere on chrosomal short arm and 5'-terminus of this base sequence : 202630
atttgaggttgaatcagacaaggccgtggctctgcctcagggcctttgcacgtgctgttctcattcccatctatgggttgctggcattttatcctctattatttatttatttatttatttatttatttatttatttatttatttattttgaggtggcatttcgctcttgttgcccagactggagtgcaatggcacaatctcggctcaccgcaacctctgcctcccaggttcaagcgattctcctgcctcagcctcccgagtagctgggattacaggcacccaccatcacacctggctaattttttgtatttttagtagagacggggtttcaccatgttggccaggctggtctggagctcctgacctcaggtgatccacccgcctcggcctcccaaagtgccgggattacaggaatgagccacatg

SEQ ID NO: 23892 - DNA, 271 bp, Homo sapiens
  AC020561.3_172996
  Located on chromosome 19
  Distance between a terminus base of telomere on chromosomal short arm and 5'-terminus of this base sequence : 14731859
  Distance between 3'-terminus of neighbour sequence of sequence listing upward to telomere on chrosomal short arm and 5'-terminus of this base sequence : 51146
gagcttgtagtgagccaagatccgccactgcactccagcctgggcgacagagggagacttcatctcaaaaataaataaataaataaataaataaaataataataaataaaaaataagtggagacgaatgcactgtaaccacagtggctccaacttagcccaggcggttcttcagccatctgtaaaaccctgcccctcgcctttctggaacaggatgctccccttgtccccgtaactccagtatgattctggtttggaggtctctagcattg

SEQ ID NO: 23893 - DNA, 273 bp, Homo sapiens
  AC020561.3_124319
  Located on chromosome 19
  Distance between a terminus base of telomere on chromosomal short arm and 5'-terminus of this base sequence : 14800947
  Distance between 3'-terminus of neighbour sequence of sequence listing upward to telomere on chrosomal short arm and 5'-terminus of this base sequence : 68817
atgtacctactgattttatcgcagaaatcagcatctcttcccagcctggaaataaataaaaattattttctctctctctctctctctctctctctctctctctcctttccttccttccttccttccttccttccttccttccttccttccttccttccctccttccctccttccccctctctctctctgtctcagggtgttgctctgtcacccaggctggagtgcagtggcacaatcatagctcactgcagcctctggactgaagcaatcttc

SEQ ID NO: 23894 - DNA, 249 bp, Homo sapiens
  AC020561.3_41524
  Located on chromosome 19
  Distance between a terminus base of telomere on chromosomal short arm and 5'-terminus of this base sequence : 14817142
  Distance between 3'-terminus of neighbour sequence of sequence listing upward to telomere on chrosomal short arm and 5'-terminus of this base sequence : 15922
acagtgagccgagatcactccactgcactccagcctgggaaacagagccagactctgtctcaaaaataaataaataaataaataaataaataaataaataaataaataaaataaagtcagggtcagactggggtcaggtcaccattggggtcaatggttagggtcacagttatatagaaagaaaggacacagttgtcatagtcaagctggacagtcaaacataaaagttggagtcagttactcagaact

SEQ ID NO: 23895 - DNA, 373 bp, Homo sapiens
  chr19.fa.O7frz.14886353
  Located on chromosome 19
  Distance between a terminus base of telomere on chromosomal short arm and 5'-terminus of this base sequence : 15287085
  Distance between 3'-terminus of neighbour sequence of sequence listing upward to telomere on chrosomal short arm and 5'-terminus of this base sequence : 469694
caggaattcaacatcagtttaggcaacacagtgagaacctccatctctacagaaaaatttaaaaattagccagcagtggtggtgcacgcctgtagtcccagctactcaggaggctgaggtgagaggactgcttgagaccaggagtatgagaatgcagcaagctatgatgggtgccaatgcactccaacctgggcaaaagaggaagaccctgtctcaagataaacatagatagatagatagatagatagatagatagatagatagatagatagatagatagattcagttatgtgaagccataatgaagagtgattctccctatttctctgagctttttctccctgtagccttctcaaggctacactctaggatt

SEQ ID NO: 23896 - DNA, 315 bp, Homo sapiens
  AC012618.4_92339
  Located on chromosome 19
  Distance between a terminus base of telomere on chromosomal short arm and 5'-terminus of this base sequence : 15343656
  Distance between 3'-terminus of neighbour sequence of sequence listing upward to telomere on chrosomal short arm and 5'-terminus of this base sequence : 56198
aacatagtgaaaccctgtctctactaaaagtacaaaaattagccggctggggtggtggccacctgtaatcccagctactcgggaggctgaagcaggagaatcacttgaacctgggaggcagaggttgcagtgagctgagactgcaacactgcactccagcctgggcaacagagcaagaccttgtctctaaaataacataacataacataacataacataacataacataacataacataacataacaacataacataacataaatacagtagagtagagtagagtagaatttccaacaaagtcctttgaaccatt

SEQ ID NO: 23897 - DNA, 370 bp, Homo sapiens
  AC008543.7_39406
  Located on chromosome 19
  Distance between a terminus base of telomere on chromosomal short arm and 5'-terminus of this base sequence : 15655464
  Distance between 3'-terminus of neighbour sequence of sequence listing upward to telomere on chrosomal short arm and 5'-terminus of this base sequence : 311493
ctcctagctacctgttctgtaaacaaccttcccgcttttgccgcgcccagacaagtccagatacgccttcccgcctagtaacggacagtccctgttccttcccgtctcatagaccctatttaatttgtgtgtgtgtgtgtgtgtgtgtgtgtgtgtgtgtgtgtgtgacggagttgcccagttgtctcgctctgttgcccaggctggagtacagtggtgcgatctcggctcactgcaagctccacctcccgggttcacgccattctcctgcctcagcctcccgagtagctggaactacaggcgcccgccaccatacccagttaatttttttgtatttttagtggagacggggtttcaccgtgttagccag

SEQ ID NO: 23898 - DNA, 158 bp, Homo sapiens
  D19S906
  Located on chromosome 19
  Distance between a terminus base of telomere on chromosomal short arm and 5'-terminus of this base sequence : 15655531
  Distance between 3'-terminus of neighbour sequence of sequence listing upward to telomere on chrosomal short arm and 5'-terminus of this base sequence : -303
ttcccgcctagtaacggacagtccctgttccttcccgtctcatagaccctatttaatttgtgtgtgtgtgtgtgtgtgtgtgtgtgtgtgtgtgtgtgtgacggagttgcccagttgtctcgctctgttgcccaggctggagtacagtggtgcgatct

SEQ ID NO: 23899 - DNA, 324 bp, Homo sapiens
  chr19.fa.O7frz.15379036
  Located on chromosome 19
  Distance between a terminus base of telomere on chromosomal short arm and 5'-terminus of this base sequence : 15921429
  Distance between 3'-terminus of neighbour sequence of sequence listing upward to telomere on chrosomal short arm and 5'-terminus of this base sequence : 265740
gctggtcttgaacttctgacctcgtgatccacctgcctcggcctcccaaagtgctgggattacaggcatgagccactgcacccggccacaaataccttttcaaacacacacacacacacacacacacaaatatgcaccaatgcgtgcttccccctccttgccacagggataaaaaggcaaacatgccgacatttgctgacacacacaaagacatacatggccgcacacacggatacacccgctctcagacacgcagcgacctacgcccattttcctggccatacaagcagccgaacgttcctgtacttctgtatctgcatagct

SEQ ID NO: 23900 - DNA, 332 bp, Homo sapiens
  chr19.fa.O7frz.15700680
  Located on chromosome 19
  Distance between a terminus base of telomere on chromosomal short arm and 5'-terminus of this base sequence : 16242172
  Distance between 3'-terminus of neighbour sequence of sequence listing upward to telomere on chrosomal short arm and 5'-terminus of this base sequence : 320419
tagttcctgaaactctcaaagatgtgtccagatctgcaggtctccaaagggcttggccaaaagaaataagacccttgggaccttgggggacaggggggatgttccacagatcgagagagagagagagagagagagagagagagagagagaaaccacagcaggtagaaggtccccagcccccactcctgctggagccacactgaaaacctggcttaatcaccaaccagcagatgaccttgggcaagccaccttggtaaactggagacaaccacacttcctacctcaaagggccatccaaaggcataaatgaattaatacatcttagcgtgatg

SEQ ID NO: 23901 - DNA, 413 bp, Homo sapiens
  chr19.fa.O7frz.15789058
  Located on chromosome 19
  Distance between a terminus base of telomere on chromosomal short arm and 5'-terminus of this base sequence : 16290329
  Distance between 3'-terminus of neighbour sequence of sequence listing upward to telomere on chrosomal short arm and 5'-terminus of this base sequence : 47825
ctgaggaattcggttataaatacattttaaaattaacccactgcctgggtgtctgtatatatctgtctcttactcacacgtcttatatttttaatcgtgagctagcttttcagtctttctcctaaatcgaggcttcctcccctctggtggcaccacccacatctgtcccctcaaaaccccactcggacccaagccaaccccatggcctcttctcctttagctagtctagggtagaaaaacataaaataaaacttcacagaaacctaggatccaggagtcctggtttctctgctcacggctgatttttccaagaggccctgccccatattcattctctctctctctctctctctctctcgcatttccgcctgggtgacgaggccaggagcagaaatagctctgcctcaattaac

SEQ ID NO: 23902 - DNA, 413 bp, Homo sapiens
  AC017030.4_59540
  Located on chromosome 19
  Distance between a terminus base of telomere on chromosomal short arm and 5'-terminus of this base sequence : 16477830
  Distance between 3'-terminus of neighbour sequence of sequence listing upward to telomere on chrosomal short arm and 5'-terminus of this base sequence : 187088
aatgtctcagttctgatttctgacttaatcaatggtgaaaattgagttatgggggaagaagcagaggaaggagtgaaatgcaaaaattcattcattcattcagtcagtcagtcagtcagtcagtcagtgtcaggctctgttctcagccctgagactacaagaacgaccaaaacaaaaatctgtgccctggaaatgaacaggcagagttcagaatatctacttgtatcagaaaacaaggaaaacgcctttaaagactaaaggagtgtttttgtcagatgaacatgggaacgaactgaaagaggctctccctagtcaaaatggggaccataacattctcttctgttagtcaaaagcctgtgtcataaaaaccttgcttacagatgttcaacgtaatttcttacagctccaatcag

SEQ ID NO: 23903 - DNA, 204 bp, Homo sapiens
  D19S840
  Located on chromosome 19
  Distance between a terminus base of telomere on chromosomal short arm and 5'-terminus of this base sequence : 16507608
  Distance between 3'-terminus of neighbour sequence of sequence listing upward to telomere on chrosomal short arm and 5'-terminus of this base sequence : 29365
gccctaactgctgtaagagaacttcttaccacttgatttgacatctcctgaatcaagacttgctgtatgacaaagaacttttaatttttttctaactgtatctgattttatatatgtatgtatgtatgtgtgtgtgtgtgtgtgtgtgtgtgtgtgtgtatatatttgttttgttttgttttgttttagacagtcttggcctat

SEQ ID NO: 23904 - DNA, 344 bp, Homo sapiens
  chr19.fa.O7frz.16333489
  Located on chromosome 19
  Distance between a terminus base of telomere on chromosomal short arm and 5'-terminus of this base sequence : 16599393
  Distance between 3'-terminus of neighbour sequence of sequence listing upward to telomere on chrosomal short arm and 5'-terminus of this base sequence : 91581
caggttttcaccatgtcagccgggatggtctcaatctcctgacctcgtgatccacccacctcagcctcccaaagtgctgggattacaggcatgagccaccacacccggcctagtttaaaaattttttttgtaatgatgggatctcattacattgcccaggttggtctcaaattcctggcctcaagcgaccctctcgccttggcccatctctttaaaacacacaaacacacacacacatacacacacacacacacacacacacacacacacacacacacacagtttggagtgtttttccagaatatttagaaagaacagcctgtaagagccaagatttagacaac

SEQ ID NO: 23905 - DNA, 294 bp, Homo sapiens
  chr19.fa.O7frz.16625201
  Located on chromosome 19
  Distance between a terminus base of telomere on chromosomal short arm and 5'-terminus of this base sequence : 16855513
  Distance between 3'-terminus of neighbour sequence of sequence listing upward to telomere on chrosomal short arm and 5'-terminus of this base sequence : 255776
cacttgatatttccattggaccccacgagtctaaagaatcttaaaggccgggcagggtggctcatgcctgtaatcccagcactttgggaggccgaagcgggaggatagcttaagccaggagttcgagaccagcctggtcaacataggaagaaccccccccttctctacaataataataataatataataataataataaaataggggcatcgtcgctgcctgtactcccagctgcttaggaggccgaagtgggaggatcacttgaacccaggagttagagtttgcagaagttgg

SEQ ID NO: 23906 - DNA, 435 bp, Homo sapiens
  chr19.fa.O7frz.16724719
  Located on chromosome 19
  Distance between a terminus base of telomere on chromosomal short arm and 5'-terminus of this base sequence : 16957962
  Distance between 3'-terminus of neighbour sequence of sequence listing upward to telomere on chrosomal short arm and 5'-terminus of this base sequence : 102155
cagtaattgagtaatcggtgagggtgggcgggcaggcttggggcactaatagtggcgtgtgcaggatcctagggccggcatagggccgagccgggtaattagttgtttttaaataaacgtcagcgggcatgctttaattaagccttcttcccagtgagagcctcgaagatgtaatcacagagagagagagagagagagcgagagagagacagagagaggagcatcggctcaccaagaaggcctgtcctggtcccaggggccacagcgggatggcccctaccaacctggcccagccgacttgttggaggtaagaggatggtccaggggcctcttggtggcactggggtgtgtgttacccctgagtcttccactggcctgctccagctgaggtctggggcggggcagggggctgtaattctttactgagtgatcagg

SEQ ID NO: 23907 - DNA, 192 bp, Homo sapiens
  chr19.fa.O7frz.16944681
  Located on chromosome 19
  Distance between a terminus base of telomere on chromosomal short arm and 5'-terminus of this base sequence : 17156549
  Distance between 3'-terminus of neighbour sequence of sequence listing upward to telomere on chrosomal short arm and 5'-terminus of this base sequence : 198152
gttgcacttcattcttactgagtgcacgtgtgtgtgtgtgtgtgtgtgtgtgtgtgtgtgtgtgtgtatgcagcgcccctgggtctgtgtttttattgcactttcctgctggcttccagctgcaccgccagttccggggagggccctgggccagcggctgtccgccccccctccttcataaagtcctggcct

SEQ ID NO: 23908 - DNA, 140 bp, Homo sapiens
  D19S892
  Located on chromosome 19
  Distance between a terminus base of telomere on chromosomal short arm and 5'-terminus of this base sequence : 17281249
  Distance between 3'-terminus of neighbour sequence of sequence listing upward to telomere on chrosomal short arm and 5'-terminus of this base sequence : 124508
ttccagtcacaccaggcctgtgtgtgtgtgtgtgtgtgtgtgtggatggccctgtgggggagtggttcccagatctccagcctaggggcctcttccccgggccttggctccaggagcccctccctgcgccctaacaagct

SEQ ID NO: 23909 - DNA, 243 bp, Homo sapiens
  D19S226
  Located on chromosome 19
  Distance between a terminus base of telomere on chromosomal short arm and 5'-terminus of this base sequence : 17297897
  Distance between 3'-terminus of neighbour sequence of sequence listing upward to telomere on chrosomal short arm and 5'-terminus of this base sequence : 16508
ccagcagattttggtgttgtctagccagcccccacaagcatgtaagccaattccttgaaataaatctctgcacacaaacacagacacacacacagacacacacacacacacacacacacacacacacacacacacacacacactcctactggctctggctctgtgtctttggtaaaatcctgactgatacaggaactatgcaagtgagtctgaggacagttgctttagttcaaatcctggacc

SEQ ID NO: 23910 - DNA, 106 bp, Homo sapiens
  DISD22_0011675
  Located on chromosome 19
  Distance between a terminus base of telomere on chromosomal short arm and 5'-terminus of this base sequence : 17371070
  Distance between 3'-terminus of neighbour sequence of sequence listing upward to telomere on chrosomal short arm and 5'-terminus of this base sequence : 72930
gtacaggcaaatccatcttggggggaagcccctggacctcacacaaacacacacacacacacacacacacacacacacacacatttttctccggagtttggattca

SEQ ID NO: 23911 - DNA, 338 bp, Homo sapiens
  AC005327.1_24816
  Located on chromosome 19
  Distance between a terminus base of telomere on chromosomal short arm and 5'-terminus of this base sequence : 17617198
  Distance between 3'-terminus of neighbour sequence of sequence listing upward to telomere on chrosomal short arm and 5'-terminus of this base sequence : 246022
aagtacttaccgagaaagacgagaaagacgcggcctcccatggttccagctgagctgccggcaggagcagcaggggaaagagtgagtgggacagggctgtcccgtctccgcaggctgggcagctgtgcgggctgtcccgaggccaggactttataaaggagggggggcggacagccgctggcccagggccctccccggaactggcggtgcagctggaagccagcaggaaagcacaataaaaacacagaaccaggggcgctgcacacacacacacacacacacacacacacacacacacacgtgtactcgctcagcaagaatgaagtgcaacctgcttt

SEQ ID NO: 23912 - DNA, 323 bp, Homo sapiens
  AC002988.1_27163
  Located on chromosome 19
  Distance between a terminus base of telomere on chromosomal short arm and 5'-terminus of this base sequence : 17721769
  Distance between 3'-terminus of neighbour sequence of sequence listing upward to telomere on chrosomal short arm and 5'-terminus of this base sequence : 104233
caattctggttcctcagaaagtcccagaagaacaaattctgaaatccctgtgtcattctctggttccatctttttttttctatttatttatttatttatttatttatttatttatttattaacatagacagggtctctcactctgttgccaacgctggtctgaacctcctggactcatgcgatcctcccacttcagcctacaaaagtgctgagattataggcataagccattgtgcccaggcttggttgcatcttttcaatgtgactaccaaaaagagagagaatatgacaatgtaattatgcattacaaacctatcagaaat

SEQ ID NO: 23913 - DNA, 255 bp, Homo sapiens
  D19S415
  Located on chromosome 19
  Distance between a terminus base of telomere on chromosomal short arm and 5'-terminus of this base sequence : 17855681
  Distance between 3'-terminus of neighbour sequence of sequence listing upward to telomere on chrosomal short arm and 5'-terminus of this base sequence : 133589
gggtcatggtatgctccatgtgtgtatacattgtgtgtgtgtgtgtgtgtgtgtgtacatgcatgcacgcatgcctttagagtgagaggaggtttcagagaaagggagctttggctctatgttccaaaaggtaactcatcacacagaggccagaactcaaggcaacagtaacagtagcaaacaaagaagaaatgcattgcaattcatgtgacactgtttgcagccaaattagcaaagtgccaatgcaacaacatc

SEQ ID NO: 23914 - DNA, 411 bp, Homo sapiens
  AC004659.1_92832
  Located on chromosome 19
  Distance between a terminus base of telomere on chromosomal short arm and 5'-terminus of this base sequence : 17937216
  Distance between 3'-terminus of neighbour sequence of sequence listing upward to telomere on chrosomal short arm and 5'-terminus of this base sequence : 81280
aggacaagtattgtatgattcaacttatatgagatacatagaatagccaaagcaaagacaaaaagtagaacattggttaccagggactgcagagttgcaaggagaatggggagttattgtttgatgggcactgagtttcatctggggaagacggatgaaggtaatggttgcacaacaatgggattgtacttaatgccactgaactgtacacttagaaatatatacattagaatcctgccaattggtcagtttgttctcctcctcctccttctccttccccttctttctttcctcctcctcctcctccctctcctcctcctctttcttcttcttcttcttcttcttcttcttcttgttcttcttcctcttcttcttcttcctctcattgtaccttaagccgttacttctatc

SEQ ID NO: 23915 - DNA, 258 bp, Homo sapiens
  D19S929
  Located on chromosome 19
  Distance between a terminus base of telomere on chromosomal short arm and 5'-terminus of this base sequence : 18034631
  Distance between 3'-terminus of neighbour sequence of sequence listing upward to telomere on chrosomal short arm and 5'-terminus of this base sequence : 97004
tgatttggtggatattagcctctctctctctctctctctctctctctcacacacacacacacacacacacacacacacacacgcacatacacacatacgctccctctcccttcatgaattaatgctctggccagttttggcagaatggaagaaatttccatccatcccctctttcttttcatctgttcatttttttcttatttgtttactcagcaaattctctccaacaccacctctgtgctccctgccacactgttg

SEQ ID NO: 23916 - DNA, 287 bp, Homo sapiens
  AC004257.1_30552
  Located on chromosome 19
  Distance between a terminus base of telomere on chromosomal short arm and 5'-terminus of this base sequence : 18207985
  Distance between 3'-terminus of neighbour sequence of sequence listing upward to telomere on chrosomal short arm and 5'-terminus of this base sequence : 173096
caaggttcagctccaagactgcttcctccagggagccttccctcccttcccccaggtaagtgctcctccccagttgctcattccaccagggcctgatcacaccctgctggcagtgtcagagcccggctttgtcttccaccacccctcctagaactggtggcagggacagatgaatggatgaatgaatgaatgggaagtgagaattctactactggaccatcaatgcagccctcggaatgagtgagtgagtgagtgagtgagtgagtgagtgatggaaagtggtctgg

SEQ ID NO: 23917 - DNA, 455 bp, Homo sapiens
  chr19.fa.O7frz.19300934
  Located on chromosome 19
  Distance between a terminus base of telomere on chromosomal short arm and 5'-terminus of this base sequence : 18326448
  Distance between 3'-terminus of neighbour sequence of sequence listing upward to telomere on chrosomal short arm and 5'-terminus of this base sequence : 118176
ttcgtatacatttcatgagtcacaaaatgtcattattttgacttttgtcaaccttttatttatttatttatttatttatttatttatttatttattttttagacggagtttcgctcttgttgcccaggctggagtgtggtggcgcgatctcggctcaccgcaacctctgcctcccgggttcaagcaattctcctacctcatcttcccaagtagctgggattacaggcatgcgctatcacacccggctaattttttatttttagtagagatggggtttctccatgttggccaggctggtcttgaactcctgagcacaggtgatcgcccacctcggcctcccaaagtgctgggattacaggcatgagccaccgcgcccggctgtcagccttttaaaaaatataaaaaccattcctcactggaaggctgttcaaaaacggtggctgagatttgtcttg

SEQ ID NO: 23918 - DNA, 226 bp, Homo sapiens
  AC068845.2_111554
  Located on chromosome 19
  Distance between a terminus base of telomere on chromosomal short arm and 5'-terminus of this base sequence : 18615933
  Distance between 3'-terminus of neighbour sequence of sequence listing upward to telomere on chrosomal short arm and 5'-terminus of this base sequence : 289030
atcatctatcgatctgtcacctacctttctctttctctcatctatctgtctatcgtattatctacctacctacctacctatccatccatccatcctgcctgtgcatccattcatccttctatctatcctatctatctatctatctatctatctagctatctatctatctatctatctaatctatcatctatccatccatccatcttatctgtgcatccatacatca

SEQ ID NO: 23919 - DNA, 182 bp, Homo sapiens
  G08034
  Located on chromosome 19
  Distance between a terminus base of telomere on chromosomal short arm and 5'-terminus of this base sequence : 18616843
  Distance between 3'-terminus of neighbour sequence of sequence listing upward to telomere on chrosomal short arm and 5'-terminus of this base sequence : 684
acccatcctatctacgggtccatccaaccatctatcttattatctatctgtctgtctatctatctatctatctatctatctatccatccatccatccatcatctacatatctatctagagaaagacacagagagaggaagagagtgagggaacagagaagcacatagacacagacacagaaa

SEQ ID NO: 23920 - DNA, 264 bp, Homo sapiens
  AD000685.1_2729
  Located on chromosome 19
  Distance between a terminus base of telomere on chromosomal short arm and 5'-terminus of this base sequence : 18662788
  Distance between 3'-terminus of neighbour sequence of sequence listing upward to telomere on chrosomal short arm and 5'-terminus of this base sequence : 45763
catgctgttcattgcagaggctgtgccacctctaaagcctgcagtgggacctgctgtggctcctcctgggaaatgtatttatttctccagagtaatagaattaataggatatcaatatctacatctatctatctatctatctatctatctatctatctatctatctatctatcagtccgtctgtctgtctatgatctatctaatctatggagagacagaagagggcatttattataggaattgactcatgtttatggaagctga

SEQ ID NO: 23921 - DNA, 264 bp, Homo sapiens; identical to SEQ ID NO: 23920
  AC068845.2_190415
  Located on chromosome 19
  Distance between a terminus base of telomere on chromosomal short arm and 5'-terminus of this base sequence : 18662788
  Distance between 3'-terminus of neighbour sequence of sequence listing upward to telomere on chrosomal short arm and 5'-terminus of this base sequence : -264

SEQ ID NO: 23922 - DNA, 170 bp, Homo sapiens
  D19S588
  Located on chromosome 19
  Distance between a terminus base of telomere on chromosomal short arm and 5'-terminus of this base sequence : 18662846
  Distance between 3'-terminus of neighbour sequence of sequence listing upward to telomere on chrosomal short arm and 5'-terminus of this base sequence : -206
gctcctcctgggaaatgtatttatttctccagagtaatagaattaataggatatcaatatctacatctatctatctatctatctatctatctatctatctatctatctatctatcagtccgtctgtctgtctatgatctatctaatctatggagagacagaagagggcat

SEQ ID NO: 23923 - DNA, 344 bp, Homo sapiens
  AD000685.1_11850
  Located on chromosome 19
  Distance between a terminus base of telomere on chromosomal short arm and 5'-terminus of this base sequence : 18671814
  Distance between 3'-terminus of neighbour sequence of sequence listing upward to telomere on chrosomal short arm and 5'-terminus of this base sequence : 8798
cattctagcctcgaatagatgtgaagtggtacctcgttgtcagctagcttccatttctatgacagctagtgactttgcgcatctcctcttacatttctcatgtttgagcatccatgaattcttagatcaaatcctttgtctacttttcacttgggttacctgttcgttctcttgtagatttgcaggaattcctaacatattcagatattgttctggatatctatctatctatctatctatctatctatctatctatcttaggcatcttctctgaatctcttatctctcattggaatgttaattgggtccactgtatcttttactgcacagaaatccttaatttg

SEQ ID NO: 23924 - DNA, 369 bp, Homo sapiens
  AC068845.2_154842
  Located on chromosome 19
  Distance between a terminus base of telomere on chromosomal short arm and 5'-terminus of this base sequence : 18688025
  Distance between 3'-terminus of neighbour sequence of sequence listing upward to telomere on chrosomal short arm and 5'-terminus of this base sequence : 15867
agaacaaggaaatttttcctctcaagctaagtgggcctctgtgagtggacagtgtgtcttttccttctgccttgggatgcgctcttgggacttgggggtggccccaagagagatagagcaggaggaatgtagacagatagataggtaataggatagatggatggatggatgcacagatagggtgaatagatggctggctggctggataagtaggtgggtagatagacagatagatagatagataacaggatagatggatggatggacagatggatgcatggataagatggatggatggatggatggatggatggatggatggataatacatacataaagtagtagataagatggatacattaggtggat

SEQ ID NO: 23925 - DNA, 336 bp, Homo sapiens
  AB002459.1_1467
  Located on chromosome 19
  Distance between a terminus base of telomere on chromosomal short arm and 5'-terminus of this base sequence : 18699012
  Distance between 3'-terminus of neighbour sequence of sequence listing upward to telomere on chrosomal short arm and 5'-terminus of this base sequence : 10618
ttacagtaagggaagcaggactaggggggtatagaaagtgtctcagttgaaagcctgaataatgatcagtagataattgggtacagttggggagcagtgctgtaggtcaagaagaccacctggggtcttcgggggaggaagagagagaggagagagagagagagagagagagagagagagagagagagagagagagagagcagggtcaggacagaaaggaggagaaggggagaaagagggagagactgacttgtggtgagatgataaaactggagatggtagcaggggctggctgtggaagccttggggaaaatgttaatggcttcagttttagcc

SEQ ID NO: 23926 - DNA, 371 bp, Homo sapiens
  chr19.fa.O7frz.18623196
  Located on chromosome 19
  Distance between a terminus base of telomere on chromosomal short arm and 5'-terminus of this base sequence : 18832605
  Distance between 3'-terminus of neighbour sequence of sequence listing upward to telomere on chrosomal short arm and 5'-terminus of this base sequence : 133257
ggtttcttatttaaagttcctcactgtctttgggagacatataccctaagtgtgtgtgtggatattatgtcgaattgagtgaaggatatcagaatgcaaaagtggagagagagcaagaaggagagagagagagagagatacagagataggagaaagagagagagagaaagagagagagagaaagcaggtgtcaagtagtcaagtaaaaatagagttctttacattttttgatctgtacaagaaatgtaataactaagaatttggggcaaaatctgggaaagggaaaaagagagaaaaaaaggaggttggtaaaatagggctttaatatgtcctaataatagggctgtaatatgtcctaataagacaggcac

SEQ ID NO: 23927 - DNA, 226 bp, Homo sapiens
  AF221943.1_2479
  Located on chromosome 19
  Distance between a terminus base of telomere on chromosomal short arm and 5'-terminus of this base sequence : 19032658
  Distance between 3'-terminus of neighbour sequence of sequence listing upward to telomere on chrosomal short arm and 5'-terminus of this base sequence : 199682
agccatctatccgtctaatctatccatcatatatatctactccatctgtctacataatctatccatcctatctactctatctacccatccatccatcatccatccatccatccatcctatctgtgcatccgtgtgtccatgcatccatatgtcctattatttgtctatctatctatccatccatccatccatccatccatccatccatccatgctatctgtgcatc

SEQ ID NO: 23928 - DNA, 226 bp, Homo sapiens; identical to SEQ ID NO: 23927
  AC005336.1_18306
  Located on chromosome 19
  Distance between a terminus base of telomere on chromosomal short arm and 5'-terminus of this base sequence : 19032658
  Distance between 3'-terminus of neighbour sequence of sequence listing upward to telomere on chrosomal short arm and 5'-terminus of this base sequence : -226

SEQ ID NO: 23929 - DNA, 202 bp, Homo sapiens
  AC020950.5_15524
  Located on chromosome 19
  Distance between a terminus base of telomere on chromosomal short arm and 5'-terminus of this base sequence : 19056216
  Distance between 3'-terminus of neighbour sequence of sequence listing upward to telomere on chrosomal short arm and 5'-terminus of this base sequence : 23332
gaacggatggacagatgtatagatagatagatagatagatagatagatagatagatagatagatagatagacagatagataagcagacagttagatgacaaattgatgtctcaagagacccctttagggaaagcgaggatattaggtggggtggtgggaatgtcaaggttaaaccctgtcttatctgtagtgtcgcattgag

SEQ ID NO: 23930 - DNA, 289 bp, Homo sapiens
  DISD22_0011680
  Located on chromosome 19
  Distance between a terminus base of telomere on chromosomal short arm and 5'-terminus of this base sequence : 19225457
  Distance between 3'-terminus of neighbour sequence of sequence listing upward to telomere on chrosomal short arm and 5'-terminus of this base sequence : 169039
tttggaacagtgattctgagtcttttaatagagtttaaaatttgcttagatatcttaggcatattttgttaaatccactcctagatacttttgttgctatggaaaaatgtgtcaccttttatttgggttcagggaaatttatgaattcatttggaatatagagattttgtgtttcttgttaaatttaatccaggtattttatattattattattattattattattattattattattattggcatcttttctttcatgctgttttccagctggttgttatttctacca

SEQ ID NO: 23931 - DNA, 282 bp, Homo sapiens
  DISO7_00000021
  Located on chromosome 19
  Distance between a terminus base of telomere on chromosomal short arm and 5'-terminus of this base sequence : 19337590
  Distance between 3'-terminus of neighbour sequence of sequence listing upward to telomere on chrosomal short arm and 5'-terminus of this base sequence : 111844
cttctgagtacctggcccctagaagataggaaagtgtttgttaaaatgaaacacacacacacacacacacacacacacacacacacttcgctgcctaggaaacttctattcatccttcaaggcccagatgcaatggctcctcctctaggaagccttcctggattcctagacagactcctggactcccacccagcatcaagactcctgtgtgggatgaagtggaggtagggaggcctccttgttttctgcccaaggctgtagaggaaacaggatcgtggaaga

SEQ ID NO: 23932 - DNA, 177 bp, Homo sapiens
  D19S885
  Located on chromosome 19
  Distance between a terminus base of telomere on chromosomal short arm and 5'-terminus of this base sequence : 19367242
  Distance between 3'-terminus of neighbour sequence of sequence listing upward to telomere on chrosomal short arm and 5'-terminus of this base sequence : 29370
ctgggtgacagagtgggactccatcacacacacacacacacacacacacacacagagtcaagtgactatgacctgggaggattctatcagacagatcagtgacctgggcctatccagtctgggtgaatagatgttaactgaatgctgactatgttggacgagccagtttctccatta

SEQ ID NO: 23933 - DNA, 419 bp, Homo sapiens
  chr19.fa.O7frz.17685171
  Located on chromosome 19
  Distance between a terminus base of telomere on chromosomal short arm and 5'-terminus of this base sequence : 19478186
  Distance between 3'-terminus of neighbour sequence of sequence listing upward to telomere on chrosomal short arm and 5'-terminus of this base sequence : 110767
tcaatggacttaatagcagaatggaggccaggtacagtggctcatgcctgtaatcccagcactttgggaggctgaggtgggaagatcacttgccccaggagttctagatcagccagggcaacacagagagaccctcatctctacaaaaatttttttttaaaaattagccaggcttggtggtgcacacctgtagtcccagctactcaggaggctgaagcagaaggatcgcttgagcccaggaggttggggctacagtgagccatgcttgctccatggctctccagcctggatgacagagtgggaacctatctcaaaaaaaaaaaaaataataataataatagtaataataataataacagaatggagataaacaggaaagggccaaaggacctgtgaacttaaaggcagttcaatgtaaa

SEQ ID NO: 23934 - DNA, 219 bp, Homo sapiens
  D19S917
  Located on chromosome 19
  Distance between a terminus base of telomere on chromosomal short arm and 5'-terminus of this base sequence : 19596315
  Distance between 3'-terminus of neighbour sequence of sequence listing upward to telomere on chrosomal short arm and 5'-terminus of this base sequence : 117710
tatggtcagccagggtcgagcaggctctggtgggagggacgggttgatgcagaggaaagcgctcagagaaaagaacttgccagaaatttctaggcactatattcccagtttggccaggggccttataaaacacacacacacacacacacacacacacacacacacatacacacacacacatactcacacacacacggtgaaattgtgaaattcctcaga

SEQ ID NO: 23935 - DNA, 424 bp, Homo sapiens
  AC008764.7_65821
  Located on chromosome 19
  Distance between a terminus base of telomere on chromosomal short arm and 5'-terminus of this base sequence : 19890762
  Distance between 3'-terminus of neighbour sequence of sequence listing upward to telomere on chrosomal short arm and 5'-terminus of this base sequence : 294228
aaatttctagccaagtttggtggctcatgtctatagtcccagcactttgggaggctgaggcgggtggatcacttaagcccagaagtttgagaccagactgggcaatatggcaaaaccttctttctacaaaaaatacacacacacacacacacacacacacacacacacacagagttaaccagatatgctggtgtgaacgtgtagtcccagctactcaagaggttgaggtgggaggatcactgagcccagagaggttgaggtggcagtgagctgtgattgtaccactgcactccagcctgagcacagaatgagaccctctctcaaaggaatttaaaaaatttccatttggttcttcactctatcttctatctgttcacatttgtctccagagtctttactttgctccttggagcacgatggtaat

SEQ ID NO: 23936 - DNA, 232 bp, Homo sapiens
  AC024075.4_71599
  Located on chromosome 19
  Distance between a terminus base of telomere on chromosomal short arm and 5'-terminus of this base sequence : 20010615
  Distance between 3'-terminus of neighbour sequence of sequence listing upward to telomere on chrosomal short arm and 5'-terminus of this base sequence : 119429
aagaataccagcataagctcatagggatcttgggatcagctgaggtcagaatagcaatttcttttgtttcgtgtgtgtgtgtgtgtgtgtgtgtgtgtgtgtgtgtgtgtgtgtgtatgtgtgtgttttagatggagtcttgctctgttgcccaggctggagtgcagtgcagtggtgcaatctcagctcactgcagcctccacctcctgagttcaagtgattctcctgtcag

SEQ ID NO: 23937 - DNA, 470 bp, Homo sapiens
  chr19.fa.O7frz.17457596
  Located on chromosome 19
  Distance between a terminus base of telomere on chromosomal short arm and 5'-terminus of this base sequence : 20084940
  Distance between 3'-terminus of neighbour sequence of sequence listing upward to telomere on chrosomal short arm and 5'-terminus of this base sequence : 74093
ctgagatccttctaggctagaggtcgtcacctcaggatagttctccacgccccccatccccccacaggggacactagacagtgtgtctggaagcatttttggttgtcatgactgagcagggtggtgctcctggtgtctttactgagtggagtccagggatgctgtttaacaccctacagtgcaaaggattgtcctactttagagaatgatccagccccagatgttgatagtgcagagagtaagaaaccttgccttagcctgagagaccctatccattcatccatccatcaatccctccctccctccctccatcatctctatcatccatccatccatccatccatccatccatccatccattcatcaattcgacctttcatccatccattgtctctatcttccatccatctatccatcatctcaatcctccatccttccatccattctctctaaattccatctatccttcc

SEQ ID NO: 23938 - DNA, 185 bp, Homo sapiens
  D19S930
  Located on chromosome 19
  Distance between a terminus base of telomere on chromosomal short arm and 5'-terminus of this base sequence : 20196017
  Distance between 3'-terminus of neighbour sequence of sequence listing upward to telomere on chrosomal short arm and 5'-terminus of this base sequence : 110607
ggtgctgtgtgagcccttttgcattaacttaaaaaaaatatgtgtgtgtgtgtgtgtgtgtgtgtgtgtgtgtgtgtatatatacacataaacatttttctaatgtaaaataaagcacagatccaagaaaccacatggccaacaaatggcttgaatctttattaagcagtcacccatgtgcccac

SEQ ID NO: 23939 - DNA, 115 bp, Homo sapiens
  D19S899
  Located on chromosome 19
  Distance between a terminus base of telomere on chromosomal short arm and 5'-terminus of this base sequence : 20527351
  Distance between 3'-terminus of neighbour sequence of sequence listing upward to telomere on chrosomal short arm and 5'-terminus of this base sequence : 331149
gccactgcctttatacagtagaaatttgtgtgtgtgtgtgtgtgtgtgtgtgtgtgtgtgtgatggagtttcactcttgtcacccaggctggagtgcggtggcatgatctcagct

SEQ ID NO: 23940 - DNA, 256 bp, Homo sapiens
  D19S593
  Located on chromosome 19
  Distance between a terminus base of telomere on chromosomal short arm and 5'-terminus of this base sequence : 20601248
  Distance between 3'-terminus of neighbour sequence of sequence listing upward to telomere on chrosomal short arm and 5'-terminus of this base sequence : 73782
tagagatgacagatgaagagatggatggaaggcagataaagaggatggatgggtggaagatagagacaatgagtcaatgagtagaaggatggatggatggatagatagatgatagatagatagatagatagatagatagatagatagatagatacatagatagatagatgggcaggcaggcagggtctcttgggctaaggcaaggtttcctaccctccacactcaacatctggggctggctcactctctggggtgg

SEQ ID NO: 23941 - DNA, 170 bp, Homo sapiens
  D19S410
  Located on chromosome 19
  Distance between a terminus base of telomere on chromosomal short arm and 5'-terminus of this base sequence : 20735515
  Distance between 3'-terminus of neighbour sequence of sequence listing upward to telomere on chrosomal short arm and 5'-terminus of this base sequence : 134011
ctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatggtactgctggagaggt

SEQ ID NO: 23942 - DNA, 311 bp, Homo sapiens
  AC010463.6_72681
  Located on chromosome 19
  Distance between a terminus base of telomere on chromosomal short arm and 5'-terminus of this base sequence : 20750552
  Distance between 3'-terminus of neighbour sequence of sequence listing upward to telomere on chrosomal short arm and 5'-terminus of this base sequence : 14867
aggtgctgtctcaatgagaaccctgcaccgtgcagcaggcactccctgagccttgggagaactgttttagactccagtttggggagcgccagatcaagtgagccacggcactgagatttttttgtttgtgtgtgtgtgtgtgtgtgtgtgtgtgtgtgtttttgagacagtctcgctttgtcatccaggctggagggcagtggccggatttcggcttactgcaacctccccctcctgggttcaagcgattctcttgcctcagcctcctgagtagctgggattataggcaggtgccaccatgtctagctaat

SEQ ID NO: 23943 - DNA, 396 bp, Homo sapiens
  AC010319.6_150921
  Located on chromosome 19
  Distance between a terminus base of telomere on chromosomal short arm and 5'-terminus of this base sequence : 20803862
  Distance between 3'-terminus of neighbour sequence of sequence listing upward to telomere on chrosomal short arm and 5'-terminus of this base sequence : 52999
cctgtaatcctcgcactttaggaggctgaggcgggcagatcacctgagatcaggagttcaagaccagcctagtaaacatggtgaaacgccatctctactaaaaatacaaaaaaaatcacccaggctggtggcgggcacctgtaatcccagctactcgggaggctgaggcaggagaattgcttgaacctgggaggtggaggttgcagtgagctgagatcacaccagtgtactccagcgtgggtggcagagtgagactccatctcaaaataataataataataataataataataataataataaaataaataataaaatcttttttaaaaaaagctcttcccattgcaatttttgccatattcagccacatagctcctggaccaagatttacttaat

SEQ ID NO: 23944 - DNA, 325 bp, Homo sapiens
  AC010319.6_87775
  Located on chromosome 19
  Distance between a terminus base of telomere on chromosomal short arm and 5'-terminus of this base sequence : 20867183
  Distance between 3'-terminus of neighbour sequence of sequence listing upward to telomere on chrosomal short arm and 5'-terminus of this base sequence : 62925
tagccatcctgactgtattgtttgctagtctgggcagcgcaggacacttgttcgctatttttctaaacttttcccccaatgggtgtaaaaaagcatattattattattattattattattattattattgagacgagtttcgctcttgttgcctaagctggagtgcaatggcgcgatctcagctcattgcaacctccacctcccgggttccagtgattctcctgcctcagcccccttagtagctgggattccagacgcgcaccaccacgcctggatagttttttgtacttttagtagaaacggggtttcaccatgttaggctggt

SEQ ID NO: 23945 - DNA, 418 bp, Homo sapiens
  chr19.fa.O7frz.74870938
  Located on chromosome 19
  Distance between a terminus base of telomere on chromosomal short arm and 5'-terminus of this base sequence : 20979883
  Distance between 3'-terminus of neighbour sequence of sequence listing upward to telomere on chrosomal short arm and 5'-terminus of this base sequence : 112375
tgccataggatgactttaaatatgcattgtttaaataaacattcactgagcagccaagcaaggtggctcccgtctgtaatcccagcactttgggaggccaaggcaggcggatcaccagaggtcaagagttcaagaccagcctcgccaacatggtgaaaccccgaaaccccatctctactaaaaatacaaaaaaaaatttagccagaccctgtagcgcgcacctgtagtcccagctacttgggaggctgaggcaggagaatcgtttgaacctgggaggtggagattgcagtgagcccagattgtgccactgcattccagcctaggcaacagagctagactctgtcaaacacacacacacacacacacacacacacacacacacacacacacacaaccattcactgagcatgtaattcat

SEQ ID NO: 23946 - DNA, 239 bp, Homo sapiens
  AC008761.4_274132
  Located on chromosome 19
  Distance between a terminus base of telomere on chromosomal short arm and 5'-terminus of this base sequence : 21185068
  Distance between 3'-terminus of neighbour sequence of sequence listing upward to telomere on chrosomal short arm and 5'-terminus of this base sequence : 204767
actccagcctagtgacagagtgatactccatctcaaataataaataaataaataaataaataaataaataaataggcacttgagagaagaagaggagcacctatggtaagcccaaggacactgaattccatgttccctgcaggtagcattcctgctgacctgataacagggactggcgttgggcatggacagagttgtaaagggtggacccctgggtgtgatgtcttggctttgatagt

SEQ ID NO: 23947 - DNA, 238 bp, Homo sapiens
  AC005796.1_34597
  Located on chromosome 19
  Distance between a terminus base of telomere on chromosomal short arm and 5'-terminus of this base sequence : 21378893
  Distance between 3'-terminus of neighbour sequence of sequence listing upward to telomere on chrosomal short arm and 5'-terminus of this base sequence : 193586
ctataattccagctattcggaaggctgaggcaggagaatcgattgaactcaggaggtggaggttgcagagagcagagattgtgccattgcactccagcctgggcaacaacagccagacactgtcagaaagaaagaaaagacagagagagagagagagagagagagagagagagagagagagagagagcaagctaaaaagaaaaacgtgtagggtctcagcatgataaatattcaaagg

SEQ ID NO: 23948 - DNA, 238 bp, Homo sapiens
  AC005602.1_230
  Located on chromosome 19
  Distance between a terminus base of telomere on chromosomal short arm and 5'-terminus of this base sequence : 21413851
  Distance between 3'-terminus of neighbour sequence of sequence listing upward to telomere on chrosomal short arm and 5'-terminus of this base sequence : 34720
aaacatttcaagtagccaggtatggtggtacacacctgtagtcccagctactcgggaggctgaggcaggaggatcgtttgagcctgggaggtcgaggctgcagtgagctatgactgcactactgcactccagcctgagcaacagagtgagaccctgtctcaaataaataaataaataaataaataacacaacagatgatcgcctcatgagaattttgtctttccgttgtaagtctcct

SEQ ID NO: 23949 - DNA, 296 bp, Homo sapiens
  AC020904.6_130528
  Located on chromosome 19
  Distance between a terminus base of telomere on chromosomal short arm and 5'-terminus of this base sequence : 21570936
  Distance between 3'-terminus of neighbour sequence of sequence listing upward to telomere on chrosomal short arm and 5'-terminus of this base sequence : 156847
catctagtcaccaatctatccatctatccatccacgtattcattcatccatacacccacccatccatccatttatctacctaccgatatatccatccagccatccatccatccatccatccatccatccatccatccatacatacatacatgtatttattaattcatccatccattcatttacccacccatccacctgtctatccattcatccaccaccctttagtcctcagaggttgagatgcatatttgggagacactctcgggaggtacccctgcaggaaagaacagtaagac

SEQ ID NO: 23950 - DNA, 433 bp, Homo sapiens
  AC025749.3_57043
  Located on chromosome 19
  Distance between a terminus base of telomere on chromosomal short arm and 5'-terminus of this base sequence : 21572537
  Distance between 3'-terminus of neighbour sequence of sequence listing upward to telomere on chrosomal short arm and 5'-terminus of this base sequence : 1305
caatgagttatgattaggccactgcactccagcctgggacacagagtgagaccctacctcagtaaataaataaataaataaataaataaataaataaataaataaataagtaaagtatacggaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagaggaaagatgtcta

SEQ ID NO: 23951 - DNA, 136 bp, Homo sapiens
  AC020904.6_132092
  Located on chromosome 19
  Distance between a terminus base of telomere on chromosomal short arm and 5'-terminus of this base sequence : 21572537
  Distance between 3'-terminus of neighbour sequence of sequence listing upward to telomere on chrosomal short arm and 5'-terminus of this base sequence : -433
caatgagttatgattaggccactgcactccagcctgggacacagagtgagaccctacctcagtaaataaataaataaataaataaataaataaataaataaataaataagtaaagtatacggaaggatgtgcatag

SEQ ID NO: 23952 - DNA, 378 bp, Homo sapiens
  AF157814.1_985
  Located on chromosome 19
  Distance between a terminus base of telomere on chromosomal short arm and 5'-terminus of this base sequence : 21707853
  Distance between 3'-terminus of neighbour sequence of sequence listing upward to telomere on chrosomal short arm and 5'-terminus of this base sequence : 135180
tcactttatcggcatctcataaatggggaaactgagtcctaggggtacgtagatatttcccttttcattatgcctactaggaagctcaaatcaaagtatttcttcatttgctgctaattggccttaatggtttgtttgtttgtttgtttgtttgtttgttttctgaggcagactcttgctctttcgcccaggctggagtgcagtggtgccatctcggctcactacaacctccgcctcctgggttcaagcgattctcgtgcctcagcctcctgagtagctgggactacaggcgcgcgccaccacacctggctaatttttgtattttttagtagtgacagggtttcaccatgttggccaggctggtcctgaacacctgac

SEQ ID NO: 23953 - DNA, 197 bp, Homo sapiens
  D19S212
  Located on chromosome 19
  Distance between a terminus base of telomere on chromosomal short arm and 5'-terminus of this base sequence : 21718626
  Distance between 3'-terminus of neighbour sequence of sequence listing upward to telomere on chrosomal short arm and 5'-terminus of this base sequence : 10395
ctactcgagactgaggtgggaggatcgcttgagcctgggaggcagaggatgcagtgagccatgatcgagacactgcacttgtacctgggcaacagaatgagactctgtctcaaaaataaaaacttgtgtgtgtgtgtgtgtgtgtgcgtgtgtgtgtgtatttatatccaagcaccccagggttacctcgggtgctt

SEQ ID NO: 23954 - DNA, 180 bp, Homo sapiens
  D19S898
  Located on chromosome 19
  Distance between a terminus base of telomere on chromosomal short arm and 5'-terminus of this base sequence : 21849325
  Distance between 3'-terminus of neighbour sequence of sequence listing upward to telomere on chrosomal short arm and 5'-terminus of this base sequence : 130502
agctcactctgcccatttccccacatgtgccacagcactgggagttatcaagttttttttgtttgtgtgtgtgtgtgtgtgtgtgtgtgtgtgtgtgttttaaagagacaggatctcactctctcacccaggctgagtgcagtggtgcaatcatggctcactgcagccttgacctcctgg

SEQ ID NO: 23955 - DNA, 193 bp, Homo sapiens
  chr19.fa.O7frz.21586471
  Located on chromosome 19
  Distance between a terminus base of telomere on chromosomal short arm and 5'-terminus of this base sequence : 21949068
  Distance between 3'-terminus of neighbour sequence of sequence listing upward to telomere on chrosomal short arm and 5'-terminus of this base sequence : 99563
tgagaaatcacctgatcactctggtgggcaatgtgtgtgtgcgtgtatgaaatcacctgatcactctagtgggctgtgtgtgtgtgtgtgtgtgtgtgtgtgtttgggcggggggcggggggggaaggattgttttgttttttgagacaggatcctgctctgtcacccaggctggagtgtaatacaatcatgg

SEQ ID NO: 23956 - DNA, 366 bp, Homo sapiens
  chr19.fa.O7frz.22632080
  Located on chromosome 19
  Distance between a terminus base of telomere on chromosomal short arm and 5'-terminus of this base sequence : 22111130
  Distance between 3'-terminus of neighbour sequence of sequence listing upward to telomere on chrosomal short arm and 5'-terminus of this base sequence : 161869
ggagttcaatgttacagtgagttatgatcatgcctaggtgacagagtgggactgtggttcaaaaaatacatgtatagcccatttatgtatgtatgtatgtatgtatgtatgtatgtatgtatgtatgtatgtattttgagacggagtctcgctctgttgcccaggctggagtgcagtggtacgatcttggctcactgcaacctccatcccctcggttcaagtgattcttcgacctcagcctactgagtagctgggattacaggtgcataccaccacgcccggctaatttttgtatttttattagagccaggctttcaccatgttggccaggctggtcttgaactcctgacttcaggtaatccgtta

SEQ ID NO: 23957 - DNA, 414 bp, Homo sapiens
  chr19.fa.O7frz.21880895
  Located on chromosome 19
  Distance between a terminus base of telomere on chromosomal short arm and 5'-terminus of this base sequence : 22291534
  Distance between 3'-terminus of neighbour sequence of sequence listing upward to telomere on chrosomal short arm and 5'-terminus of this base sequence : 180038
attctctgacttatttaaagctgataggcggggcacggtggcgcacacctgtaatcccagcactttgggaggccaaggcgggcggatcatgaggtcaggagatcgagaccatcctggctaacacagtgaaaccccgtctctactaaaaataaaaaaaataaaaaaaaaattagcctggcatcgtggcgggcacctgtagtcccagctacttgggaggctgaggcaggagaatggcgtgaacccgggaggtggagcttgcagtgagctgagattgtgccactgcactccagcctgggcgacagagcgagactccgtctctaaataaataaataaataaataaataaataaataaagttgttgttgtttgtcatgaagcccttttttgtggttttagtacagtccacagaagttcc

SEQ ID NO: 23958 - DNA, 341 bp, Homo sapiens
  AC002985.1_29560
  Located on chromosome 19
  Distance between a terminus base of telomere on chromosomal short arm and 5'-terminus of this base sequence : 22474671
  Distance between 3'-terminus of neighbour sequence of sequence listing upward to telomere on chrosomal short arm and 5'-terminus of this base sequence : 182723
atgaggtcaggagttcaagagcaggctgaccaacatggtgaaaccccatgtctactaaaaatacaaaatcagccaggcatggtggcacatgactgtaatcccagctacttgggaggctgaggaaggagaattgcttgaaccggggaggcggaagttgcggtgagccgagatcgcaccattgcactccagcctgggggacaagagtgaaactctgtctcaaaaaaataaataaataaataaataaataaatgattttttaggctgggtgcagtggctcacacctgtaatcccatcactttgggagcctgaggcaggcggattacctgaagtcaggagtttga

SEQ ID NO: 23959 - DNA, 161 bp, Homo sapiens
  D19S566
  Located on chromosome 19
  Distance between a terminus base of telomere on chromosomal short arm and 5'-terminus of this base sequence : 22589860
  Distance between 3'-terminus of neighbour sequence of sequence listing upward to telomere on chrosomal short arm and 5'-terminus of this base sequence : 114848
caggtagggctggaatgtttaatatgtctgcatttatgtgtgcagcccttcggcagggacactgagttgtctggatctctctctctctctctgtgtgtgtgtgtgtgtgtgtgtgtgtgtgtgtgtgtgtgtcagtcttccacgctatggcctctgaagct

SEQ ID NO: 23960 - DNA, 152 bp, Homo sapiens
  AC003967.1_17972
  Located on chromosome 19
  Distance between a terminus base of telomere on chromosomal short arm and 5'-terminus of this base sequence : 22810491
  Distance between 3'-terminus of neighbour sequence of sequence listing upward to telomere on chrosomal short arm and 5'-terminus of this base sequence : 220470
cctgaacaagaggaaagtcacaggcctgagacaggcaatggagtagggtgtgtgtgtgtgtgtgtgtgtgtgtgtgtgtgtgtgagcaggagtcaggtacccggggccttatctgggacaatacttttacccttggtgactttggaacctag

SEQ ID NO: 23961 - DNA, 311 bp, Homo sapiens
  AC004475.1_16517
  Located on chromosome 19
  Distance between a terminus base of telomere on chromosomal short arm and 5'-terminus of this base sequence : 22829511
  Distance between 3'-terminus of neighbour sequence of sequence listing upward to telomere on chrosomal short arm and 5'-terminus of this base sequence : 18868
gatcacgaggtcaggagttcaagaccatcctggctaacacagtgaaaccccgtctctactaaaaaaaaaatacaaaaaattagccaggcttggtggcggcgcctgtagtcctagctactcaggaggctgaggcagaagaatggcgtgaacctgggaggcggagcttgcagtgagccgagatcacgccactgcactccagcctgggtgacagagtgagactctgtcacacacacacacacacacacacacacacacacacacacacacaaaagggccaagaattagatagcttcactggtaaagcaaacatt

SEQ ID NO: 23962 - DNA, 104 bp, Homo sapiens
  DISO7_10007372
  Located on chromosome 19
  Distance between a terminus base of telomere on chromosomal short arm and 5'-terminus of this base sequence : 22968770
  Distance between 3'-terminus of neighbour sequence of sequence listing upward to telomere on chrosomal short arm and 5'-terminus of this base sequence : 138948
tcagtttgagaagtccttgtgtttgggtgggttgtatggtagggggggtgtgtgtgtgtgtgtgtgtgtgtgtgtgtgtgtgtgtagtacccaggtgcaaggtc

SEQ ID NO: 23963 - DNA, 305 bp, Homo sapiens
  chr19.fa.O7frz.23279244
  Located on chromosome 19
  Distance between a terminus base of telomere on chromosomal short arm and 5'-terminus of this base sequence : 23041392
  Distance between 3'-terminus of neighbour sequence of sequence listing upward to telomere on chrosomal short arm and 5'-terminus of this base sequence : 72518
ggaagtttgaaaggataagaaagaagtagaagtcgataagtgtgtgcatgtgggcacggtggtggaagtcatctggaagctgtgtgtgtgtgtgtgtgtgtgtgtgtgtttaaagtttgaaagggagcatgaaggcatcactagttgtgtgtctgatggtaggattagagggaaaataaatagttgaaagcaccatttcctaaaagagttaccacgggggttttgagagagcgcctggcaggacccagttgccaggtttctggagtgctgcccttgcacacagggttggttcctaagaacatttg

SEQ ID NO: 23964 - DNA, 370 bp, Homo sapiens
  chr19.fa.O7frz.23436080
  Located on chromosome 19
  Distance between a terminus base of telomere on chromosomal short arm and 5'-terminus of this base sequence : 23198685
  Distance between 3'-terminus of neighbour sequence of sequence listing upward to telomere on chrosomal short arm and 5'-terminus of this base sequence : 156988
atcacgaggtcaggagtttgagaccagcctggccaatatggtgaaaccccgtctctactaaaaatataaaaattagctgggcatagtggcaggcacctgtagtctcagctactcgggaggctgaggcagaacaatcacttgaacctgggaggcggaggttgcagtgagccgagattgtgccactgcactccagcctgggcaacagagccagactccatctcaaaaacaaacaaacaaacaaacaaaaaaaccccaaaaaacaaaacaaaaacaaaaacaacaacaaaaaaagctgggaagctgggtgcacagacagcacctaatgcccagggctctgctctgctgaaggtgacatgaactcaaataggaa

SEQ ID NO: 23965 - DNA, 378 bp, Homo sapiens
  AC011477.5_147524
  Located on chromosome 19
  Distance between a terminus base of telomere on chromosomal short arm and 5'-terminus of this base sequence : 23388156
  Distance between 3'-terminus of neighbour sequence of sequence listing upward to telomere on chrosomal short arm and 5'-terminus of this base sequence : 189101
tttctatttgtactcatggcctctgtggataactacagttcaaattctttgacttacattctttcctgtttcctcctcttctctcttctggtccagactcaggcatccctcacagtgataaatgggagaggccttgccggcccttgtcttagacttttctttattgaaacacttctgatgtttgctgttgattatgatgtttgcacaaatatctttgcttaataagaattttatttttgccttttcccttccttccctcccttccttccttccttccttccttccttccttccttccttccttccttcctttcaaagcatgatctctgatgtttcttaggctggagtgcagtagctagtcacagatggaatcatagct

SEQ ID NO: 23966 - DNA, 279 bp, Homo sapiens
  AC011477.5_21980
  Located on chromosome 19
  Distance between a terminus base of telomere on chromosomal short arm and 5'-terminus of this base sequence : 23513867
  Distance between 3'-terminus of neighbour sequence of sequence listing upward to telomere on chrosomal short arm and 5'-terminus of this base sequence : 125333
ttgctcatacatttaatgtcgtacctaaaaaaatggtgccaagaccaatgtcatgtcttttttttgtattctttctttctttctttctttctttctttctttctttctttctttctttctttctttctttctttctttctttctctttcttttctttctttctttctttctttctttctttctttctttctttctttctttctttcttcctttcttttctttcttttctttcttttctttcttttctttctttcttttcttagatggagtcttgctctg

SEQ ID NO: 23967 - DNA, 199 bp, Homo sapiens
  AC011477.5_16730
  Located on chromosome 19
  Distance between a terminus base of telomere on chromosomal short arm and 5'-terminus of this base sequence : 23519132
  Distance between 3'-terminus of neighbour sequence of sequence listing upward to telomere on chrosomal short arm and 5'-terminus of this base sequence : 4986
agttcatagatgccagaaataaagatgtatgtgccaatatttttcttatttttaaaaaagaaaccaggagttggcaatttatatttgtgtgtgtgtgtgtgtgtgtgtgtgtgtgtgtgtgtgtgtgtgacagagtctcactctcttacctaggctggagtgcagtggcaaaaatcttagctcactacaatctccgtct

SEQ ID NO: 23968 - DNA, 179 bp, Homo sapiens
  AC007204.1_62139
  Located on chromosome 19
  Distance between a terminus base of telomere on chromosomal short arm and 5'-terminus of this base sequence : 23583143
  Distance between 3'-terminus of neighbour sequence of sequence listing upward to telomere on chrosomal short arm and 5'-terminus of this base sequence : 63812
ttgaagtaggagaattgctttaacctgggaggcagaggctgtggtgagccagatcacaccattgcactccagcctgggtgcacagacacacacacacacacacacacacacacacacacaccaaaaacaaaaaacaaaacaaaacaaacaaccctctgttgcaggcttaatattagcct

SEQ ID NO: 23969 - DNA, 429 bp, Homo sapiens
  AC006539.1_77659
  Located on chromosome 19
  Distance between a terminus base of telomere on chromosomal short arm and 5'-terminus of this base sequence : 23677402
  Distance between 3'-terminus of neighbour sequence of sequence listing upward to telomere on chrosomal short arm and 5'-terminus of this base sequence : 94080
ctgaggtcaggagctcaaaatcagcctggccaaaatagtgaaaccccatctctacaaaaatacataaattagccaggcatgatggtggatacctgtaatcccagccacttgggaggctgaggcgggaaaattgcttgaacctctgaggcagaggttgcactgagccgagattgcaccactgcactccagcctgggcaacaaagcaagactctgtctcaaaaataaataaataaataaataaataaataaaacagcatacagatgaaaagccaagaaaagccaagaaaactgtggaaaaaaaaacacacacaacaaaacacagataatattggccagccgtgggaaaaatcttgattgattaaaaaagctaataatagatcattggaactaaaaattcagaaatagactaaagtgcctaagaaactgtct

SEQ ID NO: 23970 - DNA, 101 bp, Homo sapiens
  DISD22_0011696
  Located on chromosome 19
  Distance between a terminus base of telomere on chromosomal short arm and 5'-terminus of this base sequence : 24758500
  Distance between 3'-terminus of neighbour sequence of sequence listing upward to telomere on chrosomal short arm and 5'-terminus of this base sequence : 1080669
atctctaaattgcaatggttcctgaaacacacacacacacacacacacacacacacacacacacacacacacatttttaccaagttgccattggtggaatt

SEQ ID NO: 23971 - DNA, 147 bp, Homo sapiens
  chr19.fa.O7frz.24393661
  Located on chromosome 19
  Distance between a terminus base of telomere on chromosomal short arm and 5'-terminus of this base sequence : 24881555
  Distance between 3'-terminus of neighbour sequence of sequence listing upward to telomere on chrosomal short arm and 5'-terminus of this base sequence : 122954
taagtcagaaccagttctgtttactctctaatttcaccttaagtcaaattaaaaatgtcgctcatggttacttagtaaatatgtgtgtgtgtgtgtgtgtgtgtgtgtgtgtgtgtgtgtgtgtttcaggtaccatagcaatttaga

SEQ ID NO: 23972 - DNA, 322 bp, Homo sapiens
  AC008554.7_15577
  Located on chromosome 19
  Distance between a terminus base of telomere on chromosomal short arm and 5'-terminus of this base sequence : 24957569
  Distance between 3'-terminus of neighbour sequence of sequence listing upward to telomere on chrosomal short arm and 5'-terminus of this base sequence : 75867
cacctgtaatccgagttactagagaggctgaagcaggagaatttcttgaacccaaaaggcagaggttgcagtgagctgagatcgcaccactgcacttccgtctaggtgacagagcgagactccatctctacaaaaataaatatataaatacataaatcacaggaatgaatgaatgaatgaatgaataaataaatgcaacagaggaccaggaagacatatttgaaaatccatggccaggcttggtggctcatgcctgtaatcccagcactttgggaggccaaggtgggtagatcgcctgaggtcagaagttcgagactagcct

SEQ ID NO: 23973 - DNA, 234 bp, Homo sapiens
  AC008554.7_19349
  Located on chromosome 19
  Distance between a terminus base of telomere on chromosomal short arm and 5'-terminus of this base sequence : 24961373
  Distance between 3'-terminus of neighbour sequence of sequence listing upward to telomere on chrosomal short arm and 5'-terminus of this base sequence : 3482
tgtatttaagttgtcctcaccaaggaagaccaggtgtctgtagttctctaacatcacatccctatataaattccgctgtgcagtgtccaggcaatgccactcctccagagagaattctatggccacatctgtaaattgcaatggcccctgaaacacacacacacacacacacacacacatttttaccaagtcgccatgggtggaatttttgacttaagatgaaatgagcgagta

SEQ ID NO: 23974 - DNA, 187 bp, Homo sapiens
  chr19.fa.O7frz.24630725
  Located on chromosome 19
  Distance between a terminus base of telomere on chromosomal short arm and 5'-terminus of this base sequence : 25118526
  Distance between 3'-terminus of neighbour sequence of sequence listing upward to telomere on chrosomal short arm and 5'-terminus of this base sequence : 156919
ctgaagcttcataagacctctccttgtctgtgtacgatggacgggtggctgactctagagctgtggctgttgcctccctctctggtggtgaatcccccatagtctggtgagggaaaatatatatatatatatatatatatatatatatatatcttttcccatttcctcgtcttattaagattggctt

SEQ ID NO: 23975 - DNA, 228 bp, Homo sapiens
  D19S911
  Located on chromosome 19
  Distance between a terminus base of telomere on chromosomal short arm and 5'-terminus of this base sequence : 25285230
  Distance between 3'-terminus of neighbour sequence of sequence listing upward to telomere on chrosomal short arm and 5'-terminus of this base sequence : 166517
tcccaaactgctggaattacaggcgtgagccaccacattcggaccctattcctgagttcttgaagtttccattatttaaagctacgcatttcactactaatcacagaaaagataaagtaatgtacattaaatataaattgaatgtgtgtttgtgtgtgtatgtctgtgtgtgtgtgtgtgtgtgtgatgactgttctaaattactacactaggttaagaccaattcct

SEQ ID NO: 23976 - DNA, 208 bp, Homo sapiens
  DISO7_10004433
  Located on chromosome 19
  Distance between a terminus base of telomere on chromosomal short arm and 5'-terminus of this base sequence : 25356527
  Distance between 3'-terminus of neighbour sequence of sequence listing upward to telomere on chrosomal short arm and 5'-terminus of this base sequence : 71069
ttatatcgtcatttccttcagcattttatgtcatgggagacatttaccagtgtctagaaaagcccctaaaagccaaaaattaagatgtatgtgccaatatttttcctgctttttaaaagaaaccaggatttggcaatttacatttgtgtgtgtgtgtgtgtgtgagagagagagagagagagagagagtctcgccctgttacctatgc

SEQ ID NO: 23977 - DNA, 299 bp, Homo sapiens
  chr19.fa.O7frz.25002497
  Located on chromosome 19
  Distance between a terminus base of telomere on chromosomal short arm and 5'-terminus of this base sequence : 25490205
  Distance between 3'-terminus of neighbour sequence of sequence listing upward to telomere on chrosomal short arm and 5'-terminus of this base sequence : 133470
gaatttacatgttatgcctgaagtaaattatacaattagtaggcactccatatttactaaaatagttacttataaatttaagtttgctgcaggcaaaacggaattataggatattcacccactttcttcagcctaaatctaaataatagcataatttattcccaaatatttgttttatatatcagaggctctaaccatattctgctatatgtgtgtgtgtgtgtgtgtgtgtgtgtatatatatgtgtgtgtgtgtgtgtgtattttatttagcagtttaaggctatttgcttctaaat

SEQ ID NO: 23978 - DNA, 211 bp, Homo sapiens
  AC012627.4_23084
  Located on chromosome 19
  Distance between a terminus base of telomere on chromosomal short arm and 5'-terminus of this base sequence : 25590929
  Distance between 3'-terminus of neighbour sequence of sequence listing upward to telomere on chrosomal short arm and 5'-terminus of this base sequence : 100425
attatagccgtgagccactacactcggcccatgtgtttttttttttcaaatatattattggatttaacagttttacttttgctatttatttatttatttatttatttatttattttactgagacagagtctcactctgttgcccaggctggggtgcaatggtgtgatcttggctcactgcaaactccgcctcacaggttcaagcaatactc

SEQ ID NO: 23979 - DNA, 254 bp, Homo sapiens
  AC009009.3_31573
  Located on chromosome 19
  Distance between a terminus base of telomere on chromosomal short arm and 5'-terminus of this base sequence : 25730205
  Distance between 3'-terminus of neighbour sequence of sequence listing upward to telomere on chrosomal short arm and 5'-terminus of this base sequence : 139065
agctgacttgaattacatcaatttttgtatgttgaaccagccttgcatcctgggaataaagctttttgacgtgctgctggattcagtttgccagcattttattgagaatttttgcattgatgtttatcaggaatattgacttgaaggtttgtgtgtgtgtgtgtgtgtgtgtgtgttgttgttgttgttttattttgttatatctctgccaggtcttgatatcagggtgatgctggcctcatagaatgagttaa

SEQ ID NO: 23980 - DNA, 339 bp, Homo sapiens
  HUMUT420
  Located on chromosome 19
  Distance between a terminus base of telomere on chromosomal short arm and 5'-terminus of this base sequence : 25747436
  Distance between 3'-terminus of neighbour sequence of sequence listing upward to telomere on chrosomal short arm and 5'-terminus of this base sequence : 16977
cacacactgaaaatccagcaaagcaattatttttctctttttaactggaaatcatattcgtaagttgtggtagatattatcatcagtgtattcatgattcgatttatattttgtgttatctggttataaattttatatagcattcaatttgacaaaatataaatctatttgatttgaatttaatggtgtgtgtgtgtgtgtgtgtgtgtgtgtgtacttccttgaactttaggaaattctacaaatcttatacagatatgaatgtatcaggcttatattttttgcaaggctatatatacatttcttctgtttattaaaatactggaattggtgttatgt

SEQ ID NO: 23981 - DNA, 299 bp, Homo sapiens
  HUMUT5999
  Located on chromosome 19
  Distance between a terminus base of telomere on chromosomal short arm and 5'-terminus of this base sequence : 26020233
  Distance between 3'-terminus of neighbour sequence of sequence listing upward to telomere on chrosomal short arm and 5'-terminus of this base sequence : 272458
agagatggagttgtagtgagccaagatcatgccactgcactccaacctgggcaacagagcaagcctacatctaagaaagaaagagagagaaaggaaggaaggaaggaaggaaggaaggaaggaaggaaggaaggaaggaaggaaggaagggagagagaaaggaatggaaaggaaaggaaaagaaaaaaagaaaagaaaaaatcctggagggaaggccaggggaggagagatgctaggctgtggggctgagcactgggcatgctggacctgttaggtcactgaacatctaactgccaagg

SEQ ID NO: 23982 - DNA, 295 bp, Homo sapiens
  DISD22_0011701
  Located on chromosome 19
  Distance between a terminus base of telomere on chromosomal short arm and 5'-terminus of this base sequence : 26091465
  Distance between 3'-terminus of neighbour sequence of sequence listing upward to telomere on chrosomal short arm and 5'-terminus of this base sequence : 70933
agttatgtgggacctgttccctaccaccctggcaagggccccaactttgtaaatggctaagagaagagagacagagagagagagacacacacacagagagagagagagagacagagagagaaacagacagagaaagagagacagacagagaggagagaggaaagagaggcagagagacaaagagggagtcaaagagagaaagaaagagaaagatagaagtagaaaaaaaaagtgtgccctcttcctttaaaagccagggtaaattaaaaacctatagttgagaaatgaaggtctt

SEQ ID NO: 23983 - DNA, 179 bp, Homo sapiens
  DISD22_0011711
  Located on chromosome 19
  Distance between a terminus base of telomere on chromosomal short arm and 5'-terminus of this base sequence : 26345164
  Distance between 3'-terminus of neighbour sequence of sequence listing upward to telomere on chrosomal short arm and 5'-terminus of this base sequence : 253404
caggagaggaggtaggcccaaagtattggatttaattttttcctttctccttttacatacagggaagtctttctctctttttctctttctctctctttctctctctctcctcccctccccccaacccagggccactttttgatgaaactgaaaggtttccacgtgcaagtgcctgacta

SEQ ID NO: 23984 - DNA, 349 bp, Homo sapiens
  HUMUT1312
  Located on chromosome 19
  Distance between a terminus base of telomere on chromosomal short arm and 5'-terminus of this base sequence : 26462685
  Distance between 3'-terminus of neighbour sequence of sequence listing upward to telomere on chrosomal short arm and 5'-terminus of this base sequence : 117342
cctatctccctttgctgactctcttttcggactcagcccacttgcacccaagtgaaataaaaagccttgttgctcacacaaagtctgttggtggactgtcttgacatggacgcacatgacaggttccaccatgttttctgtgctcaagcagtctgcccaccttggcctcccaaagtgctgcaattacaggtgtgagccaccatgcctggcttgttcgttctatctatctatctatctatctatctatctatctatctatcatctatctatctatctatctacctatgtatctaaccatctttttagcagagatgtggtctcactatgttgcccagggtctgctcatata

SEQ ID NO: 23985 - DNA, 236 bp, Homo sapiens
  chr19.fa.O7frz.26406697
  Located on chromosome 19
  Distance between a terminus base of telomere on chromosomal short arm and 5'-terminus of this base sequence : 26631297
  Distance between 3'-terminus of neighbour sequence of sequence listing upward to telomere on chrosomal short arm and 5'-terminus of this base sequence : 168263
tgagtcataacaccttggtactaagtttaatgatatgttacaatccccacttttggcagggccaggacgcacacacacacacacacacacacaaacaaaggcacatcacataggtgattaaaaaaaaaagatatgtcataatatccctgtaagcagggctcatgcataagagtctcatcacctaggttttagacccagagatttgtcacaatacacaatttatgcaagactcagac

SEQ ID NO: 23986 - DNA, 222 bp, Homo sapiens
  AC020700.4_127983
  Located on chromosome 19
  Distance between a terminus base of telomere on chromosomal short arm and 5'-terminus of this base sequence : 26863280
  Distance between 3'-terminus of neighbour sequence of sequence listing upward to telomere on chrosomal short arm and 5'-terminus of this base sequence : 231747
caggcaaactaagcttcataagcaaaggagtaataaaatccttttcagacaagtaaatgctgaaagaattcatcaccacaaggcctgccttgctagaactcctgaaagaagcattaaatatggaaaaaaacaaacaaacaaacaaacacccataacagccactgcaaagacacactgaaatacaaagatcaatgacactgtgaacaatctgcatcaactagt

SEQ ID NO: 23987 - DNA, 357 bp, Homo sapiens
  AC011494.2_96837
  Located on chromosome 19
  Distance between a terminus base of telomere on chromosomal short arm and 5'-terminus of this base sequence : 26890488
  Distance between 3'-terminus of neighbour sequence of sequence listing upward to telomere on chrosomal short arm and 5'-terminus of this base sequence : 26986
tttcacttctctggttaggtgtactcctagatatttgtgtgtgtgtgtgtgtgtgtgtgtgtgtgtgtgtcagttgtgaaggggattgtgtttttgatttggcttttggcttgcatgttgttaatatacagagattctgccaatttttatacatttattttgtattctgaaattttgctgaagtgatttgtcagtttaaagagcttttctgcagagactgtagggttttctagatacagaattatgtcatctgcaaacagggatagtttgacttcctttcttcctgtttgaatgcctttcattttatctcttgtctgattgctctggccaggacttccaattctcttaaataggagc

SEQ ID NO: 23988 - DNA, 267 bp, Homo sapiens
  AC011494.2_79437
  Located on chromosome 19
  Distance between a terminus base of telomere on chromosomal short arm and 5'-terminus of this base sequence : 26907806
  Distance between 3'-terminus of neighbour sequence of sequence listing upward to telomere on chrosomal short arm and 5'-terminus of this base sequence : 16961
cctgttggaatcttcataatgtagccttgtcctggaatagtctgaaaccaattgtcttggctagagattctgggagtctgtcaaacatgttcttagaatgtgtcttgtctgaaattgtgtgtgtgtgtgtgtgtgtgtgtgtgtgtgtgtgtttagataaagaacgttattcaggtttcttctcaatagtaatcacttgctacatctattttttgtgtgtgtggtactatattcagtgctgctgtaacatctaactttggtctcagc

SEQ ID NO: 23989 - DNA, 259 bp, Homo sapiens
  D19S568
  Located on chromosome 19
  Distance between a terminus base of telomere on chromosomal short arm and 5'-terminus of this base sequence : 26907821
  Distance between 3'-terminus of neighbour sequence of sequence listing upward to telomere on chrosomal short arm and 5'-terminus of this base sequence : -252
ataatgtagccttgtcctggaatagtctgaaaccaattgtcttggctagagattctgggagtctgtcaaacatgttcttagaatgtgtcttgtctgaaattgtgtgtgtgtgtgtgtgtgtgtgtgtgtgtgtgtgtttagataaagaacgttattcaggtttcttctcaatagtaatcacttgctacatctattttttgtgtgtgtggtactatattcagtgctgctgtaacatctaactttggtctcagcagactca

SEQ ID NO: 23990 - DNA, 454 bp, Homo sapiens
  chr19.fa.O7frz.26893535
  Located on chromosome 19
  Distance between a terminus base of telomere on chromosomal short arm and 5'-terminus of this base sequence : 27116832
  Distance between 3'-terminus of neighbour sequence of sequence listing upward to telomere on chrosomal short arm and 5'-terminus of this base sequence : 208752
gtctggccttagtggttaatcatttgcggcatctccgcctttgcccacctggaccctctttccctgacctctctgaagagggcacaaggaaaaaacctgtcttgggcaggctggggggattcttccagtgagtccccagcccaccctgagtaacacaaccagctaacagtcattttacacccaggtgcacatgagcacagcacacacataactctctctctctctcacacacacacacacacacacacacacacacacacacacacagctggactgagctgtcttccaggaagggtcttgggtctggtcacagtatgaggtcctctctcttctgaatatcatctcaatagtggtggcagagagaacccaaacctccccaagcccctgcattgcagactctgtagccggcctggctacccctccccagcacacaggattactatgtccaatagac

SEQ ID NO: 23991 - DNA, 269 bp, Homo sapiens
  D19S434
  Located on chromosome 19
  Distance between a terminus base of telomere on chromosomal short arm and 5'-terminus of this base sequence : 27180506
  Distance between 3'-terminus of neighbour sequence of sequence listing upward to telomere on chrosomal short arm and 5'-terminus of this base sequence : 63220
gcccaccatattcctgtggagtgggatgggatattagctggctggctggctggctggatggatggataaatggatggatggatggatggatggatggatggatggatggatggatggatggatgattagtcaaaatgtaactaacagaaatgattaaccacccaataggcaattctcaggactgagtttcctcttctgtgattaataccttaaaattcaaagacaacctacccataatgatagtcgctctgtgtggtggctttagtcaa

SEQ ID NO: 23992 - DNA, 429 bp, Homo sapiens
  chr19.fa.O7frz.27083737
  Located on chromosome 19
  Distance between a terminus base of telomere on chromosomal short arm and 5'-terminus of this base sequence : 27277313
  Distance between 3'-terminus of neighbour sequence of sequence listing upward to telomere on chrosomal short arm and 5'-terminus of this base sequence : 96538
cagaaagtgcagtattgaaatatcctactataattatgttgctctctctgtgtctctgttattctgtcaatatttgctttatatttgaagccctaatgtgagatacacacacacacacacacacacacacacacacacacacacacgtacatatatacaaatttgttataggttcccagtgaataaatctatttttttttttttttttttgagacagagtctcattctgtgtcccaggctggatggagtgcagtggtgtgatctcggctcactgcaacctctgcctcctgggttcaagtgattctcctgccttagcctcccaagtagctagtattataggtgcccaccaccatgcccagctaatttttgtatttttagtagagatggggtttcactatgttggccaggccagtctcgaactcctgacct

SEQ ID NO: 23993 - DNA, 413 bp, Homo sapiens
  AC008626.5_110040
  Located on chromosome 19
  Distance between a terminus base of telomere on chromosomal short arm and 5'-terminus of this base sequence : 27385817
  Distance between 3'-terminus of neighbour sequence of sequence listing upward to telomere on chrosomal short arm and 5'-terminus of this base sequence : 108075
agaagcaggcactaattatgttacatatatatactaacatatagagtgcttttaaagattgctaatctaggccaggtgcagtggctcacgcctgtaatcccagcactttgggaggctgaggcaggaggatctcgaggtcaggagatcgagaccatcctggccaacatggtgaaaccctgtctctactaaaagtgcaaaaattagcttggcgtggtggcatgtgtctgtaatcccagctacttgggggctgaggcaggagaatcgcttgaaccagggagtcagaggttgcagtgagctgagatagcaccactgcactccagcctggtaacagagtgacactccatctaaaaaataaataaataaataaataaataaataaatgctaatctatacgcttatagacaagcaatacc

SEQ ID NO: 23994 - DNA, 319 bp, Homo sapiens
  chr19.fa.O7frz.27300226
  Located on chromosome 19
  Distance between a terminus base of telomere on chromosomal short arm and 5'-terminus of this base sequence : 27487545
  Distance between 3'-terminus of neighbour sequence of sequence listing upward to telomere on chrosomal short arm and 5'-terminus of this base sequence : 101315
ggcagtaatgaccttatgtatagtgtgtgtttacacacacacaaagacacatacacacacacactaacagaaagagtagttttaaaaattgctaatctttattcttataaacaaacagtactaaccagaatacagtgtttgtgttcagttcttcagtcttgcagtattcaattaaaacagtttttcattttattattattattattattattataatttaagttttagggtacatgtgcacaatgcgcaggttagttacatatgtatacatgtgccatgctggtgtgctgcacccattaacttgtcatttagcattagg

SEQ ID NO: 23995 - DNA, 104 bp, Homo sapiens
  DISO7_10004434
  Located on chromosome 19
  Distance between a terminus base of telomere on chromosomal short arm and 5'-terminus of this base sequence : 27505737
  Distance between 3'-terminus of neighbour sequence of sequence listing upward to telomere on chrosomal short arm and 5'-terminus of this base sequence : 17873
ggagcaataaggatcactgctatatatatatatatatatatatacacacacacacacacacatatatatacacattaaatctaacaggaggtatttcacagtct

SEQ ID NO: 23996 - DNA, 101 bp, Homo sapiens
  DISD22_0011714
  Located on chromosome 19
  Distance between a terminus base of telomere on chromosomal short arm and 5'-terminus of this base sequence : 27785118
  Distance between 3'-terminus of neighbour sequence of sequence listing upward to telomere on chrosomal short arm and 5'-terminus of this base sequence : 279277
tgcatgtacctcatgatgtgtgaacctgtgtgtgtgtgtgtgtgtgtgtgtttgtgtgtgtattccccaaattctcatagaagtgggagtatccaaggaca

SEQ ID NO: 23997 - DNA, 356 bp, Homo sapiens
  chr19.fa.O7frz.27920985
  Located on chromosome 19
  Distance between a terminus base of telomere on chromosomal short arm and 5'-terminus of this base sequence : 27914152
  Distance between 3'-terminus of neighbour sequence of sequence listing upward to telomere on chrosomal short arm and 5'-terminus of this base sequence : 128933
ctgagataggtggatcacaaggtgaggagttcaagaccagaccagcctgaacaagatggtgaaaacctgtctctactaaaaatacaaaaattagccaggcggggcggcacgtgcctgtagtctcagctactcaggaggctgaggcagaagaattgcttgaacccaggaggtgggggttgcagtgagccaagatcacaccattacactccagcctgggtgacagagcgaaactccatctctctctctctctctctctctctctctctctctctctctctctctctctctatatatatatgaaacacatgacattagtcttggtgccaaattcttagatacaacattaaatgcatgag

SEQ ID NO: 23998 - DNA, 101 bp, Homo sapiens
  DISO7_10004435
  Located on chromosome 19
  Distance between a terminus base of telomere on chromosomal short arm and 5'-terminus of this base sequence : 27972787
  Distance between 3'-terminus of neighbour sequence of sequence listing upward to telomere on chrosomal short arm and 5'-terminus of this base sequence : 58279
atgtgatacagtaggaagacctagctaaaaataataattttatatatatatatatatatatatatatatatatatatatcacgtcaatttcagcatgcaga

SEQ ID NO: 23999 - DNA, 414 bp, Homo sapiens
  AC008981.4_14653
  Located on chromosome 19
  Distance between a terminus base of telomere on chromosomal short arm and 5'-terminus of this base sequence : 28263041
  Distance between 3'-terminus of neighbour sequence of sequence listing upward to telomere on chrosomal short arm and 5'-terminus of this base sequence : 290153
gaagtagacattccatgcaaacattaatcaaataagagcagaaagagtcaaaataatatcacacaagctacatcttaagtcagaaagtataatattttataaaatgtgcttgaaattgaaactccaaagaaacaaagaaggacatcaaaaaataatagattcattcacagggaatctatgacaaatttgtgtgtgtgtgtgtgtgtgtgtgtgtgtgtgtctcacattagggttccaagtatataaagcaaatattgacagaatggaagaaacacacagaaagcaatataattagaacaatatattttaataccacactttttgtaataaaaataaaacaagaaagaatgttaataagagaacagactacttaaaggcagtataaaacaattattccaaacagagttatggaga

SEQ ID NO: 24000 - DNA, 398 bp, Homo sapiens
  chrX.fa.O7frz.9579597
  Located on chromosome 19
  Distance between a terminus base of telomere on chromosomal short arm and 5'-terminus of this base sequence : 42886963
  Distance between 3'-terminus of neighbour sequence of sequence listing upward to telomere on chrosomal short arm and 5'-terminus of this base sequence : 14623508
gttggaaatactctttggctacaatctgcaaaaggagatttgtgagcccactgtactctatggcaaaatatgtgtgtgtgtgtgtgtgtgtgtgtgtgtgtgtgtgtgtgtatcagtgagtctgctttgtgatgcatggattcctctcccaaatttaaacatttgtttagattcagaaagttggaaacacctttttgtagaacctgcaaacggaaatttgtgagaccattgaggcctataatgcaaaacagaaaatctccagataaaaactagaagagagctctttgtgaaaccttttggggtgtgtttattcatttgacagaattaaacctttctgtcaatatagcatgtttgaaacattttttggatagaatctgtgaaggttacatttaagagcc

SEQ ID NO: 24001 - DNA, 167 bp, Homo sapiens
  D19S419
  Located on chromosome 19
  Distance between a terminus base of telomere on chromosomal short arm and 5'-terminus of this base sequence : 43100622
  Distance between 3'-terminus of neighbour sequence of sequence listing upward to telomere on chrosomal short arm and 5'-terminus of this base sequence : 213261
gattatcggggcaggttccccaatagaaaacaaataactttttagtataactataaaataaacatttgcgtgtaatatttctattcccacctattatatattacatacatacacacacacacacacacacacacatccttttgcttacctgaatttcatatttaatg

SEQ ID NO: 24002 - DNA, 377 bp, Homo sapiens
  AC006504.1_128709
  Located on chromosome 19
  Distance between a terminus base of telomere on chromosomal short arm and 5'-terminus of this base sequence : 43135391
  Distance between 3'-terminus of neighbour sequence of sequence listing upward to telomere on chrosomal short arm and 5'-terminus of this base sequence : 34602
tgaatagcacctctgaacctacctagggcctggagagccttgccaaactgaagggggaaatacaggcctggctgcctttttcacctgctgattgtagagccacagcgtcttgagtgaacatagggagtaaccaggaagctgtaacagcaggccttgggtaagaccaagcactctgctggattcaggtctgacctaatgcagtcatagttgtgatggccacagagatgcactttcatgtgtctcagaacacacacacacacacacacacacacacacacacagagaaactccatttgtttgggagaaagtaagggaagaaaagaagagtctctgcctggtaattcagaaaattctcctggatcttgttcaagacaatc

SEQ ID NO: 24003 - DNA, 150 bp, Homo sapiens
  D19S931
  Located on chromosome 19
  Distance between a terminus base of telomere on chromosomal short arm and 5'-terminus of this base sequence : 43432811
  Distance between 3'-terminus of neighbour sequence of sequence listing upward to telomere on chrosomal short arm and 5'-terminus of this base sequence : 297043
gggtcacatggctaggctaacacaatctctggaagaagaagaagaccatcgtgactgggccagcaaagcctctgctccattggttccattcaacacacacacacacacacacacacaaacacacacagtgcctactgcgggcaaacagct

SEQ ID NO: 24004 - DNA, 259 bp, Homo sapiens
  D19S870
  Located on chromosome 19
  Distance between a terminus base of telomere on chromosomal short arm and 5'-terminus of this base sequence : 43450878
  Distance between 3'-terminus of neighbour sequence of sequence listing upward to telomere on chrosomal short arm and 5'-terminus of this base sequence : 17917
ccactgtctgttaggcagcaaagagtctttaaactgtggaaagacgggacacgtgacgtgcctctctctttgtcccttgggcagaaatgtgctgagagaacacttccacctacctcacaatgttgaatcctcaccactacctgtgagtcttttgttccttttgtgtgtgtgtgtgtgtgtgtgtgtgtgtgcgtgtgtgtgtgtgtgtgacagagtcttactctgctgcccaggctggagtgcagtggcaccatcttgg

SEQ ID NO: 24005 - DNA, 233 bp, Homo sapiens
  D19S222
  Located on chromosome 19
  Distance between a terminus base of telomere on chromosomal short arm and 5'-terminus of this base sequence : 43535304
  Distance between 3'-terminus of neighbour sequence of sequence listing upward to telomere on chrosomal short arm and 5'-terminus of this base sequence : 84167
ttgttgaaatgtatccagtaaatcggaaaaggccaaaataatcttcaggaaaaattatctgatttcagaaaattgcaactatcataagtgtgtgtgtgtgtgtgtgtgtgtgcgcatgaaaatctccatctcctcattctcaaacaaaaaagtcaaggtcaattatgtgtcaataaagcatttttaaaaaatttcatgacttcctaagagcacagtttcaaataggacatttc

SEQ ID NO: 24006 - DNA, 473 bp, Homo sapiens
  AC020905.7_148688
  Located on chromosome 19
  Distance between a terminus base of telomere on chromosomal short arm and 5'-terminus of this base sequence : 43548028
  Distance between 3'-terminus of neighbour sequence of sequence listing upward to telomere on chrosomal short arm and 5'-terminus of this base sequence : 12491
aattgcaaatggaagacttttaagtatcaattaggcagggatttgagattaagcatattatctagggctgggcaaggtggctcatgcctgtaatcccagcactttgaggggccaaagcaggaagatcccttgagcccagggttcaagatcagcctgggcaacatagtaagaccccatctctacaataataatattgtagagatagtaaaaccccatctctacagctaataatgataataataataataataataataaattagacaggcatggtggtgcatgcctgtatccaagccactggaaaggctgaggtgggagggtctcttgagcacaggagtttaaggctgcagtgaactgtgattgtgccactgccctccagcctgggcaacagagtgaaactctgtctcagcaaaacaaaacaaaacatttaatgtcattaatcctaaaattcagagaccgccaacactcaaata

SEQ ID NO: 24007 - DNA, 450 bp, Homo sapiens
  chr19.fa.O7frz.33036240
  Located on chromosome 19
  Distance between a terminus base of telomere on chromosomal short arm and 5'-terminus of this base sequence : 43664341
  Distance between 3'-terminus of neighbour sequence of sequence listing upward to telomere on chrosomal short arm and 5'-terminus of this base sequence : 115840
acttgttaatctggttgtacaaagccatggatgaatgaatggatagatggatggatggatggatggatggatggatggatggacggacagatggacagacggatggatggataaatggatggatagatggatggatagatgaatagatggacaaatggatggatggatgaggtgatgggtggcccatctggtccaaatatgaaaagaagatcatagcagtagtatccatcattccgtaattatctagtcagaaaagatatagatcagcccagaaaaatttttctccggttgcaatgtattgagattgtacaaatccttctgtccttcctttggatatgacacattgactatgacaaccacgttatggagctggtgctcaagccaaattttaagttgtcaagaatgtgaaagcacctgaaatgcaaaggacttgtatgacagctttcagtt

SEQ ID NO: 24008 - DNA, 310 bp, Homo sapiens
  DISO7_00020035
  Located on chromosome 19
  Distance between a terminus base of telomere on chromosomal short arm and 5'-terminus of this base sequence : 43706148
  Distance between 3'-terminus of neighbour sequence of sequence listing upward to telomere on chrosomal short arm and 5'-terminus of this base sequence : 41357
cagtcactaaccacggtcatccatctcctgcctccgcgcagctcccacagacagcctgaacggaacctgttaattacgctcccaatcagtccatagatcaaacgtacaaacgagcagcccgttccttccttattattattgccactgccacactcctgcccataatccctggcccacagccaggtctttgtgttgttttgaaaccagcaaaagcaacagcatgaatcttctgttaaaacacacacacacacacacacacacacacacacacacacacacacacacacacaggcactccactaggctattt

SEQ ID NO: 24009 - DNA, 357 bp, Homo sapiens
  AC005394.1_25314
  Located on chromosome 19
  Distance between a terminus base of telomere on chromosomal short arm and 5'-terminus of this base sequence : 43884523
  Distance between 3'-terminus of neighbour sequence of sequence listing upward to telomere on chrosomal short arm and 5'-terminus of this base sequence : 178065
atttagcaaccggcattataccactaggcctggcatttcattccaggtcggggtctgcaaacaccttcaggggcagttaaggcatgactggctaatccacctggagggtcacagctatgactgcctcaccttttctaaacaggccaacagtggtgtgtatgaggacaacactcccccaaagctgtacccttacacacacacacacacacacacacacacacacacacacttatacacacacgcacacagtaatacacacactcatacacacatgcacacacaagctcatatggtacataccttgagagaaactgttcttgacaaatcactactacctcctaccatcaatgaacttga

SEQ ID NO: 24010 - DNA, 165 bp, Homo sapiens
  AC007206.1_16494
  Located on chromosome 19
  Distance between a terminus base of telomere on chromosomal short arm and 5'-terminus of this base sequence : 43923393
  Distance between 3'-terminus of neighbour sequence of sequence listing upward to telomere on chrosomal short arm and 5'-terminus of this base sequence : 38513
atttaggtaagccttgtggtaaacacacacacacacacacacacacacacacacacaaaaatctgacatagatacacaaaagataaagagaagggattgcccctacaaaaagtcatatcacataggaagacagcgagagagaaagaatggaacaaaggaagtaca

SEQ ID NO: 24011 - DNA, 232 bp, Homo sapiens
  DISO7_10007406
  Located on chromosome 19
  Distance between a terminus base of telomere on chromosomal short arm and 5'-terminus of this base sequence : 44139444
  Distance between 3'-terminus of neighbour sequence of sequence listing upward to telomere on chrosomal short arm and 5'-terminus of this base sequence : 215886
cagacttcagagctctacaaaccatatatatgtgtgtgtgtgtgtgtgtgtgtgtgtgtgtgtgtgtgtgtgtgtgtgtgtgtgtataaatatatgtaactctctctaaatataaaactctctatataactctctatatacatagagttatatagagttttatatagttatatatatatatatatacatatatttaaaatatatatggtttgtagagtacttggtggtgtaa

SEQ ID NO: 24012 - DNA, 222 bp, Homo sapiens
  DISO7_00020062
  Located on chromosome 19
  Distance between a terminus base of telomere on chromosomal short arm and 5'-terminus of this base sequence : 44406476
  Distance between 3'-terminus of neighbour sequence of sequence listing upward to telomere on chrosomal short arm and 5'-terminus of this base sequence : 266800
agatctgggctggaactggactccaaaatgtgggaactaacacatgttttatcaggctgccagctgaggggactttgctgaatttgtggtctcaagaccctgggagtgacagctctcctcccttcccgccccccacacaccagacacacacacacacgcacacagacacacacacacacacacacacacacacacacacacagagtcaccagtcaggtatgc

SEQ ID NO: 24013 - DNA, 430 bp, Homo sapiens
  AC007786.1_7208
  Located on chromosome 19
  Distance between a terminus base of telomere on chromosomal short arm and 5'-terminus of this base sequence : 44506322
  Distance between 3'-terminus of neighbour sequence of sequence listing upward to telomere on chrosomal short arm and 5'-terminus of this base sequence : 99624
gttgatgttaaatcctggtgacaggccaagcgtggtagcttatgtctataatcccaacagtttggaaggctgaggtaggcagatcacttgagcccaggagttcaagaccagccctggcaacatagcaagtccccatctctacaaaacaaaaaaattagccagatgtggtggtgcaagcctgtagtcctagctgtttgggagactgaagcgggaggacatcttgagcccaagaagtcgagactacagtgattgcaacactgcactccagcccgaatgacaaagcaaaactctgtctaaaaataaacaaatacatacatacatacatacatacatacatacatacataagtcctggtgacagagaagttctcaaaactccttcttggacacattttacaatgtttgtaacatcatagacatcctccatttga

SEQ ID NO: 24014 - DNA, 290 bp, Homo sapiens
  AC007786.1_123657
  Located on chromosome 19
  Distance between a terminus base of telomere on chromosomal short arm and 5'-terminus of this base sequence : 44623042
  Distance between 3'-terminus of neighbour sequence of sequence listing upward to telomere on chrosomal short arm and 5'-terminus of this base sequence : 116290
ggaagctaatggtgtctactgtagccaaatcagcacatttatttatttatttatttatttatttatttatttatttggagaccaagtctcactctgtcgcccaggctggactgcagtgccgtgatcttggctctctgcaacctccgcctcccaggttcaagtgattctcatgcctcagactcctggtgggactgcaggtgtgagccaccacacccggctaatttttgtatttttagtaatgacgggctttcaccatgttggccaggctggtctcgaactcctgatctcag

SEQ ID NO: 24015 - DNA, 144 bp, Homo sapiens
  D19S932
  Located on chromosome 19
  Distance between a terminus base of telomere on chromosomal short arm and 5'-terminus of this base sequence : 44686265
  Distance between 3'-terminus of neighbour sequence of sequence listing upward to telomere on chrosomal short arm and 5'-terminus of this base sequence : 62933
gcctcaaataggcaggtatgatttgtctaagggtcatgaaatgggagagcagtgtgtgtgtgtgtgtgtgtgtgtgtgtgcacacgtgcacatgtgcgtgaattggggccgggagcgggtggtgtttgggttaaaaggcttccc

SEQ ID NO: 24016 - DNA, 113 bp, Homo sapiens
  D19S875
  Located on chromosome 19
  Distance between a terminus base of telomere on chromosomal short arm and 5'-terminus of this base sequence : 44705892
  Distance between 3'-terminus of neighbour sequence of sequence listing upward to telomere on chrosomal short arm and 5'-terminus of this base sequence : 19483
aacttggtttatgatgtctcttgcaaggtagatcgtgtgtgtgtgtgtgtgtgtgtgtgtgtgtgtgtgtgtgtgtgtgtgcttgtatgcatgtagtagtcatcacagaacca

SEQ ID NO: 24017 - DNA, 290 bp, Homo sapiens
  AC007759.1_21755
  Located on chromosome 19
  Distance between a terminus base of telomere on chromosomal short arm and 5'-terminus of this base sequence : 44737403
  Distance between 3'-terminus of neighbour sequence of sequence listing upward to telomere on chrosomal short arm and 5'-terminus of this base sequence : 31398
ttaagtggccatctgttatcactcaccaccaggatataatcatataatcttggaataaagaaaagtcctttgtagcaaataaatttaggagggtgtgtgtgtccgtgtgcatacgctacctgcgtgtgtgtgtgtatatacacacatatatatacacacacgcatgtatgtgtatatatatgcatatatgtgtatacacacacacacacacacacacacacacacacacacactacctgtccttgtttttcttttctcattttgcagcagtctaggaacaagtccattgg

SEQ ID NO: 24018 - DNA, 173 bp, Homo sapiens
  HUMUT8112
  Located on chromosome 19
  Distance between a terminus base of telomere on chromosomal short arm and 5'-terminus of this base sequence : 44785220
  Distance between 3'-terminus of neighbour sequence of sequence listing upward to telomere on chrosomal short arm and 5'-terminus of this base sequence : 47527
atggggaggaggaaaaagcccccagacccccagacttcacttcctccaagatcagcagaggttttctttctttctttctttctttctttctttctttctttctttctttctttctttctttctttcttttttttagatgagatcttgctctgtggtccaagctggagtgcagt

SEQ ID NO: 24019 - DNA, 215 bp, Homo sapiens
  D19S919
  Located on chromosome 19
  Distance between a terminus base of telomere on chromosomal short arm and 5'-terminus of this base sequence : 44819554
  Distance between 3'-terminus of neighbour sequence of sequence listing upward to telomere on chrosomal short arm and 5'-terminus of this base sequence : 34161
gatgaccccagtaatgacgcataagcatcacacacacacacacacacacacacacacacacaattcacatgcctgtacatagtctcacacacagtctcacacatgcacactcacacaagttcacacacatgcttacagatgcacattcccatacatccacatgcatccacatacatgtgcacacacatacacataacgggtacaattcacacatc

SEQ ID NO: 24020 - DNA, 417 bp, Homo sapiens
  AF238868.1_2022
  Located on chromosome 19
  Distance between a terminus base of telomere on chromosomal short arm and 5'-terminus of this base sequence : 44825963
  Distance between 3'-terminus of neighbour sequence of sequence listing upward to telomere on chrosomal short arm and 5'-terminus of this base sequence : 6194
tctttctgcttaattcagtgagtgtttgtggaacatctactataggcaattctctttgctaggtgttttggagggagatggccatgagaagaggagaaattaagtcagcttcatggtcagagacatttcctaaaggagatactacattgctgttgctgctgctgctgctgctgttgtttgttgttgttgttgttgttgttgttgttgttgttgttgttgttgttgtttagatcaggggtcccgaacccctgggccatggactggtaccagtctgtgaccacccgtggcctattgggaattgggccacacagtgagtgagcaaagcatcatctgtgtttacagccattccccatcgctggcattactgcctgagctccccctcctgtcagattagtggtggcattagatgctcataac

SEQ ID NO: 24021 - DNA, 325 bp, Homo sapiens
  AC011474.3_127331
  Located on chromosome 19
  Distance between a terminus base of telomere on chromosomal short arm and 5'-terminus of this base sequence : 44826061
  Distance between 3'-terminus of neighbour sequence of sequence listing upward to telomere on chrosomal short arm and 5'-terminus of this base sequence : -319
attaagtcagcttcatggtcagagacatttcctaaaggagatactacattgctgttgctgctgctgctgctgctgttgtttgttgttgttgttgttgttgttgttgttgttgttgttgttgttgttgtttagatcaggggtcccgaacccctgggccatggactggtaccagtctgtgaccacccgtggcctattgggaattgggccacacagtgagtgagcaaagcatcatctgtgtttacagccattccccatcgctggcattactgcctgagctccccctcctgtcagattagtggtggcattagatgctcataacagcgtg

SEQ ID NO: 24022 - DNA, 471 bp, Homo sapiens
  AC011474.3_31967
  Located on chromosome 19
  Distance between a terminus base of telomere on chromosomal short arm and 5'-terminus of this base sequence : 44975340
  Distance between 3'-terminus of neighbour sequence of sequence listing upward to telomere on chrosomal short arm and 5'-terminus of this base sequence : 148954
gaagatgctgatcttcagctagtcctctccatgctgcaaataatagagcatttttaatttgtgcagcagggatgttaatcttttgccatgtaatccagtccttggggaatgccataaatatgtggcactgcgcatgtgaggctccctgaggagggcactcaatcaacccagccctggctttcctgcctgtctgtatgtcaatctctcaacactcaattaggaaatatatgataggctaatagaggatggatggatggatggatggatagatggacggatggatggataaatggatatagaggcagagacagacaaatgttcaaagattatcagacatcccttacccgcctcccccacccataaacactttatgacttctggattttgcctgaaccaacagcacaaataaatcccaaggaattattcacatttcaaaaggattcacttcagaatgcctttaaatagcaagct

SEQ ID NO: 24023 - DNA, 331 bp, Homo sapiens
  AC010505.6_3209
  Located on chromosome 19
  Distance between a terminus base of telomere on chromosomal short arm and 5'-terminus of this base sequence : 45098197
  Distance between 3'-terminus of neighbour sequence of sequence listing upward to telomere on chrosomal short arm and 5'-terminus of this base sequence : 122386
ttgacacctgagaatcctacagcccagcgagtgaggctgttccgatccactcttcctggccagctgtcaaaacactctgcacctgctctcggaccataacaagtattactcatgaaggtgacagttcctcaggcccacagtaataaagacacacacacacacacacacacacacacacacacacacacacacacaggcatttaaaaaaatgcaataggtcaacaacactcaatctaaaaccctaggggctgggcacggtagctcacgcctctaatcccagcactttgggaggctgaggtgagtggatcacttgaggtcatgagttcaagac

SEQ ID NO: 24024 - DNA, 196 bp, Homo sapiens
  AC008989.6_31793
  Located on chromosome 19
  Distance between a terminus base of telomere on chromosomal short arm and 5'-terminus of this base sequence : 45249952
  Distance between 3'-terminus of neighbour sequence of sequence listing upward to telomere on chrosomal short arm and 5'-terminus of this base sequence : 151424
ctgaaaagctttaaagtacagcacactaatgattcctgagatataggtataggtctctctctctccccgtttgtctgtctgtctatctatctatctatctatctatctatctatctatcatctatctatctaatctgtcatcgagagagtgattgtagatagaggcacagatacagatacagaaactggaagctat

SEQ ID NO: 24025 - DNA, 143 bp, Homo sapiens
  AC008989.6_10970
  Located on chromosome 19
  Distance between a terminus base of telomere on chromosomal short arm and 5'-terminus of this base sequence : 45270808
  Distance between 3'-terminus of neighbour sequence of sequence listing upward to telomere on chrosomal short arm and 5'-terminus of this base sequence : 20660
tcactaccagacttgtatcctaaattttatacagatgatagatagatagatagatagatagatagatagatagatagatagatagacagacagatagatagacagatgatagatagataattgatagaggtagatgctggata

SEQ ID NO: 24026 - DNA, 206 bp, Homo sapiens
  G08036
  Located on chromosome 19
  Distance between a terminus base of telomere on chromosomal short arm and 5'-terminus of this base sequence : 45525174
  Distance between 3'-terminus of neighbour sequence of sequence listing upward to telomere on chrosomal short arm and 5'-terminus of this base sequence : 254223
taggtttttaaggaacaggtggtgttggttacatgaataagttctttagcagtgatttctgatattttggtgcacccattacccgaataaaaatcttctctctttcttcctctctccttccttccttccttccttccttccttccttccttccttccttccttcctaccttctttccttcaacagaatcttattctgttgcccagg

SEQ ID NO: 24027 - DNA, 268 bp, Homo sapiens
  D19S590
  Located on chromosome 19
  Distance between a terminus base of telomere on chromosomal short arm and 5'-terminus of this base sequence : 45653294
  Distance between 3'-terminus of neighbour sequence of sequence listing upward to telomere on chrosomal short arm and 5'-terminus of this base sequence : 127914
ctccagagaagctgaaccaataggatggagatctctttctctatttatctatctaattaagtatgtatgtattatgtatgtatgtatctatctatcaaatctactatctatgtaatctctatctatcatctatctaatctactatctatgtttatctatctatctatctatctatctatctatctatctatctaatctattcatccatctcgaggttgattttaaagaattagctcatgcaattggaacagctggcaagttgaaattt

SEQ ID NO: 24028 - DNA, 253 bp, Homo sapiens
  AC005760.1_11182
  Located on chromosome 19
  Distance between a terminus base of telomere on chromosomal short arm and 5'-terminus of this base sequence : 45761719
  Distance between 3'-terminus of neighbour sequence of sequence listing upward to telomere on chrosomal short arm and 5'-terminus of this base sequence : 108157
tttcaattgctatccattcatccatccatccttccctctgtcaattcatccatccatccattcatccacacatctattcatccattcatccatccatccatccatccatccatccatccatccatccgtcaatttgttcatccatcaatccatccatccatccatccatccgtcaatttatccatccatccatccatccgtcaatttgtcatccatccatccagccagccatctgtcaatttgtccatccgtc

SEQ ID NO: 24029 - DNA, 118 bp, Homo sapiens
  D19S405
  Located on chromosome 19
  Distance between a terminus base of telomere on chromosomal short arm and 5'-terminus of this base sequence : 45833746
  Distance between 3'-terminus of neighbour sequence of sequence listing upward to telomere on chrosomal short arm and 5'-terminus of this base sequence : 71774
caatgtgcctggcctcctttacattttttaggctttttgttgctttattactaaattacacacacacacacacacacacacacacacgcgcacacgcaccccacaccacgaagtagct

SEQ ID NO: 24030 - DNA, 288 bp, Homo sapiens
  AC011504.2_64075
  Located on chromosome 19
  Distance between a terminus base of telomere on chromosomal short arm and 5'-terminus of this base sequence : 46118759
  Distance between 3'-terminus of neighbour sequence of sequence listing upward to telomere on chrosomal short arm and 5'-terminus of this base sequence : 284895
tagattgcatgatcatggaagggtggccagccctccccaacaccattcattcattcattcattcattcggctggtcaccagtatttattgaacacactgtgccaggaggctctaagggacacaagagtgagaaaaacagaccccatcccagccttcaaagaggtggcagtttggtggcagagacagatattaatcacacatatacgctcagtgcaaactctgagaaatgtcctgaaggttaaattctgggatgattgggcagacctgacttagtctggaagatgagag

SEQ ID NO: 24031 - DNA, 219 bp, Homo sapiens
  AC011504.2_53483
  Located on chromosome 19
  Distance between a terminus base of telomere on chromosomal short arm and 5'-terminus of this base sequence : 46129267
  Distance between 3'-terminus of neighbour sequence of sequence listing upward to telomere on chrosomal short arm and 5'-terminus of this base sequence : 10220
gaaggaataccactggttagaggaaaagaaaattaaaaaattaaataaatctcaaaccaatgcacgaaaggtttaacaaaggatcacagatgcaatttttgtaatacctctctctctgtctttttgttgttgttgttgttgttgttgttgtttttgagatggagtttcgctcttgttgcccaggctggagtgcagcagtatgatctcagctcacttcaa

SEQ ID NO: 24032 - DNA, 172 bp, Homo sapiens
  D19S928
  Located on chromosome 19
  Distance between a terminus base of telomere on chromosomal short arm and 5'-terminus of this base sequence : 46258964
  Distance between 3'-terminus of neighbour sequence of sequence listing upward to telomere on chrosomal short arm and 5'-terminus of this base sequence : 129478
gagtctgattatgttcagtctttgctcctaccctgtttgacacaagggtgtgtgtgtgtgtgtgtgtgtgtgtgtgtttgtatgtgtttatcctcttcaatagatatcaatgatttcataaagccccatctatacctcctttgaaaaagccacagataacttgtctaaggga

SEQ ID NO: 24033 - DNA, 379 bp, Homo sapiens
  chr19.fa.O7frz.35990216
  Located on chromosome 19
  Distance between a terminus base of telomere on chromosomal short arm and 5'-terminus of this base sequence : 46313252
  Distance between 3'-terminus of neighbour sequence of sequence listing upward to telomere on chrosomal short arm and 5'-terminus of this base sequence : 54116
ctgcagtactaatggtcctctcaggcctgtgctttttcaagctgagtcaacctctatgccgcatacatagtgtgtgagtggggatgtgtgtgtgtgtgtgtgtgtgtgtgtgcacatgcatatgtgaactatgcttctttaaatgtttgcagacatgtggttcagtaaggtaaagtctatggaaatactaatgctcttcatattacagtaattatataaggcacttagagcattgggatctattattttcctttactggtagaaagtcttttttttttaagtcattaaatgcaagggagtcttttacgtccatattattggaggataatcggaattcttcctctagaagaaaaggaaaagagcaaaggatgacaaagtg

SEQ ID NO: 24034 - DNA, 457 bp, Homo sapiens
  HUMUT7989B
  Located on chromosome 19
  Distance between a terminus base of telomere on chromosomal short arm and 5'-terminus of this base sequence : 46423893
  Distance between 3'-terminus of neighbour sequence of sequence listing upward to telomere on chrosomal short arm and 5'-terminus of this base sequence : 110262
taaccggtgaatgaatgcaaatcattaaagaggaatgtgaagtagtggtgttgatgatgatgatgatgatgataatggcgatgatgataataatgatgatggtgatgatgttgctgatcaaggtgatggtaagatgatgatgatgatggttatgatgatggtgatggtgatagtgataattaccatctttgtccctattaacaaatggtggtgatgataataatgatggtgatgatgatggtggtgatgatggtgatggtgatgatggtaatgatggtggtgatggtgatgatgatgatagtggtgatgaggatgacaatactgatgatgatgacagtgataagtagtagtagtatttctgtagaggctatcaagattagctttgaaagaactcttcagagataaattctaaaagccatttatgcaatggataaattgccaaaatcagtgttaacct

SEQ ID NO: 24035 - DNA, 323 bp, Homo sapiens
  AC020897.6_89687
  Located on chromosome 19
  Distance between a terminus base of telomere on chromosomal short arm and 5'-terminus of this base sequence : 46543296
  Distance between 3'-terminus of neighbour sequence of sequence listing upward to telomere on chrosomal short arm and 5'-terminus of this base sequence : 118946
aggaactcatgtaatcacgagtccttaaaaatggggaaccttggccagacgtggtggcttacgcctgcaatcccagcactttgggaggctgaggtgagaggatcgcttgaggccaggagatcaagaccagcctgggcaacctagtgagacaccgtctctacaaaaataaataaataaataaataaataaataaataaataaataaatagatagataaataaataattagttgggtgtggtagcacatgcctgtagtcccagctacttggtaggctgaggtgggagaatagcttgggcccaggaggtcaaggctgtagtgagcc

SEQ ID NO: 24036 - DNA, 186 bp, Homo sapiens
  Z66676
  Located on chromosome 19
  Distance between a terminus base of telomere on chromosomal short arm and 5'-terminus of this base sequence : 46822335
  Distance between 3'-terminus of neighbour sequence of sequence listing upward to telomere on chrosomal short arm and 5'-terminus of this base sequence : 278716
agagccctctgtatttgtggggcctcatgtgtataccttctcccaggtaggtctgtgaatgatggactctaattttagttcttataacgtgtgtgtgtgtgtgtgtgtgtgtgtgtgtgtgtgtgacagagagagggagaactaaatacattatgtacatctgaaaagtcaccaaagacaagaaaa

SEQ ID NO: 24037 - DNA, 211 bp, Homo sapiens
  DISO7_00003967
  Located on chromosome 19
  Distance between a terminus base of telomere on chromosomal short arm and 5'-terminus of this base sequence : 46940647
  Distance between 3'-terminus of neighbour sequence of sequence listing upward to telomere on chrosomal short arm and 5'-terminus of this base sequence : 118126
cacctgctagcatgcactcactctctctctctctctctctgacacacacacacacacacacacacacacacacacacacacagcacttcccacagtcccacaccataagaaaacctacagaacagctcctttgatccgaatcctctgctagcattctcctggctcctcactcactcctaggccacattcttccctggttccacggctactt

SEQ ID NO: 24038 - DNA, 228 bp, Homo sapiens
  AC008794.7_106839
  Located on chromosome 19
  Distance between a terminus base of telomere on chromosomal short arm and 5'-terminus of this base sequence : 47150421
  Distance between 3'-terminus of neighbour sequence of sequence listing upward to telomere on chrosomal short arm and 5'-terminus of this base sequence : 209563
ggtggatttattccttcatacacacacacacacacacacacacacacacacacacacacacactacccaggctggagtgcagtggcgcgatctcagctcactgctaagtctacctcctgggttcaagccattgtcctgcctcagcctcccaagtagctgggattacaggaatgcaccaccgcacccagttgatttttgtgtttttagtagaaacgaagtttcaccatg

SEQ ID NO: 24039 - DNA, 130 bp, Homo sapiens
  D19S430
  Located on chromosome 19
  Distance between a terminus base of telomere on chromosomal short arm and 5'-terminus of this base sequence : 47410659
  Distance between 3'-terminus of neighbour sequence of sequence listing upward to telomere on chrosomal short arm and 5'-terminus of this base sequence : 260010
ctagcctgactgtgcactccctctggtgacccagtgcctttatctatctatctatctatctatctatctatctatctatatgtatatatatatgccacaatttctttatccactcattgatgtatgggca

SEQ ID NO: 24040 - DNA, 287 bp, Homo sapiens
  G08033
  Located on chromosome 19
  Distance between a terminus base of telomere on chromosomal short arm and 5'-terminus of this base sequence : 47429761
  Distance between 3'-terminus of neighbour sequence of sequence listing upward to telomere on chrosomal short arm and 5'-terminus of this base sequence : 18972
aacacatctcggtggatagagatagatagatacatagatagatacatagatagacaaatgataggtagataatagacagatgatagatagatagaggttagatagatacatagactgataataaatagatgataggtagatagatgattgatagatagatagatagatagatagatagatagatagatagacagatagatctgtgattgcttacctacaataaaacctctttaaggaaggtccccaggggttgggtgttctacgaaactaagctcaaccatttctgc

SEQ ID NO: 24041 - DNA, 373 bp, Homo sapiens
  AC011456.2_46515
  Located on chromosome 19
  Distance between a terminus base of telomere on chromosomal short arm and 5'-terminus of this base sequence : 47529012
  Distance between 3'-terminus of neighbour sequence of sequence listing upward to telomere on chrosomal short arm and 5'-terminus of this base sequence : 98964
acattgaatgtgctttcagaacatttgttttatcttgatcttacattggcctttctcttttacctgctacacagacacacacacacacacacacacacacacacacacacatctctgatgatccttggttgtctactcatagataagaagggtgaggtaggtgggtgagcttcctgcaaggcaagttctccaagtgaagattctgctaagagttctttgggaggcagagaatggcagaaaaaaaattgaataacaggttttggattaggtgaggagggggttggaagagcgggtaagtcaggggagggtggggggaggagacacctgatacctaccaaaatgaggagttcagtcagtcctatgcattgtcatt

SEQ ID NO: 24042 - DNA, 300 bp, Homo sapiens
  AC011456.2_74939
  Located on chromosome 19
  Distance between a terminus base of telomere on chromosomal short arm and 5'-terminus of this base sequence : 47557369
  Distance between 3'-terminus of neighbour sequence of sequence listing upward to telomere on chrosomal short arm and 5'-terminus of this base sequence : 27984
ctgccatgcaagataggagccctgtgttgctagatattctgattttttcaagagaatccagaactggattgctgtggaacttgcccagctttatatttgtcctcaagaaagaaagaaagaaagagagagagagagagagagagaaagaaagaaagaaagaaagaaagaaagaaagaaagaaagaaagaaagaaggaaagaaagaaagcaacaaaagacattgtgctttccaaacaaaatacacccaaaccagagccaagttcatgggaagctttgggttgaaagtcagaatatgcagtct

SEQ ID NO: 24043 - DNA, 206 bp, Homo sapiens
  AC011456.2_88491
  Located on chromosome 19
  Distance between a terminus base of telomere on chromosomal short arm and 5'-terminus of this base sequence : 47571010
  Distance between 3'-terminus of neighbour sequence of sequence listing upward to telomere on chrosomal short arm and 5'-terminus of this base sequence : 13341
agattgtgccaatgcagtccagcctgagtgacagagtgagaccctatctcgaatatatatatatatatatatatatatatatattccaacaacttaaataaataagacctagtatttgctagcacaacagggtgacaatagtaaaaaataattatttgtttaaaaataactaagagtataatctaactgtctgaaacacaaaggat

SEQ ID NO: 24044 - DNA, 151 bp, Homo sapiens
  AC005265.1_38351
  Located on chromosome 19
  Distance between a terminus base of telomere on chromosomal short arm and 5'-terminus of this base sequence : 47688623
  Distance between 3'-terminus of neighbour sequence of sequence listing upward to telomere on chrosomal short arm and 5'-terminus of this base sequence : 117407
gacatcttcaccttggaaataagctgccagcttgctctgcaggcttgcttgagaagagctgatctcctctctctctctctctctctctctctctctctctctctctatctatctatctatctatctatctaatgctagcaactcatcagtg

SEQ ID NO: 24045 - DNA, 230 bp, Homo sapiens
  AC005265.1_38314
  Located on chromosome 19
  Distance between a terminus base of telomere on chromosomal short arm and 5'-terminus of this base sequence : 47688623
  Distance between 3'-terminus of neighbour sequence of sequence listing upward to telomere on chrosomal short arm and 5'-terminus of this base sequence : -151
gacatcttcaccttggaaataagctgccagcttgctctgcaggcttgcttgagaagagctgatctcctctctctctctctctctctctctctctctctctctctctatctatctatctatctatctatctaatgctagcaactcatcagtgaacccctccctaggaaagcagccatttcaatcaaatatctgcaggtgcagagcctagggcatgacgctgagcaagatct

SEQ ID NO: 24046 - DNA, 285 bp, Homo sapiens
  DISO7_00020169
  Located on chromosome 19
  Distance between a terminus base of telomere on chromosomal short arm and 5'-terminus of this base sequence : 47815019
  Distance between 3'-terminus of neighbour sequence of sequence listing upward to telomere on chrosomal short arm and 5'-terminus of this base sequence : 126166
agtgcccaggtgctactcagacgtcctcggcctctcctacccagaaaaaccccacagagaaacccagccataccctccttccttcatctggggccccattctcattagcccccgttagaaaaggcaggacatgcgtgtgttcaaaatacatcttattctgttgtcaaaactcactcagtattaaaaaggctgacagattttccctacaccaagaaaccacacatgcagtgtcacacacacacacacacacacacacacaagctgggtgcctgcttcatttaacct

SEQ ID NO: 24047 - DNA, 334 bp, Homo sapiens
  AC007773.1_49398
  Located on chromosome 19
  Distance between a terminus base of telomere on chromosomal short arm and 5'-terminus of this base sequence : 47968755
  Distance between 3'-terminus of neighbour sequence of sequence listing upward to telomere on chrosomal short arm and 5'-terminus of this base sequence : 153451
gaggtcaggaattcgaaaccagcatggccaacatggcaaaacactgtctccattaaaaatacaaaaaaaattagctgggcgtggtggtgcacatctgtagtcccagctacttgggaggctgaggcaggggaatcacttgaacccgggaggcggaggttgcagtgagccaagaccatgccactgtactccagcctgggcaacagaatgagactctgtctgaaaagaaaagaaaaggaaagaaaagaaaagaaaagaaaagaaaagaaaccacaccacacatgtaaagagctcaccatgctcctggcacagagtaactgcttagttcttggttatg

SEQ ID NO: 24048 - DNA, 327 bp, Homo sapiens
  AC007773.1_62560
  Located on chromosome 19
  Distance between a terminus base of telomere on chromosomal short arm and 5'-terminus of this base sequence : 47981911
  Distance between 3'-terminus of neighbour sequence of sequence listing upward to telomere on chrosomal short arm and 5'-terminus of this base sequence : 12822
caggatacttgttttaatctgcacaaaaatcacagcatgttcatgctgggaggaaacttaaacattatctgaatatttgtgtacttttccagtattctcacagatgttttcatatatagtttattttctgttaacatgtatgtttggtgtcccctaattaaactacgcgtgtttttcatgtgggctataccatgtgtactgcctttcaagttaccctcattcccatctaagcaccagtggaacacacacacacacacacacacacacacacacacacccttccccacccacacacacacgactgtactcagaggagcttaatcaaca

SEQ ID NO: 24049 - DNA, 172 bp, Homo sapiens
  D19S225
  Located on chromosome 19
  Distance between a terminus base of telomere on chromosomal short arm and 5'-terminus of this base sequence : 47982046
  Distance between 3'-terminus of neighbour sequence of sequence listing upward to telomere on chrosomal short arm and 5'-terminus of this base sequence : -192
atgtatgtttggtgtcccctaattaaactacgcgtgtttttcatgtgggctataccatgtgtactgcctttcaagttaccctcattcccatctaagcaccagtggaacacacacacacacacacacacacacacacacacacccttccccacccacacacacacgactgtac

SEQ ID NO: 24050 - DNA, 331 bp, Homo sapiens
  AC007773.1_125446
  Located on chromosome 19
  Distance between a terminus base of telomere on chromosomal short arm and 5'-terminus of this base sequence : 48044820
  Distance between 3'-terminus of neighbour sequence of sequence listing upward to telomere on chrosomal short arm and 5'-terminus of this base sequence : 62602
ttgaagctaggagctcaagaccagcctggccaacatggtgaagccccatctctactggaagtacaaaaattagtcaggtgtggtggtacacgcctgtagtcccagctactcaggaggctgaggcatgagaatcgctagaacccaggaggtcaaggctgcagagagccaagatcgcgccactgcactccagtttgggaaacagagtgaaatcctgtctcaataaataaataaataaataaataaataaataaataaataaataaaagaagtttggcgaccattgcattgacttttaccaagatacttgaaaagtcaactaaattggatgaaa

SEQ ID NO: 24051 - DNA, 326 bp, Homo sapiens
  AC008474.7_109988
  Located on chromosome 19
  Distance between a terminus base of telomere on chromosomal short arm and 5'-terminus of this base sequence : 48217234
  Distance between 3'-terminus of neighbour sequence of sequence listing upward to telomere on chrosomal short arm and 5'-terminus of this base sequence : 172083
gtctggaactcctggcttaaagcaatcctcccgcctcagcctctcgagtagctgggactacaagtgcaagccactgctcttccttccttccttccttccttctttcccttcctcccttcctttcttctcctttcgtccctccctcccttccttccttttccctccatccctgcctccctccttccctcccttcctacctaccaaccttccttccttcctccttccttgtttcctccctccttccctccctccctcattcatttcccagtcacaaggtaggactgcacttccccacccgctttgatgttaggcatagtcacatgatt

SEQ ID NO: 24052 - DNA, 194 bp, Homo sapiens
  DISO7_10007421
  Located on chromosome 19
  Distance between a terminus base of telomere on chromosomal short arm and 5'-terminus of this base sequence : 48467693
  Distance between 3'-terminus of neighbour sequence of sequence listing upward to telomere on chrosomal short arm and 5'-terminus of this base sequence : 250133
gaagatgacataaactgatatcacctaactgttcttatttttgacaggtcagcccccagtgttttgtttttgtagtttgaggtctaacttccatccagtgatgcgcacagatgttaagtgaacagctcagcagagtgtgtgtgtgtgtgtgtgtgtgtgtgtgtgtgtgtgtgtgcgtgtgaaccacacccaca

SEQ ID NO: 24053 - DNA, 245 bp, Homo sapiens
  AC011449.6_67309
  Located on chromosome 19
  Distance between a terminus base of telomere on chromosomal short arm and 5'-terminus of this base sequence : 48633234
  Distance between 3'-terminus of neighbour sequence of sequence listing upward to telomere on chrosomal short arm and 5'-terminus of this base sequence : 165347
agattgatcaaacaagctctgtacattggttagctatgcaactgtcaccactttcaaaaacctacagtcaatgtggatgaaaactaaccactgactgtccaagttataaaagaccacacacacacacacacacacacacacgcactcacacgcatgcacatgaacacacacacacacacacacacacacacacacacacacactctgaccaaaccaagtgttggtgagaatatgaagcaactgga

SEQ ID NO: 24054 - DNA, 197 bp, Homo sapiens
  D19S868
  Located on chromosome 19
  Distance between a terminus base of telomere on chromosomal short arm and 5'-terminus of this base sequence : 48633301
  Distance between 3'-terminus of neighbour sequence of sequence listing upward to telomere on chrosomal short arm and 5'-terminus of this base sequence : -178
tcaatgtggatgaaaactaaccactgactgtccaagttataaaagaccacacacacacacacacacacacacacgcactcacacgcatgcacatgaacacacacacacacacacacacacacacacacacacacactctgaccaaaccaagtgttggtgagaatatgaagcaactggactcatatactgttggtggg

SEQ ID NO: 24055 - DNA, 192 bp, Homo sapiens
  DISO7_00020236
  Located on chromosome 19
  Distance between a terminus base of telomere on chromosomal short arm and 5'-terminus of this base sequence : 48855140
  Distance between 3'-terminus of neighbour sequence of sequence listing upward to telomere on chrosomal short arm and 5'-terminus of this base sequence : 221642
aagtgggtagcactgcctgcttcctattgcatcccccagggaattccagggtgtgtgtgtgtgtgtgtgtgtgtgtgtgtgtgtgtgtgtgtgtgtgtgtgtctttctctctctctctctctcagggctggtggtcttgctaccagacacctggagcccctctgccagctgctttgagcttggctgaaagtg

SEQ ID NO: 24056 - DNA, 222 bp, Homo sapiens
  DISO7_10007438
  Located on chromosome 19
  Distance between a terminus base of telomere on chromosomal short arm and 5'-terminus of this base sequence : 48949767
  Distance between 3'-terminus of neighbour sequence of sequence listing upward to telomere on chrosomal short arm and 5'-terminus of this base sequence : 94435
cacaaatgtgcacttgcacgccccccccaacacacatacacacacacatacacacacacacatacacatacacacacacacatacacatacacacacacacacacacacacacacatacacacatacatacacatacacacacacacatacacacacacacacctggcttggcttcccattacccagccacctgctggaaaaccaagagctgtctcttgaaa

SEQ ID NO: 24057 - DNA, 293 bp, Homo sapiens
  HUMUT1974
  Located on chromosome 19
  Distance between a terminus base of telomere on chromosomal short arm and 5'-terminus of this base sequence : 48976810
  Distance between 3'-terminus of neighbour sequence of sequence listing upward to telomere on chrosomal short arm and 5'-terminus of this base sequence : 26821
caggacacacttgctcagtaaataagagcttggcatacgcttccctactctccttgtctctccataagtgcacttttgaggttctagtttcccccaaaactttgaatattaagcaactcatttctttttttctttttcttttcttttcccttccttccttccttccttccctccctcccttctttcttttctttctctctctctctctctttctttctttcttttctttctttctttccttccttccttccttccttcttttttttctttctgacatggggtcttgctgtgtc

SEQ ID NO: 24058 - DNA, 101 bp, Homo sapiens
  DISO7_10007431
  Located on chromosome 19
  Distance between a terminus base of telomere on chromosomal short arm and 5'-terminus of this base sequence : 49037962
  Distance between 3'-terminus of neighbour sequence of sequence listing upward to telomere on chrosomal short arm and 5'-terminus of this base sequence : 60859
gcataatgaaatcaacaggaagacacatacacacttacacacacacacatacacacagagagagagagagagagagagacaaagacatctgttcttggttc

SEQ ID NO: 24059 - DNA, 248 bp, Homo sapiens
  G08038
  Located on chromosome 19
  Distance between a terminus base of telomere on chromosomal short arm and 5'-terminus of this base sequence : 49092453
  Distance between 3'-terminus of neighbour sequence of sequence listing upward to telomere on chrosomal short arm and 5'-terminus of this base sequence : 54390
ccatcatctatcaaggtgatgatcatctatatcagcctacatacttacctacttatcatccatccatccatccatccatccatccatctatccaaccatctctagcctcccattaggcttgagctttatctttttgttcactgtagtatccctcaagagaccagaacagtgcttggcacatcagaagtctttggtatacctctgttgagtgactgaataagtgaatggctgtatgagcagcaccacag

SEQ ID NO: 24060 - DNA, 165 bp, Homo sapiens
  D19S416
  Located on chromosome 19
  Distance between a terminus base of telomere on chromosomal short arm and 5'-terminus of this base sequence : 49247157
  Distance between 3'-terminus of neighbour sequence of sequence listing upward to telomere on chrosomal short arm and 5'-terminus of this base sequence : 154456
cctgtcccagagagaccctaggagtgacctgcatttactctcacagttggctccaggcctgacacctgcccccgcccccaccaccacacacacacacacacacacacacacacacacacggcaggagggacagcagcaggagcagagcaaatggcacactctctt

SEQ ID NO: 24061 - DNA, 179 bp, Homo sapiens
  D19S874
  Located on chromosome 19
  Distance between a terminus base of telomere on chromosomal short arm and 5'-terminus of this base sequence : 49247528
  Distance between 3'-terminus of neighbour sequence of sequence listing upward to telomere on chrosomal short arm and 5'-terminus of this base sequence : 206
actggcgtttcccatgctctgcatgtgtgtgtgtgtgtgtgtgtgtgtgtgcacatgcaatgtggccaggccgccatgtgtctcagcagaatggtaagacgagtgaataaggcattgatccctgtgagcccaaagaacgcacgtgttagtctcttagtagcaagcctgtgagcaactgt

SEQ ID NO: 24062 - DNA, 132 bp, Homo sapiens
  AC010485.5_97878
  Located on chromosome 19
  Distance between a terminus base of telomere on chromosomal short arm and 5'-terminus of this base sequence : 49251872
  Distance between 3'-terminus of neighbour sequence of sequence listing upward to telomere on chrosomal short arm and 5'-terminus of this base sequence : 4165
ggagacagagccaacagatagatagatgatgatagatagatgatagatagatagatagatagatagatagatagatagatagatagataaacacacatgagagagagagagagataacagaagtcaggcaca

SEQ ID NO: 24063 - DNA, 183 bp, Homo sapiens
  D19S213
  Located on chromosome 19
  Distance between a terminus base of telomere on chromosomal short arm and 5'-terminus of this base sequence : 49289766
  Distance between 3'-terminus of neighbour sequence of sequence listing upward to telomere on chrosomal short arm and 5'-terminus of this base sequence : 37762
cctccaatctgcacctgactgaggcggaggagggtgatttcagacacacacacacacacacacacacacacacattcccctcatgcgtgcagccagtggagtgtgcctgggtcccagcgcagccccaggcctgggtcactccgagcctaaagtcctggaaagggaaccccagaacaaagccta

SEQ ID NO: 24064 - DNA, 373 bp, Homo sapiens
  AC067911.1_10584
  Located on chromosome 19
  Distance between a terminus base of telomere on chromosomal short arm and 5'-terminus of this base sequence : 49496792
  Distance between 3'-terminus of neighbour sequence of sequence listing upward to telomere on chrosomal short arm and 5'-terminus of this base sequence : 206843
agtggtagatcatagcacactgtaaagctaaactcctggcctcaagcgatcctcccacctcagcttccctagcagctagaactgcaggcacatgccacaatgcctgggtaattttttatatttatttatttatttatttatttatttatttatttatttatttattgagacctagtcttgctctgttgcccaggctagaatacagtggcacgatctcagctcactgcaacctccacctcccgggttcaaacgattctcgtgtctcagcttctcaagtagctgggattacagatgtgcaccaccacacccggctaatttttgtatttttagtagagatggagttttgccatctctactcattgaccaggctcat

SEQ ID NO: 24065 - DNA, 232 bp, Homo sapiens
  AC008556.5_53166
  Located on chromosome 19
  Distance between a terminus base of telomere on chromosomal short arm and 5'-terminus of this base sequence : 49551097
  Distance between 3'-terminus of neighbour sequence of sequence listing upward to telomere on chrosomal short arm and 5'-terminus of this base sequence : 53932
gatcagacaatggaaagtagaaagctttctctaaaacaattttcaaatctgtttattctactagacaccctcgtattcctagcgcttgtttctacgttttcttttgtttaaatctcttattgtctcaaaaaggttatcaaaaaataaaaataaaaaaacgcatgtgcacacacacacacacacacacacacacacacacacacacaagattgtgtccagaagactttccaag

SEQ ID NO: 24066 - DNA, 208 bp, Homo sapiens
  AC005792.1_45376
  Located on chromosome 19
  Distance between a terminus base of telomere on chromosomal short arm and 5'-terminus of this base sequence : 49639779
  Distance between 3'-terminus of neighbour sequence of sequence listing upward to telomere on chrosomal short arm and 5'-terminus of this base sequence : 88450
ttgacaagtcaaccattagtctaagtgtcacttctttgaaggtaatctttattttttctacagctgcttttaagattttctctgtctttagtttttaacagattagatagatagatagatagatagatagatagatagatagatagataaattagagggtgtagttttagtcatatttacccttcttgaagtttcagacttcatgaat

SEQ ID NO: 24067 - DNA, 190 bp, Homo sapiens
  D19S595
  Located on chromosome 19
  Distance between a terminus base of telomere on chromosomal short arm and 5'-terminus of this base sequence : 49639823
  Distance between 3'-terminus of neighbour sequence of sequence listing upward to telomere on chrosomal short arm and 5'-terminus of this base sequence : -164
atctttattttttctacagctgcttttaagattttctctgtctttagtttttaacagattagatagatagatagatagatagatagatagatagatagatagataaattagagggtgtagttttagtcatatttacccttcttgaagtttcagacttcatgaatctgtggcttgatgtctttttgaccaa

SEQ ID NO: 24068 - DNA, 207 bp, Homo sapiens
  Z67701
  Located on chromosome 19
  Distance between a terminus base of telomere on chromosomal short arm and 5'-terminus of this base sequence : 49720588
  Distance between 3'-terminus of neighbour sequence of sequence listing upward to telomere on chrosomal short arm and 5'-terminus of this base sequence : 80575
ttgggtgctagtatctgggtcacaaaataatctgtacaacaaacccccatgacacaagtttacctatataacacacctgcacatgtacccctgaacttagaagttttaaaaaacacacatatataaaactataatcacacacacacacacacacacacacacaaaccacagacagcagtcagacccacagggaatgacatcaggcca

SEQ ID NO: 24069 - DNA, 461 bp, Homo sapiens
  chr19.fa.O7frz.40751998
  Located on chromosome 19
  Distance between a terminus base of telomere on chromosomal short arm and 5'-terminus of this base sequence : 50009802
  Distance between 3'-terminus of neighbour sequence of sequence listing upward to telomere on chrosomal short arm and 5'-terminus of this base sequence : 289007
ggtagtggccttaaacatctagccatggcccctctccctttttcttttcttttcttttcttttcttttcttttcttttcttttctgtcttggtctttgtctttggtcttgtcatcttgtctttttaggatctggctctgttgcccagccaggctggagtgtagtggtacaatctcagctcactgcaatattgctctccatccatgctatccatcccatccatcccccagctcctgggctcaagtcatcctcctacctcagccttccgagtagctgggattacaggtgtacgcccagctaatttttgtatttttcatgaagatggggtttcgctgtgttggccaggctggtatcaaactcctgacctcaagtgcctgcctcggcctcccaaagtgctgggattacaggcgtgagccaccatgcccaaccttttctccctttcttaactcatgagtacacaaa

SEQ ID NO: 24070 - DNA, 385 bp, Homo sapiens
  chr19.fa.O7frz.43176544
  Located on chromosome 19
  Distance between a terminus base of telomere on chromosomal short arm and 5'-terminus of this base sequence : 50210792
  Distance between 3'-terminus of neighbour sequence of sequence listing upward to telomere on chrosomal short arm and 5'-terminus of this base sequence : 200529
aaagatacggagacaggataagctgcagagagagagggagagagggattgaactggagcgagaccaacagagccctgacgctgggatttgggaggatttggtgggttctcagtgaccccactgaggcctgacccaccagtggaaaaggctcacctcctgtaagtgaccacactgtggggtgtaattgtgtgtttgtttgtgtgtgtgtgtgtgtgtctgtgtgtgtgttggcgtcgccctgatggcctcttggagggtcctggggtgggtgggtcttgggcatggggtgccctctgccctcattctttcttcatccgggctccctgcccctgttggggtgggaagcacagatgtcagcttgctgagctgcaggtaccatgacaat

SEQ ID NO: 24071 - DNA, 198 bp, Homo sapiens
  AC022143.6_62436
  Located on chromosome 19
  Distance between a terminus base of telomere on chromosomal short arm and 5'-terminus of this base sequence : 50282481
  Distance between 3'-terminus of neighbour sequence of sequence listing upward to telomere on chrosomal short arm and 5'-terminus of this base sequence : 71304
tcttaaacagattccagcaaactcacaagtgtccttcagctctaggcctgctgtgtgtgtgtgtgtgtgtgtgtgtgtgtgtgtgtgtgtgtgtatgtgtgtgaatgtctggggccaaggccagggatgactgggctgtggtgagaacctgacccttcccagtcttccctgatttctcttgttcctgcagctacctag

SEQ ID NO: 24072 - DNA, 368 bp, Homo sapiens
  AC020910.5_47397
  Located on chromosome 19
  Distance between a terminus base of telomere on chromosomal short arm and 5'-terminus of this base sequence : 50351841
  Distance between 3'-terminus of neighbour sequence of sequence listing upward to telomere on chrosomal short arm and 5'-terminus of this base sequence : 69162
agatacatttgccaagacacagggtcatgccccaggggctcctgggcacacatgcacacacagacctgcgcgctcacaccacagtgctcagcccgttcccaatcccaggacactccagggaggacagagactgtcacgccaacacccaacccctcccactgcaggctgagctgagttcctgatatgctgccagcccaacagcatagccaagggccctgggtctctctgcagacctgccctgaccccacttatgtgcatacacagacacacagacacacacagacacacacagacacagacacacacacacacacacacacacacacacacgaaggtgtgtgtcagttgtccagatacacataaagctc

SEQ ID NO: 24073 - DNA, 154 bp, Homo sapiens
  D19S587
  Located on chromosome 19
  Distance between a terminus base of telomere on chromosomal short arm and 5'-terminus of this base sequence : 50425785
  Distance between 3'-terminus of neighbour sequence of sequence listing upward to telomere on chrosomal short arm and 5'-terminus of this base sequence : 73576
tctgtcaatggatgaatggataaagaaaatgtgatatatacaaaagctatctatctatctgtctattatctatctatctatctatctatctatctatctatctatctatctatctatgtatctatcatctgtgttttacaaaatatacaatgga

SEQ ID NO: 24074 - DNA, 322 bp, Homo sapiens
  AC020910.5_189076
  Located on chromosome 19
  Distance between a terminus base of telomere on chromosomal short arm and 5'-terminus of this base sequence : 50493781
  Distance between 3'-terminus of neighbour sequence of sequence listing upward to telomere on chrosomal short arm and 5'-terminus of this base sequence : 67842
agtcagtactcatgaaatgcattacggctatttttatcatcatcatcatcatcatcatcatcatcatcatcatcatcatcatcacaagacactcacatacaatggctgtgagggggcaaacgaaatgtcccttttgctgggtcatttgggatatctgtcaaaatataaaacatcactcaaatgcatcaagcagcctcagagttaatcactgaaagttttacaagatagtacacctttgaataacactatttggctcctttaaaagaatttatttttaaaaatagatcatgcaggagggtttcataaactgtaggatgaattc

SEQ ID NO: 24075 - DNA, 451 bp, Homo sapiens
  AC020907.4_69092
  Located on chromosome 19
  Distance between a terminus base of telomere on chromosomal short arm and 5'-terminus of this base sequence : 50682753
  Distance between 3'-terminus of neighbour sequence of sequence listing upward to telomere on chrosomal short arm and 5'-terminus of this base sequence : 188650
aacttgaacattacgaaatgttaagttttggccgggtgcagtggctcacgcctgtaatcccagcactttgggaggccaaggtgggtggatctcctggtcaggagttcgcgacaagcctggccaacatggtgaaaccccgtctctactgaaaatacaaaaattagccaggcatggtggcaggtgcctgtaatcccagctactcaggaggctgaggcaggagaatcgcttgaacccaggaggcagaggttgcagtgagccaagatggtgccactgcactccagcctagatgccaagagcaaaactgcctcaaacaaacaaacaaacaaacaaaagaaatgttaagttttccatttgagatattttttcaggttctgtatactgatgaaaccactgatgccatttggtctgaaggaacccacaggagctgctgactcactaaagaatgcagttt

SEQ ID NO: 24076 - DNA, 265 bp, Homo sapiens
  D19S425
  Located on chromosome 19
  Distance between a terminus base of telomere on chromosomal short arm and 5'-terminus of this base sequence : 50709625
  Distance between 3'-terminus of neighbour sequence of sequence listing upward to telomere on chrosomal short arm and 5'-terminus of this base sequence : 26421
gccatgtgactgtagcagactagcaatgctgcaggtgtgtgtgtgtgtgtgtgtgtgtgtgtgtgtaattactctgtggctctctgtagcatacctatgatgctgttgctctgtgcgtgtgtgtgtgtgtgtgtgtgtgtgtgtgtgtgtgcatatgagagagagagagaggaaagagactccttgcaattgtagggaaatgcagtttacccctgacacctactgtgtgacaatcattgagtttcccttttatgcacacctgtgg

SEQ ID NO: 24077 - DNA, 177 bp, Homo sapiens
  D19S893
  Located on chromosome 19
  Distance between a terminus base of telomere on chromosomal short arm and 5'-terminus of this base sequence : 50813142
  Distance between 3'-terminus of neighbour sequence of sequence listing upward to telomere on chrosomal short arm and 5'-terminus of this base sequence : 103252
aatcctgagactgggggacacccccactccgccagcgcacacacacacacacacacacacacacacacaaaaccctccccagcaatctctcctccagtatgtttttcccctgatctgtgaaacccccaaagacaagggttagggatggggtctctcttggtcaccagtgtgtcacca

SEQ ID NO: 24078 - DNA, 255 bp, Homo sapiens
  AC024682.3_128236
  Located on chromosome 19
  Distance between a terminus base of telomere on chromosomal short arm and 5'-terminus of this base sequence : 50822498
  Distance between 3'-terminus of neighbour sequence of sequence listing upward to telomere on chrosomal short arm and 5'-terminus of this base sequence : 9179
actggagatcctcattacttcaccttcgatggggccatagcccacttccagggcacctgcacctaccacctggcctatgccatccatccattcatccatctatcatccatccactcatccatccttccatccattcatccattcatccatccatccatccatccatccatccatccatccatccatctatccactcatccatccttccatccatccactcacaaaatttttctgagtatctactttgtagcaggc

SEQ ID NO: 24079 - DNA, 171 bp, Homo sapiens
  D19S208
  Located on chromosome 19
  Distance between a terminus base of telomere on chromosomal short arm and 5'-terminus of this base sequence : 50848310
  Distance between 3'-terminus of neighbour sequence of sequence listing upward to telomere on chrosomal short arm and 5'-terminus of this base sequence : 25557
ggatgcctgacggtgtttacaccccacgtcctgctccaaccagcagtttggggagaggttgttgttcatgtccattccggccccactgtgtgtgtgtgtgtgtgtgtgtgtgtgtgtgtgtgtgtgtatccctgccccagcatgtgttttctatctctaaggcccactggg

SEQ ID NO: 24080 - DNA, 191 bp, Homo sapiens
  AC002390.1_33720
  Located on chromosome 19
  Distance between a terminus base of telomere on chromosomal short arm and 5'-terminus of this base sequence : 50896870
  Distance between 3'-terminus of neighbour sequence of sequence listing upward to telomere on chrosomal short arm and 5'-terminus of this base sequence : 48389
ataatccactggaaagcgttgcctcctttttttaatttttgcaagagtttgagaagaattggtattagctcttctttaaatttttagaaaaatctgccagtgaagctatctggttcttggtgtgtgtgtgtgtgtgtgtgtgtgtgtgtgtgtgtatgtgtgtgtgtgtctttggtcattaattcaatctc

SEQ ID NO: 24081 - DNA, 426 bp, Homo sapiens
  chr19.fa.O7frz.42338165
  Located on chromosome 19
  Distance between a terminus base of telomere on chromosomal short arm and 5'-terminus of this base sequence : 51051073
  Distance between 3'-terminus of neighbour sequence of sequence listing upward to telomere on chrosomal short arm and 5'-terminus of this base sequence : 154012
accgtctactgtaaggcctcttcctgctcttgttcttcttggtggtggtcagtccttccttccttccttccttccttccttccttccttccttccttcctttctttctctctttcttttcctcctcctcttcttcccctcctcctcctcttcctccttcttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggc

SEQ ID NO: 24082 - DNA, 166 bp, Homo sapiens
  AD001502.1_20047
  Located on chromosome 19
  Distance between a terminus base of telomere on chromosomal short arm and 5'-terminus of this base sequence : 51256583
  Distance between 3'-terminus of neighbour sequence of sequence listing upward to telomere on chrosomal short arm and 5'-terminus of this base sequence : 205084
actaaatccatttcatgtttcaagatctttgcagtggatggatggatggatggatggatggatggatggatggatggatggatggatgggtgggtggatgggtggatgggtgggtggatggctgggtggatggatggatgcgcgagtgaatgagtgaatctggatc

SEQ ID NO: 24083 - DNA, 277 bp, Homo sapiens
  AC002389.1_4482
  Located on chromosome 19
  Distance between a terminus base of telomere on chromosomal short arm and 5'-terminus of this base sequence : 51285474
  Distance between 3'-terminus of neighbour sequence of sequence listing upward to telomere on chrosomal short arm and 5'-terminus of this base sequence : 28725
catcagcctttctcaatgtctctcagtcagtctctctcttctctccaccccaatatccgcaccccagcttataacatccaacacttcttaccttgtaaacactatccccatctgtcctcctcagctcctacttccctgttattccatctctgactcgttaatgatgataatagcgatggtggtaataataataataataataataataattacagctccagcttatcagcggttctgtatgtacccagcattggactaagcacaagcagtttaagaa

SEQ ID NO: 24084 - DNA, 469 bp, Homo sapiens
  chr19.fa.O7frz.41798529
  Located on chromosome 19
  Distance between a terminus base of telomere on chromosomal short arm and 5'-terminus of this base sequence : 51590530
  Distance between 3'-terminus of neighbour sequence of sequence listing upward to telomere on chrosomal short arm and 5'-terminus of this base sequence : 304779
cactagccttaattcctaccactccctgacttgggggttattctccagcaacaattttagggaaatcccttcccacactgtgctcctggagtcttctttgtctccagcccctgcacagctacttatcccttaatactggagtttggtgacagcttaggagcagaggacagtccagccagttttaatctccagcacagacctctctcctgagctctggaacccaatgtacacacacacacacacacacacacacacacacacacacacacacacacacacatgctcattcagaatcccctcatggattggttcttctcaaacgggacacgaccgcaccctggtgggagcttgggaaatttgcataattgtttttggctgcagcattgattggagggcattacaggcatctagaggcaggaccaggaatgctggacgctgaaatctgcatccagaacagtttgtaaatgtc

SEQ ID NO: 24085 - DNA, 371 bp, Homo sapiens
  AD000833.1_9189
  Located on chromosome 19
  Distance between a terminus base of telomere on chromosomal short arm and 5'-terminus of this base sequence : 51681216
  Distance between 3'-terminus of neighbour sequence of sequence listing upward to telomere on chrosomal short arm and 5'-terminus of this base sequence : 90217
cctgtaattccagctactcaggagcctgaggcaggagaatcgcttgaacccaggaggcagaggttgcagtgagcagagattgcgccattgcactccagcctgggcaacaaaagcgaaactcagtctcaaaataataataataataataataataataataataataataataataataaactttcactcctgctctaaaacttaccttggtttctcactctgccttatgtcccttggtcaaattcttttttgaggaggcaaggattgaggttgctgcagacccctatggattcactgctgcgaacatacttcggtaccgtgtgacttggatatgttccatgctaaaaattagtatgtccagtctcgagttc

SEQ ID NO: 24086 - DNA, 175 bp, Homo sapiens
  D19S876
  Located on chromosome 19
  Distance between a terminus base of telomere on chromosomal short arm and 5'-terminus of this base sequence : 51718223
  Distance between 3'-terminus of neighbour sequence of sequence listing upward to telomere on chrosomal short arm and 5'-terminus of this base sequence : 36636
tgaggatgctgggggcctagtgctggctacaattaccagttgctcccatgagggggagccagagggcactgttcgtgtgtgtgtgtgtgtgtgtgtgtgtgtgtgtgtgtgtgtgtcgaagtctcttgtcgcctaggctggagtgcaatggcgcgatctccgctcactgcaaccc

SEQ ID NO: 24087 - DNA, 258 bp, Homo sapiens
  D19S224
  Located on chromosome 19
  Distance between a terminus base of telomere on chromosomal short arm and 5'-terminus of this base sequence : 51807869
  Distance between 3'-terminus of neighbour sequence of sequence listing upward to telomere on chrosomal short arm and 5'-terminus of this base sequence : 89471
aacaccattcctcatcttcctcccccgccaccccacacacagagacataacacccttcctcaacttcctcccctacacacacacacacacacacacacacacacacacaccttcctcagcttcctcccctacacacacacacacacacaaacaccttcctcaaattcctcccctacacacacacacacacacacacacacacacacacacacccagcagtaaaatatagaggcaaaagggattcagatagggcctggg

SEQ ID NO: 24088 - DNA, 195 bp, Homo sapiens
  chr19.fa.O7frz.45776396
  Located on chromosome 19
  Distance between a terminus base of telomere on chromosomal short arm and 5'-terminus of this base sequence : 52028877
  Distance between 3'-terminus of neighbour sequence of sequence listing upward to telomere on chrosomal short arm and 5'-terminus of this base sequence : 220750
tgatttgcatgtatactttacagatgtcctaataatgttcattttatttttctaagagattatatatcttgaatattttatatgtccttgtgtattttctaaaacttagcacttagagattaatacacacgcacactctctctctctctctctctgtttctctcacgtctgtttttgctgtaccttaacaggatc

SEQ ID NO: 24089 - DNA, 242 bp, Homo sapiens
  D19S909
  Located on chromosome 19
  Distance between a terminus base of telomere on chromosomal short arm and 5'-terminus of this base sequence : 52409852
  Distance between 3'-terminus of neighbour sequence of sequence listing upward to telomere on chrosomal short arm and 5'-terminus of this base sequence : 380780
acgagactccgtcccttcccttccaaaaaagatcatttattgggaaacctggtattgactgatgactgatatgcttaaatgaatagaataccactgggaccacacagaaaaaaactttatctcataactgccactctcaaaattcctatttgagagtgtgtgtgtgtgtgtgtgtgtgtgtgtgtgtgtgtgtatttatttttttttttgctggatgaatttcttctgctggaagcctgaaa

SEQ ID NO: 24090 - DNA, 344 bp, Homo sapiens
  chr19.fa.O7frz.45260105
  Located on chromosome 19
  Distance between a terminus base of telomere on chromosomal short arm and 5'-terminus of this base sequence : 52558811
  Distance between 3'-terminus of neighbour sequence of sequence listing upward to telomere on chrosomal short arm and 5'-terminus of this base sequence : 148717
cagtcacatttaaatagtccattagggtcacacacagcgcctgtcaacgtcgtgtgcgcgtgcgcgcacacacacacacacacacacatacacacacacacacacaagctcccgtcgcggccccagctcctgcatcaatttcactctcgcatccactgctcccatcgcgatcgctcgcccccacgctccctcgccggcaaagccaccaactccaaagacattagcacctcactcccctcagccccggcctcgggccctccggagtcattcggcttctgtgtctcggaatcactcacccggccctgcggtcccttgatggtggaaggttccgcgatctttctatt

SEQ ID NO: 24091 - DNA, 464 bp, Homo sapiens
  chr19.fa.O7frz.44894563
  Located on chromosome 19
  Distance between a terminus base of telomere on chromosomal short arm and 5'-terminus of this base sequence : 52783732
  Distance between 3'-terminus of neighbour sequence of sequence listing upward to telomere on chrosomal short arm and 5'-terminus of this base sequence : 224577
accaatatgtacaagcatgactgacgaaatcctatggagcttcaatatggatttttaaacattatttctaaattaaaagtataattcagaagatatttttaagctagctgcatacttcactcttcgatctatccatccatccatccatccaatcacaaacttacagaaagttgcaagtatagcaccaggaactttcttgttactgaaccatttgaaagtaaattgttgacctaatgctacatcacccctgaaacaggaattaaaagaaattaaagagtgtgtaagcaaaaactcaattgtatgtgagaaaacccaattccccctgagaaacagaaagagctggagtcctttaaaaaattaactgcctgtttttctgtggctagtgagctttatctctccctttcccaggcattgtgaagacccggtttccctagctgtgcagctgcaaggtcactagacagata

SEQ ID NO: 24092 - DNA, 301 bp, Homo sapiens
  AC012309.7_73570
  Located on chromosome 19
  Distance between a terminus base of telomere on chromosomal short arm and 5'-terminus of this base sequence : 52881038
  Distance between 3'-terminus of neighbour sequence of sequence listing upward to telomere on chrosomal short arm and 5'-terminus of this base sequence : 96842
gaaggcagaggatgtagtgagctgagatggcaccactgcactccagcctgggcaacagagccagaacctgtctcaaaaataaataaataaataaataaataaataaataaataaataaataactagaaaaagaagagcaaaagaactcaaaagcaagcagaaggaactaaataataaaaagtagaaatcaacaaaactgaaaacaaaagatagagagaaaaatcactgtaacacaatccagttattagagaacaaaataataaaaccgataaattcactgattggtctattagtcaaccag

SEQ ID NO: 24093 - DNA, 200 bp, Homo sapiens
  D19S570
  Located on chromosome 19
  Distance between a terminus base of telomere on chromosomal short arm and 5'-terminus of this base sequence : 52957611
  Distance between 3'-terminus of neighbour sequence of sequence listing upward to telomere on chrosomal short arm and 5'-terminus of this base sequence : 76272
tacaggcatgagccaccgcgtccggcccctcttctgcattttttagacttgtacaggtgttttctactaccactccccaaaataatataattgcgtctgtatacacacatgtgaacacacacacacacacacacacacacacacacacacacacagagacacacacacacacaccccttgcccaagtactggtcttcatt

SEQ ID NO: 24094 - DNA, 248 bp, Homo sapiens
  AC008848.7_18364
  Located on chromosome 19
  Distance between a terminus base of telomere on chromosomal short arm and 5'-terminus of this base sequence : 53121422
  Distance between 3'-terminus of neighbour sequence of sequence listing upward to telomere on chrosomal short arm and 5'-terminus of this base sequence : 163611
atggtagctgatgcatttagatgcaggtgtgtgtgtgtgtgtgtgtgtgtgtgtgtgtgtgtgtgtgtgtgatgtttaatgtgtttcaatccatttaaattgcaccctcagtgatgctcaaatgcctccatgttgggtgtggaagagcctcttccagttggctcctgtgtccttttgctatgacccagtcctctttgattatttgccccgtctgccaccacaagatgttccaagttcatcttgttcat

SEQ ID NO: 24095 - DNA, 404 bp, Homo sapiens
  AC017110.5_148326
  Located on chromosome 19
  Distance between a terminus base of telomere on chromosomal short arm and 5'-terminus of this base sequence : 53328574
  Distance between 3'-terminus of neighbour sequence of sequence listing upward to telomere on chrosomal short arm and 5'-terminus of this base sequence : 206904
ctgatctcaaactccttaactcaggcaatccgcctgcctcggcctcccaaagtgctgggattacaggcgagagccatcttgcacggcccgcttatcaatttctttctttctttctttctttttttttttttttgagaccgagtctcctctgttgcccaggctggagtgcaatggcacaatctcggctcactgcaacctccgcctcccaggttcaagcgattctactgcctgagcctcctgagtagccgggattacaggcacgtgccaccacgcccggctaattttttgtacttttagtagagacggggtttcactgtgttggccaggatggtctcgatctcctgacctcgtgatccgcccgcctaggcctcccaatggagccttgctctgtcgccagttaggag

SEQ ID NO: 24096 - DNA, 265 bp, Homo sapiens
  AC008806.4_106716
  Located on chromosome 19
  Distance between a terminus base of telomere on chromosomal short arm and 5'-terminus of this base sequence : 53489254
  Distance between 3'-terminus of neighbour sequence of sequence listing upward to telomere on chrosomal short arm and 5'-terminus of this base sequence : 160276
tggtgtttagaaaccaagctaggtatgctctaggctactgggatatcactctttctggccctgacagcagctaaagctaggaaacagatagatagataggtagatagatagatagatagatagatagatagatagatagatagatatttacacacacacccctatatttatttctgcctctttttttcccattttttattacctctatctttttatatactaaaactatcagtttatattaataacttgatttctagtcctgctt

SEQ ID NO: 24097 - DNA, 386 bp, Homo sapiens
  AC008806.4_95649
  Located on chromosome 19
  Distance between a terminus base of telomere on chromosomal short arm and 5'-terminus of this base sequence : 53500276
  Distance between 3'-terminus of neighbour sequence of sequence listing upward to telomere on chrosomal short arm and 5'-terminus of this base sequence : 10757
aagaaagtaaattccaaggtgaaaaagatgaaaaaagggatggggagccagggaaggcccttctgaagttaacttttgagtgaagacctaaaagagaaatatctatctatctgtctatctacctatctctatctatctatctatctatctatctatctatctatctatctatctatctatctatctatctactcatccatccatctatccaaactacatatatatacccacctatagacacatttatatgcctttatagctaatgggaaggaaatctttagtggtatatatacatttacactttatacttactaatttattctcattttatcatgtctacatatttgtgtgttacattttaacacttgactcagatgaattatggc

SEQ ID NO: 24098 - DNA, 217 bp, Homo sapiens
  G08029
  Located on chromosome 19
  Distance between a terminus base of telomere on chromosomal short arm and 5'-terminus of this base sequence : 53500347
  Distance between 3'-terminus of neighbour sequence of sequence listing upward to telomere on chrosomal short arm and 5'-terminus of this base sequence : -315
acttttgagtgaagacctaaaagagaaatatctatctatctgtctatctacctatctctatctatctatctatctatctatctatctatctatctatctatctatctatctatctatctactcatccatccatctatccaaactacatatatatacccacctatagacacatttatatgcctttatagctaatgggaaggaaatctttagtggtata

SEQ ID NO: 24099 - DNA, 471 bp, Homo sapiens
  chr19.fa.O7frz.44441716
  Located on chromosome 19
  Distance between a terminus base of telomere on chromosomal short arm and 5'-terminus of this base sequence : 53621406
  Distance between 3'-terminus of neighbour sequence of sequence listing upward to telomere on chrosomal short arm and 5'-terminus of this base sequence : 120842
cactattctttagttcaagaccagcctgggcaatatggcaaaaccctatctctgcaaaaaatacaaaaattatctgggcgtggtcttgtacacctatagtttcagctacttgggaggctgaggtgggagggtcgcttgagtctggtaggttaagactgcagtgagccatgattgtgccactgcactccagcgtgggtgacagagtgagaccctgtctccagtagatagatagatagacagatagatagatagatagatagatagatagatagatagactcttccagggaatttataaaggaatacaccattacccaacccttttttttttatataaagccaacattgttgcattgattccaaaaactggaaaaggtggcatttcaaaagaaaaccatagcccaaccttcttatgaatgtacatgtaaaattagcaatatgttaaataatgcattatgactgagaataaatt

SEQ ID NO: 24100 - DNA, 425 bp, Homo sapiens
  AC073501.2_164016
  Located on chromosome 19
  Distance between a terminus base of telomere on chromosomal short arm and 5'-terminus of this base sequence : 53969008
  Distance between 3'-terminus of neighbour sequence of sequence listing upward to telomere on chrosomal short arm and 5'-terminus of this base sequence : 347131
gttcctgtcacatagtaagtgctcagtaaatgttagtttcattaatgggttctgatggcctcatctctttctttctttctttctttctttttttgagacagtgtctagctttgtctctaggctagagtgcagtggcgcgatctcagctcatgcaacctctgcctcccgggttcaagcgattctcctgcctcagcctcccgagtagcggggattacaggcacgcgctgccatgcccagcggatttttgtatttttgttagagacggggtttcaccatattggccaggagggtctcgatttcctgacctcaggtgatctgcccacctcggcctccaaagtgctgggattacaggcatgagccaccgcgcccggccggcctcatctcttaatgggacaattgcagtcctaattagctcactgcttcta

SEQ ID NO: 24101 - DNA, 209 bp, Homo sapiens
  D19S228
  Located on chromosome 19
  Distance between a terminus base of telomere on chromosomal short arm and 5'-terminus of this base sequence : 53999869
  Distance between 3'-terminus of neighbour sequence of sequence listing upward to telomere on chrosomal short arm and 5'-terminus of this base sequence : 30436
agctaatatggcagaatcttgacaatttttgaatctaggtttgggtacaagggagttcattgtaccttactccctacttttttttagcatgttaacagaacaaaaaccagccctatctatcacacacacacacacacacacacacacacacacccacacacacacaaagactaaaaattgtgtgaccatgaaaagcactgcgatcctgc

SEQ ID NO: 24102 - DNA, 447 bp, Homo sapiens
  AC073501.2_73585
  Located on chromosome 19
  Distance between a terminus base of telomere on chromosomal short arm and 5'-terminus of this base sequence : 54072306
  Distance between 3'-terminus of neighbour sequence of sequence listing upward to telomere on chrosomal short arm and 5'-terminus of this base sequence : 72228
tacctctattgtatgctggcaggaagaccagtcccccgagcatccccatctggccttggatactggctgttcccagcttccctgctcatccacggcaggtaccctctcttcttgcagatcctggtttagacaccacccttcaaggagtcttcctgaccccctcccaactatagtgatcttcagtcctatctatctatctatctatctatctatctatttttgagacagggtcttgctctgtcacccaggctggagtgcagtggcgtgatcacagctcactgcagccttgacctcctgggctcaagcgatcctcccacctcagcctcccatagtgctgtgattacacacatgagccactgcacccagccattttatgacctttacaatgctggccacccttggaaattctattttatttctctggcgtttctctactggaggtccatt

SEQ ID NO: 24103 - DNA, 92 bp, Homo sapiens
  D19S897
  Located on chromosome 19
  Distance between a terminus base of telomere on chromosomal short arm and 5'-terminus of this base sequence : 54271020
  Distance between 3'-terminus of neighbour sequence of sequence listing upward to telomere on chrosomal short arm and 5'-terminus of this base sequence : 198267
tgcacattacagtgtgagacagagagagagcatgcgcgcgcgcgtgtgtgtgtgtgtgtgtgtgtgttacggctggctgttggggaaatcct

SEQ ID NO: 24104 - DNA, 188 bp, Homo sapiens
  D19S421
  Located on chromosome 19
  Distance between a terminus base of telomere on chromosomal short arm and 5'-terminus of this base sequence : 54382858
  Distance between 3'-terminus of neighbour sequence of sequence listing upward to telomere on chrosomal short arm and 5'-terminus of this base sequence : 111746
gagcctgtggtggagccagcgctgtctccctcctggaaaatagatggataattggacagtagatgagataatgagatgccagcccagagcaggcttggggggagggagggagggaggaagagggggtgagagagagagagagagagtgtgtgtgtgtgtgtgtgtgtgcgcataaaccagcaagggct

SEQ ID NO: 24105 - DNA, 281 bp, Homo sapiens
  AC011469.6_54285
  Located on chromosome 19
  Distance between a terminus base of telomere on chromosomal short arm and 5'-terminus of this base sequence : 54470206
  Distance between 3'-terminus of neighbour sequence of sequence listing upward to telomere on chrosomal short arm and 5'-terminus of this base sequence : 87160
acttcatgcatctactgtaccactcatccacccatctatccatccattcaaccaatgattcatccatccatccatccatcgatctatcagacatccatctatccaaccaacaattcatccatccatccatccatccatcatccatccatccatccatccatccatccatccatccatccatccaaccatccatccagctaaccaaccatccattcatccagccaacatagggagaccccatctctacaaaaaataaaaaaattagctaggcaaggtagcat

SEQ ID NO: 24106 - DNA, 322 bp, Homo sapiens
  chr19.fa.O7frz.44231395
  Located on chromosome 19
  Distance between a terminus base of telomere on chromosomal short arm and 5'-terminus of this base sequence : 54921597
  Distance between 3'-terminus of neighbour sequence of sequence listing upward to telomere on chrosomal short arm and 5'-terminus of this base sequence : 451110
aagataagcctaggcaacatagcaagaccgtatctctacacaaatttaaaaaattagctgggcacggtggcacacttgtagtcccagctacttgggaggcagaggtgagggaatcacttgagcccaggagtttgaggctgcagtgagccacaatcataccactgtactgtagcctgggtaacagagtgagaccttgactcaaaataataataataataataataataataataataataataaataaaatttaaaaatgggccccagagaagcttttggataaaagaatgatgaagacgtcagaatacattcacattaagct

SEQ ID NO: 24107 - DNA, 293 bp, Homo sapiens
  chr19.fa.O7frz.43511986
  Located on chromosome 19
  Distance between a terminus base of telomere on chromosomal short arm and 5'-terminus of this base sequence : 55106073
  Distance between 3'-terminus of neighbour sequence of sequence listing upward to telomere on chrosomal short arm and 5'-terminus of this base sequence : 184154
tgtcatccaagctacaaagtaggctgaggcaggagaatcgcttgaacccgggaggcggaggctgcagtgagccgagatcgcgccactgcactccagcctgggcaacagaggcgactctgtctcaaaaataacacacacacacacacacacacacacacacacggaaaacacggccctggactccgtgtatagaacctggtgtctcagggcgttgggcaggagcagaggcaggtgtctaagccggaccattggctcccttccgcgccagcccggtgtgctatgagaaccttgtt

SEQ ID NO: 24108 - DNA, 251 bp, Homo sapiens
  AC011455.6_10698
  Located on chromosome 19
  Distance between a terminus base of telomere on chromosomal short arm and 5'-terminus of this base sequence : 55210839
  Distance between 3'-terminus of neighbour sequence of sequence listing upward to telomere on chrosomal short arm and 5'-terminus of this base sequence : 104473
ggttacagtgagctgagatcacacgccactgcactctagcctgggcaacgagcgaaattccgccacacacacacacacacacacacacacacacacacacacacaaaaagccctgacatgagaactgaagacctttgtggctgggcagagggagtgacagggtgagtctgaggggacaaggtcagaggggtgatgggggcacgttatgtggggcccactgagacgggctgaggatgaggactttggtctta

SEQ ID NO: 24109 - DNA, 137 bp, Homo sapiens
  D19S881
  Located on chromosome 19
  Distance between a terminus base of telomere on chromosomal short arm and 5'-terminus of this base sequence : 55210852
  Distance between 3'-terminus of neighbour sequence of sequence listing upward to telomere on chrosomal short arm and 5'-terminus of this base sequence : -238
tgagatcacacgccactgcactctagcctgggcaacgagcgaaattccgccacacacacacacacacacacacacacacacacacacacacaaaaagccctgacatgagaactgaagacctttgtggctgggcagag

SEQ ID NO: 24110 - DNA, 208 bp, Homo sapiens
  AC011455.6_86848
  Located on chromosome 19
  Distance between a terminus base of telomere on chromosomal short arm and 5'-terminus of this base sequence : 55286962
  Distance between 3'-terminus of neighbour sequence of sequence listing upward to telomere on chrosomal short arm and 5'-terminus of this base sequence : 75973
agtaattgtaatgttgatgtggaaggggtgtggaaaggattcaatggggtgtgctgctccacacccgggagctgttcttttattttatacgtgtgtgtgtgtgtgtgtgtgtgtgtgtgtgtttgtgtgtgtttgtgtagagagagagacagagtctcactgtgttgtccaggctggagtgcggttctatgatcaaagcttacttcag

SEQ ID NO: 24111 - DNA, 230 bp, Homo sapiens
  D19S417
  Located on chromosome 19
  Distance between a terminus base of telomere on chromosomal short arm and 5'-terminus of this base sequence : 55335323
  Distance between 3'-terminus of neighbour sequence of sequence listing upward to telomere on chrosomal short arm and 5'-terminus of this base sequence : 48153
ctcttggaaaatgtagggcacaaaaaatatccatttagatataaatagagacatagagacacaacccctggtagggatagagacaggtacacacacacacagaactgaaggcacacacacacacacacacacacacacacacacacttttttttgttttgttttgagacaaggtcttgctctgttgcccaggctagagtgcagtggcatgatcatggctcatgacagcct

SEQ ID NO: 24112 - DNA, 378 bp, Homo sapiens
  AC010605.4_65986
  Located on chromosome 19
  Distance between a terminus base of telomere on chromosomal short arm and 5'-terminus of this base sequence : 55414986
  Distance between 3'-terminus of neighbour sequence of sequence listing upward to telomere on chrosomal short arm and 5'-terminus of this base sequence : 79433
agtgagcatctggacagactacacatcttctgtgggtttcctgttacttgcagcccaaagcattcatatgtggagtgtgtgtgtgtgtgtgtgtgtgtgtgtgtgtgtgtgtgtgtgaaatgttctcctgaaagcactggggggtttctgagacttctgaacatgggctatctttactagtgttttttcaggcctgtctcccactcctgagccccctaagccagtattctctccaacaaggcctctttccctaccccatgctacagatctctgggaagctgagcccagtggtctgattgacaggtgactccaagatgttgcttgttcaaagatgctgagatctctctggaaattgtcactaatttccacttaggacag

SEQ ID NO: 24113 - DNA, 279 bp, Homo sapiens
  chr19.fa.O7frz.46960170
  Located on chromosome 19
  Distance between a terminus base of telomere on chromosomal short arm and 5'-terminus of this base sequence : 55545858
  Distance between 3'-terminus of neighbour sequence of sequence listing upward to telomere on chrosomal short arm and 5'-terminus of this base sequence : 130494
tattgttagaatgcacttggaggccgggtgcagtgtggttcacccctgtcatcccagcactttgggaggccgaggctgcagtgagctgtgatcagcatcactgcactccagcctgggcaacagggaaagatcctaactcaaataataataataataataataataataataataataatgcacttggctttgcagggcccagctgtggccctggatcccttggattgaagtaaaagggtttctcatagattctggggcccatcacaattactgaagccg

SEQ ID NO: 24114 - DNA, 279 bp, Homo sapiens
  chr19.fa.O7frz.48700343
  Located on chromosome 19
  Distance between a terminus base of telomere on chromosomal short arm and 5'-terminus of this base sequence : 55666886
  Distance between 3'-terminus of neighbour sequence of sequence listing upward to telomere on chrosomal short arm and 5'-terminus of this base sequence : 120749
tatgaataatgctgttgaggacatttgtgtgtaagtttttgtgtggatgtgtttcaccatctccttttaatccttagcagctctctgatgagtgggttcgtgtgtgtgtgtgtgtgtgtgtgtgtgtgtgtgtgtgtgtttgtgtgcatagggtgcttggatattcatggtgaagaacagttggaaagagtcaaggggcgctgggagggtgtggcagcagtgccaccctgcctggcacagaagtgttttggcattggagctacctgcacagctgtattg

SEQ ID NO: 24115 - DNA, 176 bp, Homo sapiens
  HUMUT5576
  Located on chromosome 19
  Distance between a terminus base of telomere on chromosomal short arm and 5'-terminus of this base sequence : 55780545
  Distance between 3'-terminus of neighbour sequence of sequence listing upward to telomere on chrosomal short arm and 5'-terminus of this base sequence : 113380
ctttcttgtttgcttgcccagggaagctgattgttggcttctgacctccagaacagtaagagaataaacttcctaacttccttccttccttccttccttccttccttccttccttccttccttccttcctctctttctctctctctctctcattctttctttcgtctcaaatccct

SEQ ID NO: 24116 - DNA, 302 bp, Homo sapiens
  AC007842.1_76703
  Located on chromosome 19
  Distance between a terminus base of telomere on chromosomal short arm and 5'-terminus of this base sequence : 55967829
  Distance between 3'-terminus of neighbour sequence of sequence listing upward to telomere on chrosomal short arm and 5'-terminus of this base sequence : 187108
cactccaggctagcgatatatatatatatatatatatatatatatatatatatatatttatatatatgtagtcaggtcagtggtgcctccctactctgggagatagggtgggggcaaagggagataggggtggggccattttataagatttgggtaggtaaaggaaaattacagtcaaaggggttttgttctctggcaggcaggagtgggggtcgcaaggtgctcagtgggggagctttttgagccaggatgagccaggaaaaggactttcacaaggtaatgtcatcacttaaggcaaggac

SEQ ID NO: 24117 - DNA, 426 bp, Homo sapiens
  AC007842.1_73038
  Located on chromosome 19
  Distance between a terminus base of telomere on chromosomal short arm and 5'-terminus of this base sequence : 55971422
  Distance between 3'-terminus of neighbour sequence of sequence listing upward to telomere on chrosomal short arm and 5'-terminus of this base sequence : 3291
gtaggaaatgtaccataaaccaagacagctcccactggtctaaggtttgaccacttcaaatgttaaaaatccatgcattcataaggatattacatacacacacacacacacacacacacacacacacacgcacacacacgttttggttacctttagagagaatgtactaaaactgaaaattgaagcatttaagttgctttttctgtattaactacaatttagggtaaccagagaattaatgaggggatgcttctttgtataatagcattgtagttaataaatgaagagaaaataatacattaaaaatccccattttgcaaagccctggtgaaataatggaactagacaggtttccagatttagccaataaatggcatgggacatatttatactaaaaattaattgtcacctgaaattcaaattgaa

SEQ ID NO: 24118 - DNA, 446 bp, Homo sapiens
  AC007842.1_70977
  Located on chromosome 19
  Distance between a terminus base of telomere on chromosomal short arm and 5'-terminus of this base sequence : 55973360
  Distance between 3'-terminus of neighbour sequence of sequence listing upward to telomere on chrosomal short arm and 5'-terminus of this base sequence : 1512
tctatcctggaagactacaagaaccaaggatgattgtaacatctcctggtaccccagatgggaccctcattttaggtccccacaggagttagcaagacttcctggaggacagaggcaactgaccaggtggtaacaaaggtggccactctggaccattgctttggtgttggtgctttggagagtcaagtctggaccctaggtgagtctgctcttcttcttctctctctctctctctctctctctctctctctcaccagatgcccagtaaatggcatggccaggattatatctggccatctcctctgcgtatttcttaccctttccaagatttgaaactttcaccaggagtacaatgagtgaggactactagaacatcttgtcaagtcaaaggaaatgttagactaaacttaatacattaatcactaaacctatctggattgttcaag

SEQ ID NO: 24119 - DNA, 265 bp, Homo sapiens
  chr19.fa.O7frz.47666514
  Located on chromosome 19
  Distance between a terminus base of telomere on chromosomal short arm and 5'-terminus of this base sequence : 56268311
  Distance between 3'-terminus of neighbour sequence of sequence listing upward to telomere on chrosomal short arm and 5'-terminus of this base sequence : 294505
attcttgcagactcatacagttaccaccttgatgatcttggacaagttccaggataattctctggattacaatgcggagacttttgcccttttccctttctttctccccccaaaaaaacagtgtgtgtgtgtgtgtgtgtgtgtgtgtgtgtgtgtgtgttttgagacacctaaagctggggatagactaataaaagcaccgttgtggtcaccaccactatgactgggtcagacctgaatccagtatagcactggatctcactga

SEQ ID NO: 24120 - DNA, 274 bp, Homo sapiens
  chr19.fa.O7frz.48032181
  Located on chromosome 19
  Distance between a terminus base of telomere on chromosomal short arm and 5'-terminus of this base sequence : 56431594
  Distance between 3'-terminus of neighbour sequence of sequence listing upward to telomere on chrosomal short arm and 5'-terminus of this base sequence : 163018
ctaatgtaggtgacaggttgatgggtgcagcaaaccaccatggcacatgtatacctgtataacaaaactgcacgttctgcacatgtaccccggaacataaagtatgtgtgtgtgtgtgtgtgtgtgtgtgtacaaaaaccagagaaagagcctacactaaagtttaacataggctaggtctcattcattatgatttgagatttaggcttccagctttaaagaatgttgctttaaccttctcttctccctttactttggactgttcattctgtaa

SEQ ID NO: 24121 - DNA, 154 bp, Homo sapiens
  AC005393.1_102677
  Located on chromosome 19
  Distance between a terminus base of telomere on chromosomal short arm and 5'-terminus of this base sequence : 56529409
  Distance between 3'-terminus of neighbour sequence of sequence listing upward to telomere on chrosomal short arm and 5'-terminus of this base sequence : 97541
ctgatgtctccttggtaagttaatggtacgcgcgcacacacacacacacacacacacacacacacacacacacatcctgggccctccccttcctaggtattgataatggtcaagttacctaaacttttctgtcctaggtatcatttacaaatgg

SEQ ID NO: 24122 - DNA, 367 bp, Homo sapiens
  chr19.fa.O7frz.47355462
  Located on chromosome 19
  Distance between a terminus base of telomere on chromosomal short arm and 5'-terminus of this base sequence : 56689009
  Distance between 3'-terminus of neighbour sequence of sequence listing upward to telomere on chrosomal short arm and 5'-terminus of this base sequence : 159446
tggttcagtattttctatgcatttggaagtgtgtaaatcacaggactgttgtgtgagcatgtgtctgttatgagtgaacatcttggcgtgtctgcaaaggtggatctttttgtgcctgtgtgcgtgttccagtgtggatcagcctcgtatctgtatgcttgtggttttgtgtgtgtgtgtgtgtgtgtgaggtatgtatctgttagcgtggtgctgtatcaactttgcaacatggagatgtgtgaagtatgagtgtgtctaggcatttaagagtgtgcacttgtgtatgtttgcacaggtgtgtgtgtgtttgttagatgtgtgtgcccctgtgtgctggtgagtgtgcaaggtagatctgttgtaa

SEQ ID NO: 24123 - DNA, 275 bp, Homo sapiens
  chr19.fa.O7frz.47263038
  Located on chromosome 19
  Distance between a terminus base of telomere on chromosomal short arm and 5'-terminus of this base sequence : 56781529
  Distance between 3'-terminus of neighbour sequence of sequence listing upward to telomere on chrosomal short arm and 5'-terminus of this base sequence : 92153
tgagcagaggttgtgctactgcactccagcctgggcaatagagaaagactcagtctcaaaaacaaacaaacaagcaaacaaaaacaaacaaacaaaaaaacaccaaaaaacaaaaacaaacaaaaaacccccacacaaccaacaatcaaaagagatttctgtctgttttgttcacttttatgtccccagcacacaaaacagtgcctggcacactttaggtgtaagtatttcttgatagaatgagtgcatttgttgctaatgtagacagttgatct

SEQ ID NO: 24124 - DNA, 391 bp, Homo sapiens
  DISO7_00003979
  Located on chromosome 19
  Distance between a terminus base of telomere on chromosomal short arm and 5'-terminus of this base sequence : 56898489
  Distance between 3'-terminus of neighbour sequence of sequence listing upward to telomere on chrosomal short arm and 5'-terminus of this base sequence : 116685
taaccttagtctgttgctgtttcttgctagatttgtttgtttgtttgtttgtttgtttgtttgagacggagtctcgctctgttttaacccaggctggagtgcagtggcgcaatctcagctcactgcaacctctgcctcccaggttcaagcaattctcctgcctcagtctcccgagtagctgggattacaagcgcccgccaccacgcccagctaatttttacatttttggtagagacagggtttcaccacattggccaggctggtcttgaactcctaacctcaggtgatccacccacctcggcctcccaaagtgctgggattacaggcgtgagccaccacacccgacctgctagatcctttttaggcatccccatttgtcttcctgccatga

SEQ ID NO: 24125 - DNA, 349 bp, Homo sapiens
  chr19.fa.O7frz.49339015
  Located on chromosome 19
  Distance between a terminus base of telomere on chromosomal short arm and 5'-terminus of this base sequence : 57051710
  Distance between 3'-terminus of neighbour sequence of sequence listing upward to telomere on chrosomal short arm and 5'-terminus of this base sequence : 152830
atcagagctgttcactttcatcttcacactgacctggttagagagaatttatcaaccctgttttattttattttatttatttatttatttatttatttatttatttatttatttatttttttagatggagtctcactctgtcgcccaggctggagtgcagtggcatgatctcggctcactgcaagctccacctcctgggttcacaccattctcctgcctcagcctcccaagtagcttggactacaggcgcccgccaccacgcccggctaattttttgtatttttagtagagacggggtttcaccgtgttagccaggatggtctcgatctcctgaccttatggtccacct

SEQ ID NO: 24126 - DNA, 285 bp, Homo sapiens
  HUMUT6622
  Located on chromosome 19
  Distance between a terminus base of telomere on chromosomal short arm and 5'-terminus of this base sequence : 57127863
  Distance between 3'-terminus of neighbour sequence of sequence listing upward to telomere on chrosomal short arm and 5'-terminus of this base sequence : 75804
acgcgttctcctctggaatgttcagagggaggtagtccaggcggtcaccgcgctcgccagacaagcaacgcagcgccccccgatggccaccgcgcgccggcgcagcccaagccggctgcgccccctagtggccgatgctcgtaaagtcttcagcgagccccgagcttttgctagccagcccttggttttgcaggctggggtcatcgtcgttgtcatcgttggcatcatcatcatcatcatcatcatcatcatcatcatcaatagctagtaggcttggcgtggtgg

SEQ ID NO: 24127 - DNA, 316 bp, Homo sapiens
  AC010412.7_58783
  Located on chromosome 19
  Distance between a terminus base of telomere on chromosomal short arm and 5'-terminus of this base sequence : 57168665
  Distance between 3'-terminus of neighbour sequence of sequence listing upward to telomere on chrosomal short arm and 5'-terminus of this base sequence : 40517
tcgcatctattaatacctgttaaacctcattagtctcccttaatcaggatcagttcccaatggtaaattctttgtaaattctaagtagtgttttcccaaagaacttaaattcacagtaaaataaataaataaattaattaattaataaataaattaattatatggtgactcaggacatacatacaattatattttaaacacacacacacacacacacacacacacacacacacacagagttttagaacttacaaagtatttaaccatttacctagaaagttagttttaccaagtatgtttcaaactttcttgatgg

SEQ ID NO: 24128 - DNA, 182 bp, Homo sapiens
  chr19.fa.O7frz.50148555
  Located on chromosome 19
  Distance between a terminus base of telomere on chromosomal short arm and 5'-terminus of this base sequence : 57476799
  Distance between 3'-terminus of neighbour sequence of sequence listing upward to telomere on chrosomal short arm and 5'-terminus of this base sequence : 307818
caatcaacctaagtgtctatcaacagatgaatgaatggataaagaaaatgtgctatgcatgcatgtacacacacacacacacacacacacacacacacacaaatattatttagccttaagaaagaagaaaatcctgtcctttgcaacaccaggggtgaacctggaccatgttacattaagtg

SEQ ID NO: 24129 - DNA, 354 bp, Homo sapiens
  AC023172.1_34474
  Located on chromosome 19
  Distance between a terminus base of telomere on chromosomal short arm and 5'-terminus of this base sequence : 57514865
  Distance between 3'-terminus of neighbour sequence of sequence listing upward to telomere on chrosomal short arm and 5'-terminus of this base sequence : 37884
acttcagattgagtggtcagagagggctcctttgagaagacttctgagaattggccatgggaaggtgtggggagaagccttctcagctgagggaacagcaaggtcaaagacccagaggtaagaaagcaagcttggaaccttccaggagcaacaaggcattggctctgataatgccttctcctgctaaaatgacagctctaggaaggcagggttcttatttcctgtctatctatctatctatctatctatctatctatctatctatctatcatctatctatctatcatatatctatctatccgtctgtctttatttatttatagaggcagagtcttgctctattgtccattgtat

SEQ ID NO: 24130 - DNA, 201 bp, Homo sapiens
  HUMUT5036
  Located on chromosome 19
  Distance between a terminus base of telomere on chromosomal short arm and 5'-terminus of this base sequence : 57515053
  Distance between 3'-terminus of neighbour sequence of sequence listing upward to telomere on chrosomal short arm and 5'-terminus of this base sequence : -166
atgacagctctaggaaggcagggttcttatttcctgtctatctatctatctatctatctatctatctatctatctatctatcatctatctatctatcatatatctatctatccgtctgtctttatttatttatagaggcagagtcttgctctattgtccattgtattagtccattttcatgctgctgataaagacataccg

SEQ ID NO: 24131 - DNA, 439 bp, Homo sapiens
  chr19.fa.O7frz.50223947
  Located on chromosome 19
  Distance between a terminus base of telomere on chromosomal short arm and 5'-terminus of this base sequence : 57728498
  Distance between 3'-terminus of neighbour sequence of sequence listing upward to telomere on chrosomal short arm and 5'-terminus of this base sequence : 213244
gctatgcagagcttgacacttgttgccaggaaacacacataaaataataagtgacaggccgggcacggtggctcgtgcctgtgatcccagcactttgggaggctgagcgggcagatcacctgaggtagggagtttgagaccagcctgaccaacatggagtaaccctgtctctactaaaaatacagaattagccgggtgtggtggtgcatgcctgtaatcctagctactcaggaggttgaggcaagagaatcacttgaacctgggaggcggaggttgcagtgagccgagatcatgccattgtactccagcctgggcaacaagagcgaaactccatctcaaataaataaataaataaatagatagatagatagatagatagatagatagatagatagataataaatgacagtatgcacaagcagtcttctaaatgcttaca

SEQ ID NO: 24132 - DNA, 114 bp, Homo sapiens
  DISO7_10004447
  Located on chromosome 19
  Distance between a terminus base of telomere on chromosomal short arm and 5'-terminus of this base sequence : 58040663
  Distance between 3'-terminus of neighbour sequence of sequence listing upward to telomere on chrosomal short arm and 5'-terminus of this base sequence : 311726
aaccacgagcctaacaccctaaacagacacaggcatagacacacacacacacacacacacacacacacacacccagcaccaaagctgctcctaccccagtcacactggaattag

SEQ ID NO: 24133 - DNA, 188 bp, Homo sapiens
  AC005955.1_26613
  Located on chromosome 19
  Distance between a terminus base of telomere on chromosomal short arm and 5'-terminus of this base sequence : 58110352
  Distance between 3'-terminus of neighbour sequence of sequence listing upward to telomere on chrosomal short arm and 5'-terminus of this base sequence : 69575
ttaaagcatgttcatagtatgcagttttgcctaataaagcattctcatatatacatacatatagatagatgatagatagatagatagatagatagatagatagatagatagatagatattcagacagatcttcaggccccacttgtccctgaggaggattatttgcctatggaaagaacaagcagatg

SEQ ID NO: 24134 - DNA, 384 bp, Homo sapiens
  AC005955.1_32996
  Located on chromosome 19
  Distance between a terminus base of telomere on chromosomal short arm and 5'-terminus of this base sequence : 58116552
  Distance between 3'-terminus of neighbour sequence of sequence listing upward to telomere on chrosomal short arm and 5'-terminus of this base sequence : 6012
cagtacctcagtaagtcaaggaaggtcacagaactcgtacatgataaaaccaaatttttactgcattgttcctgattttattgccaataacaacatcaaaaaaataagaatactagttgatagcatcagttgagctctcgccctgtgtataactctgctttaatctctttaatctcctaataaacatcctcacaaccactctgagatccaggtgttacagtgagtttgatctctagcatatatatacatatatatagatagatagatagatagatagatagatagatagatagatagatagatatagtagctgttgttattctttcttagcctgtccatctctctgctcacagcatccgtctgttctgcacattgtctatgctt

SEQ ID NO: 24135 - DNA, 433 bp, Homo sapiens
  AC005794.1_22677
  Located on chromosome 19
  Distance between a terminus base of telomere on chromosomal short arm and 5'-terminus of this base sequence : 58140560
  Distance between 3'-terminus of neighbour sequence of sequence listing upward to telomere on chrosomal short arm and 5'-terminus of this base sequence : 23624
agtaaggatttcctgaccttctatatatgtacagttgcctttaacaacctcccacctctgccaccatgtttggccccagagaaatgcattactcttctggaaaaggggttagaggagaaggcaagagagcaaatatttgttgagctagcgtgtgtgtgtgtgtgtgtgtgtgtgtgtgtgtgtgtgtgtgtatttgccagctaccgttgtggacactttcccatacagtatcttaactctcttgacaccgtttgtatataagtacagtttacttcttttggtaaaggaggaagctggcactggaaaagactaacttgccctaatcccctgtagctgaaagaagctacattttgatgcatgtgtggcccactatgccacattttctcctccgttttttccattcataggcaattaatcttatccacctggactt

SEQ ID NO: 24136 - DNA, 221 bp, Homo sapiens
  AC004785.1_33823
  Located on chromosome 19
  Distance between a terminus base of telomere on chromosomal short arm and 5'-terminus of this base sequence : 58377259
  Distance between 3'-terminus of neighbour sequence of sequence listing upward to telomere on chrosomal short arm and 5'-terminus of this base sequence : 236266
gacaaggtcagaggcactaagggaatgggagtcacactgctgaccttgacccagtaggacacacacacacacacacacacacacacacacacacacacacactccaaggtggaggggtgaagacacctgctcaggacccaaggccccatttttctaccctaatgcataggtcccaatattgactgatgctctctcctctctcctagcctcacttctaacct

SEQ ID NO: 24137 - DNA, 212 bp, Homo sapiens
  D19S872
  Located on chromosome 19
  Distance between a terminus base of telomere on chromosomal short arm and 5'-terminus of this base sequence : 58428458
  Distance between 3'-terminus of neighbour sequence of sequence listing upward to telomere on chrosomal short arm and 5'-terminus of this base sequence : 50978
acctgggcgattgagtgactgcctcaaaaaatatatgtgtgtgtttgtatgtgtgtgtgtatttgtgtgtgtgtgtgtgtgtgtgtgtgtgtgtgtatcttccacgtcagttctaaccaagaaagcaattttgcctgatttgtgaccacaggaaaaagggtgctcactttactttcaaatcagtgccccagtcactgttagcacaagccaca

SEQ ID NO: 24138 - DNA, 331 bp, Homo sapiens
  AC006486.1_99280
  Located on chromosome 19
  Distance between a terminus base of telomere on chromosomal short arm and 5'-terminus of this base sequence : 58597290
  Distance between 3'-terminus of neighbour sequence of sequence listing upward to telomere on chrosomal short arm and 5'-terminus of this base sequence : 168620
ctgtaatctcacctactcaaagaggctgaggcaggagaatcgcttgaaatcgggaggcggaggttgcagtgagccgagatcgcgccactgcactccagcctgggggacacaacgagactctgtctcaacaacaacaacaacaacaacaacaacaaaagatggagggtggtgaaggggtcatgagattggagggatttgggggaccagaaagtgattctggacggagaaatccaggggtagacgaggtacaggggaatgcagaaagtggaaagagatagtagagaaagagaagcaggagagggagagcagcaagagaagtctggaaagcctg

SEQ ID NO: 24139 - DNA, 161 bp, Homo sapiens
  AC006486.1_94920
  Located on chromosome 19
  Distance between a terminus base of telomere on chromosomal short arm and 5'-terminus of this base sequence : 58601728
  Distance between 3'-terminus of neighbour sequence of sequence listing upward to telomere on chrosomal short arm and 5'-terminus of this base sequence : 4107
tgtcttgaatgcaaagatatgtactttagatttcaacacacacacacacacacacacacacacacacacacacacacccacggtgttttgagtaggggaagcccacgagtagataggctcactaaagccctggcgcggccttagagtggctccttagaagg

SEQ ID NO: 24140 - DNA, 465 bp, Homo sapiens
  chr19.fa.O7frz.51074965
  Located on chromosome 19
  Distance between a terminus base of telomere on chromosomal short arm and 5'-terminus of this base sequence : 58802570
  Distance between 3'-terminus of neighbour sequence of sequence listing upward to telomere on chrosomal short arm and 5'-terminus of this base sequence : 200681
ttacatttacctgctacctgacctgctattctctctctctctctctctcttttttttttttgaggcggggtctcactgtcacccaggccggagtgcagtggtgtgatcatggttcactgcaacctccacgtcccaggctcaagcaatcctcctacctcagcctcccaagtagtatctgggactacaggcccatcccaccacactcaactaatttgtgtgtgtgtgtgtgtgtgtgtgtgtgtgtgtgtgtgtatctttttgtagagacagggtttcaccatgttgcccagtctggtttcaaactcctgagctcaagtgatccacccactgcggcctcccaaagtgctaggattacaggcatgagtcgctgcacctggccaacccctgaaattcctcaaaatctttcagagaaagcattatagaagatacgagtttgtgattgtatgtttcatctgatcctacatc

SEQ ID NO: 24141 - DNA, 345 bp, Homo sapiens
  chr19.fa.O7frz.51175481
  Located on chromosome 19
  Distance between a terminus base of telomere on chromosomal short arm and 5'-terminus of this base sequence : 58903080
  Distance between 3'-terminus of neighbour sequence of sequence listing upward to telomere on chrosomal short arm and 5'-terminus of this base sequence : 100045
caaatacagaagtgatgacatctatttaataaggttgtagtaaggatgaacgaggtaatgcacagaaaatgcctaacccacagtaaaggtaccctacgtcactgcctctaaacctcacaagatagtgggagagaattaaactgagctcccacacataaatggcctgacacagcgactctccattccctacttcccacccctaaacacacaaactctgtctcacacacacacacacacacacactcattcactcaacttaaaaaggcatgaagttgcagggtgagtgtatctgctgcccccttatggccagagaaaagaatcacactgttctcctttcctaggaac

SEQ ID NO: 24142 - DNA, 184 bp, Homo sapiens
  D19S423
  Located on chromosome 19
  Distance between a terminus base of telomere on chromosomal short arm and 5'-terminus of this base sequence : 58906890
  Distance between 3'-terminus of neighbour sequence of sequence listing upward to telomere on chrosomal short arm and 5'-terminus of this base sequence : 3465
gtttcaaactcgtgtgtgtgtgtgtgtgtgtgtgtgtgtgtgtgtgtgtgtgtaagttaacatatcactaaataacccttggttcaacatggaaatttaaaagtatttagaactgaggtcaggagcagtggctcacgcctgtaatcccatcactttgggaggctaaggcaggtggatcaccaga

SEQ ID NO: 24143 - DNA, 150 bp, Homo sapiens
  DISO7_10004451
  Located on chromosome 19
  Distance between a terminus base of telomere on chromosomal short arm and 5'-terminus of this base sequence : 59156981
  Distance between 3'-terminus of neighbour sequence of sequence listing upward to telomere on chrosomal short arm and 5'-terminus of this base sequence : 249907
gaagagtcctcatcttctttcccttttatatatatatatatatatatgtttatatatatatataaattttttttctagtttaaatttattgtttgtttgtttctgtttttttggttttcggttcaaaactttgttggcctccacaatagc

SEQ ID NO: 24144 - DNA, 331 bp, Homo sapiens
  DISO7_00020513
  Located on chromosome 19
  Distance between a terminus base of telomere on chromosomal short arm and 5'-terminus of this base sequence : 59249274
  Distance between 3'-terminus of neighbour sequence of sequence listing upward to telomere on chrosomal short arm and 5'-terminus of this base sequence : 92143
gtcttggttacaagtcttggggctcccttataatctctgaggataaagggtgtaagataagggaaacgaaggcacacaaagcaggaagggaagaaactggggagaaggaaaaaagtggtgcaaggacaaggagcaaaaagaagagacctgttattcaggaggctgaggcacaagaatcacttgaactcaggaggcagaggttgcagtaagccaagattgttccactgcactgccctgggcgatagagcaagactctgtctcaaaagagagagagagagagagagagagagagagagagagagacctggaactggaactggatgtatggaag

SEQ ID NO: 24145 - DNA, 449 bp, Homo sapiens
  AC004558.1_21272
  Located on chromosome 19
  Distance between a terminus base of telomere on chromosomal short arm and 5'-terminus of this base sequence : 59385726
  Distance between 3'-terminus of neighbour sequence of sequence listing upward to telomere on chrosomal short arm and 5'-terminus of this base sequence : 136121
tatgcctttacatcctcatcacttagctcccacttatgaatgagaacatacgatgtttggttttccattcctgagtcacttcacttagaataatagtcttcaatcccatccaggttgctgaggatgccattaattcattcctttttatggctgagtagtattccatcatacacacacacacacacacacacacacacacacacacacacacatatatatacataccaagtttctttatccactcattgattgatggacatttttgttggttccacatttttgcaattgcaaattgtgctgctataaacatgcatgtgcaagtatctttttgtataatgacttcttttcttctgggtagataccaaaagtgggattgctggatcaaatggtagttctacttttagttctttaaggaatctccacactggtttccataatggttgcactag

SEQ ID NO: 24146 - DNA, 311 bp, Homo sapiens
  AC005204.1_16463
  Located on chromosome 19
  Distance between a terminus base of telomere on chromosomal short arm and 5'-terminus of this base sequence : 59455033
  Distance between 3'-terminus of neighbour sequence of sequence listing upward to telomere on chrosomal short arm and 5'-terminus of this base sequence : 68858
agatacaggcaaagtacttagcacagaatccggcacataggaattgcccctcagtcatagctaacatagcattattcatcagcctgagttgactggtaagggctaaaagtaaatggttgcaacaaaaataaagaaacatacgccaaaaatgtgtgtgtgtgtgtgtgtgtgtgtgtgtgtgtgtgtaaaaggtattttatgtaaatacaaacacactgttggagaccagcctcaacaccacccgtagggtacctgaagtctggtggcgacaaaggaatgagcagagacaggttaagagttcataaaggtgg

SEQ ID NO: 24147 - DNA, 195 bp, Homo sapiens
  D19S211
  Located on chromosome 19
  Distance between a terminus base of telomere on chromosomal short arm and 5'-terminus of this base sequence : 59718884
  Distance between 3'-terminus of neighbour sequence of sequence listing upward to telomere on chrosomal short arm and 5'-terminus of this base sequence : 263540
tcaccaaacctcaagacacactttgtgcagacacacagacacacacacacacacacacacacacacacacagaagagatacacacagacccacacagtcagacacataccctgcaggttgggcaagaacagtcctgggcctcagcctcctggtgtccccatggctctgggtcggggtgcaaattaacgccctttg

SEQ ID NO: 24148 - DNA, 280 bp, Homo sapiens
  AC005260.1_494
  Located on chromosome 19
  Distance between a terminus base of telomere on chromosomal short arm and 5'-terminus of this base sequence : 59733570
  Distance between 3'-terminus of neighbour sequence of sequence listing upward to telomere on chrosomal short arm and 5'-terminus of this base sequence : 14491
gagtgcgacagaaatacttcagatttttgattttaaaactttatgcatgaacctataaaactccctgttaaaaaaaaaaaactggatttaaattgtgctattgtaaatataaaaattaacatttatctgaggaagcccttgctgagttttagagagagtaggtagtaaatttacatctcaaagcacacacacacacacacacacacacacacacacacacacacagaagaatttgggtgtgttcaaggaagattaaaagtagatgccaaggtaacacaaa

SEQ ID NO: 24149 - DNA, 271 bp, Homo sapiens
  chr19.fa.O7frz.53007224
  Located on chromosome 19
  Distance between a terminus base of telomere on chromosomal short arm and 5'-terminus of this base sequence : 59813302
  Distance between 3'-terminus of neighbour sequence of sequence listing upward to telomere on chrosomal short arm and 5'-terminus of this base sequence : 79452
cttaaatgaatcctcagaggactatttctgtgggtgtgtgtctgcttgtgtgtgtgtgtgtgtgtgtgtgtgtgcatgtgtgtgtcttgccccattccaattctccatccccatgctgaggaggctggaggattcagaatgcagaatcaggtgtatttttaaaaaatcattatgtctgtcctcaccaaaacactggctatttctatctttccttctcattttactctgctataggaatctaagtaaatcatctttaggaaataccaagacc

SEQ ID NO: 24150 - DNA, 369 bp, Homo sapiens
  DISO7_00003985
  Located on chromosome 19
  Distance between a terminus base of telomere on chromosomal short arm and 5'-terminus of this base sequence : 59920239
  Distance between 3'-terminus of neighbour sequence of sequence listing upward to telomere on chrosomal short arm and 5'-terminus of this base sequence : 106666
ggcaggttccagaagtttaaaagtgatgctaggaggtggagagagcatcagacaatattgagacctatgtattggggtgaaaagatggggccctgggtcctgaggaggtctcttcaatcctcagccttgaagacacacacacacacacacacacacacacacacacacacacacacacacaaaaggggcatgtgtgtttgtatgtgtgtatgtgtgtgtgtactactgtcctactaggtcaaggtcagcagcatgacccccattccttcaccacttgtgaccttggcatttttctgtttggaatcctcttccccaggggtccgcatgaccccatcaggtcctgctcacatcagggtatcctaagacttc

SEQ ID NO: 24151 - DNA, 428 bp, Homo sapiens
  chr19.fa.O7frz.53190425
  Located on chromosome 19
  Distance between a terminus base of telomere on chromosomal short arm and 5'-terminus of this base sequence : 60040473
  Distance between 3'-terminus of neighbour sequence of sequence listing upward to telomere on chrosomal short arm and 5'-terminus of this base sequence : 119865
atcactattgtagaacgcgagactggtcttttgagatgtttctcattcttttgcattctggcaaccggctgacctcattcatacctatgactaatggctcagccagtcatgtggtccctacctagaggcagattcaagcacaaacagatcatttccctccgcccgcatgattccatcaccaaacaatcaccaaaaaatgagcagtactcaatttttagtcctgtgaccctgaaactgtccttgaaaatctctaacccctgctccactggggaggctgatttgagtactaatcaacctccagcctcctgtttggcagacttggagtcgttaaaatctttcttgactagaaaccaacatttcaataattttgtgtgtgtgtgtgtgtgtgtgcagaaggccagaagaacttgtctggcaattatgagtgg

SEQ ID NO: 24152 - DNA, 456 bp, Homo sapiens
  chr19.fa.O7frz.53292256
  Located on chromosome 19
  Distance between a terminus base of telomere on chromosomal short arm and 5'-terminus of this base sequence : 60142535
  Distance between 3'-terminus of neighbour sequence of sequence listing upward to telomere on chrosomal short arm and 5'-terminus of this base sequence : 101634
gttccagaaggttaaaagtgaggctaggatggggagggagcatcagtcaatatcaaaacctatgtattgggatggaaagttggggccctttgtccttagaggttctcttcacccatgagccttggagagagagagaatgtgtgtgtgtgtgtgtgtgtgtgtgtgtgtgtgtgtgtgtgtgtgtgtgtgtgtgtcctgctgggtcaaggtcagcagcatgacccccattccttcaacacctctgaacttggcatttccctgtgtggaatcctcttccccaggggtctgcatggttccctttccactgacctcatatcctgctcacatcagggcatccttgaaagagccctttcttgacacctccactagagattctgggtcttccctttctcacttttccctgctcagttttctccagggctcttgtcaacacctgacctcacattctagatatcc

SEQ ID NO: 24153 - DNA, 130 bp, Homo sapiens
  DISD22_0011744
  Located on chromosome 19
  Distance between a terminus base of telomere on chromosomal short arm and 5'-terminus of this base sequence : 60304174
  Distance between 3'-terminus of neighbour sequence of sequence listing upward to telomere on chrosomal short arm and 5'-terminus of this base sequence : 161183
tcttgttaggcaaccctctctgaatatctctctctttctgtctccggctctctctccagctctctctgtctctttctgtctatgtctctctctctctctctctctgtctgcagattccagcagtggctct

SEQ ID NO: 24154 - DNA, 104 bp, Homo sapiens
  DISD22_0011745
  Located on chromosome 19
  Distance between a terminus base of telomere on chromosomal short arm and 5'-terminus of this base sequence : 60388258
  Distance between 3'-terminus of neighbour sequence of sequence listing upward to telomere on chrosomal short arm and 5'-terminus of this base sequence : 83954
tgattgaccaaccatttctcaaaagggctttttgagcactctctctctctctctctcttgctgtctctgtatttttttaatgtttgacagcaagaagatagtca

SEQ ID NO: 24155 - DNA, 477 bp, Homo sapiens
  AC068785.8_161856
  Located on chromosome 19
  Distance between a terminus base of telomere on chromosomal short arm and 5'-terminus of this base sequence : 60474493
  Distance between 3'-terminus of neighbour sequence of sequence listing upward to telomere on chrosomal short arm and 5'-terminus of this base sequence : 86131
acgaatgagtgaacatgaagtctaaagccacccttagctgggcagtgtggctcaacacctgtaatcccagcactttaggaggccaaggcgggaagactgcttgaggccagaagttcgaggccagcctgggcaacatagtgagagcccatctctacaaaaaatagaaaatttatcaggtgtggtggtacatgcctatagtcccagctgctcaggaggctgaagcaggaggatcgcttgggcccaggagttcgaggctggagtgaacaatgattgcaccactgcacttcagcctgggcaacagagcaagaccctgtctctaataataataataataataataataataataataataataaaccaccctcatcttaaagatgcaaaaacaaaggtccagaaagagacaggagtgagactggtagcccttggttgatgaggcaaaagttgggaaagggcttggaatgtccaataaaaggt

SEQ ID NO: 24156 - DNA, 136 bp, Homo sapiens
  D19S408
  Located on chromosome 19
  Distance between a terminus base of telomere on chromosomal short arm and 5'-terminus of this base sequence : 60475878
  Distance between 3'-terminus of neighbour sequence of sequence listing upward to telomere on chrosomal short arm and 5'-terminus of this base sequence : 908
gcctcttagagttttgggagactcttggatgagaaccaactcatctttattaaatgcatcgtgtgtgtgtgtgtgtgtgtgtgtgtgtgtgtgtgtgtatagcacatacttcaggcttgcggcaccaccccataga

SEQ ID NO: 24157 - DNA, 238 bp, Homo sapiens
  DISO7_00020558
  Located on chromosome 19
  Distance between a terminus base of telomere on chromosomal short arm and 5'-terminus of this base sequence : 60557996
  Distance between 3'-terminus of neighbour sequence of sequence listing upward to telomere on chrosomal short arm and 5'-terminus of this base sequence : 81982
cagtcctgggcctacttccacccatcaccaaggtctcaggaattctagcccaggctgaacatggtggcttatgcctgcaatcccagcactttaggaggctgagacgggaggactgcttaaggccagcagttccagaccagcctgggcaacacagggagaccccgtcactacaattaaaaaataataataataataataataattctagccctcccacgccattccatcctcagcaacc

SEQ ID NO: 24158 - DNA, 100 bp, Homo sapiens
  D19S913
  Located on chromosome 19
  Distance between a terminus base of telomere on chromosomal short arm and 5'-terminus of this base sequence : 60620095
  Distance between 3'-terminus of neighbour sequence of sequence listing upward to telomere on chrosomal short arm and 5'-terminus of this base sequence : 61861
ccaccatgcctgattagtcctattcttgaatcgtgtgtgtgtgtgtgtgtgtgtgtgtgtgtgtgtgttctttgtccttctcaaactgcagagtctgatc

SEQ ID NO: 24159 - DNA, 163 bp, Homo sapiens
  AC005622.1_4171
  Located on chromosome 19
  Distance between a terminus base of telomere on chromosomal short arm and 5'-terminus of this base sequence : 60620107
  Distance between 3'-terminus of neighbour sequence of sequence listing upward to telomere on chrosomal short arm and 5'-terminus of this base sequence : -88
attagtcctattcttgaatcgtgtgtgtgtgtgtgtgtgtgtgtgtgtgtgtgtgttctttgtccttctcaaactgcagagtctgatcactgttttcttccttgcaggaagctctaagacatgtccagcctgctctttgctgtgaacctgcattgaaataact

SEQ ID NO: 24160 - DNA, 368 bp, Homo sapiens
  AC005622.1_26583
  Located on chromosome 19
  Distance between a terminus base of telomere on chromosomal short arm and 5'-terminus of this base sequence : 60642444
  Distance between 3'-terminus of neighbour sequence of sequence listing upward to telomere on chrosomal short arm and 5'-terminus of this base sequence : 22174
taagctccacgagagcaagggccttctgtgtcttattcatcactgtatcagtacctaaaactgtgcctagcacctaaaaggcagccagtatttacatgaatgaatgaatgaatgaatgaatgaatgaatccctgaggactgacttcaggtttacccaggttgtggagagtggagagaaggtggaggccaccacatgtagatattcctaggaaagtgctttagaatttctaagagacacagagagaaagggcagggaggaaaggaggcttgggagtgggcagaagaaatcgttcagggactgtctttttcactgctgtgtctccagcctcgaccagccagggcctgactcacagtaggtgtctggaaag

SEQ ID NO: 24161 - DNA, 223 bp, Homo sapiens
  D19S217
  Located on chromosome 19
  Distance between a terminus base of telomere on chromosomal short arm and 5'-terminus of this base sequence : 60709810
  Distance between 3'-terminus of neighbour sequence of sequence listing upward to telomere on chrosomal short arm and 5'-terminus of this base sequence : 66998
caagacccatacccatgaagggggaccttgaaactcacattccttcttattcctgtcccatttcacatcaaaaatagttcttcaggtgtgtgtgtgtgtgtgtgtgtgtgtgggtgtgtgtgtgtggtgtctagaaaaagacatctagcctctagagagtgccccctccccttcccttcctacccacctggtgttgtcctagaaaccaacttcaatcaacccc

SEQ ID NO: 24162 - DNA, 369 bp, Homo sapiens
  AC011508.4_18463
  Located on chromosome 19
  Distance between a terminus base of telomere on chromosomal short arm and 5'-terminus of this base sequence : 60751624
  Distance between 3'-terminus of neighbour sequence of sequence listing upward to telomere on chrosomal short arm and 5'-terminus of this base sequence : 41591
gtcaggagttcaagaccagactggccaacagggcgaaactctgtctctactaaaaatacaaaaattagcctgatgtggtggtgggcacctataatcccagctacctgggaggcaaaggcaggagaatggcttggacctggaaggcggaggttgcagtgagcagagatcacgccactgccctctagcctgggtgacaaagggagaaagaaagaaagaaagaaagaaggaaagagagaaagaaagagggaaggagagagggagggaggaaggaaggaagggagggagggagggaggaaggcaggcaggaagactcattgatcatccatatagcaattatgtggatcaaaattgtcaacatttgccatattt

SEQ ID NO: 24163 - DNA, 285 bp, Homo sapiens
  AC011508.4_59767
  Located on chromosome 19
  Distance between a terminus base of telomere on chromosomal short arm and 5'-terminus of this base sequence : 60792940
  Distance between 3'-terminus of neighbour sequence of sequence listing upward to telomere on chrosomal short arm and 5'-terminus of this base sequence : 40947
tagtggcatttgattgttgataattgtggtttaattttccattttctgattgctgcctatttgtatattcttgcaatttctcttcgctccttgctccgggcattggatgcattcgatgtgtctgttttttacagagcctctgttcagtttgcaggacaacaattaacacctaggccatgacattctctctgtgtgtgtgtgtgtgtgtgtgtgtgtgtgtgtgtgtgtgtgtgtattccccaccagtgagctggttttgatgactgtgatggaatcagctttatc

SEQ ID NO: 24164 - DNA, 124 bp, Homo sapiens
  DID22N_0015535
  Located on chromosome 19
  Distance between a terminus base of telomere on chromosomal short arm and 5'-terminus of this base sequence : 61141114
  Distance between 3'-terminus of neighbour sequence of sequence listing upward to telomere on chrosomal short arm and 5'-terminus of this base sequence : 347889
catcatagagacttgtcctcctcaaaaaaactacaatttttaagggtcagtttgttaaatctaatcatgtattcatcatatatatatatatatatatatatatgcgccaagagttacatactct

SEQ ID NO: 24165 - DNA, 333 bp, Homo sapiens
  AC074331.1_81747
  Located on chromosome 19
  Distance between a terminus base of telomere on chromosomal short arm and 5'-terminus of this base sequence : 61199008
  Distance between 3'-terminus of neighbour sequence of sequence listing upward to telomere on chrosomal short arm and 5'-terminus of this base sequence : 57770
gaggtcaggaattcaagactagcctggccaagatggcaaaaccccgtctctactaaaaatacaaaaattagctgggcgtggtggggaggggggtgcctataaccccagcgacttgggaggctgaggcaggagacttgcttgaaccttgtgtgagggcggaggttgcaatgagccgaggtcatgccacttcactccagcctgggcaaaagagccaaactctgtctaacaacaacaacaacaacaacaacaacaaaacagaacaaaaaaaaaaagaaaaaagttgtgaaaatgtagtgagggtcccatagtctgaatagtttgaactagttcctg

SEQ ID NO: 24166 - DNA, 193 bp, Homo sapiens
  AC074331.1_116281
  Located on chromosome 19
  Distance between a terminus base of telomere on chromosomal short arm and 5'-terminus of this base sequence : 61233695
  Distance between 3'-terminus of neighbour sequence of sequence listing upward to telomere on chrosomal short arm and 5'-terminus of this base sequence : 34354
ggttgtcacatatggcataaagttgttcataatatttccttattatcattttaatgtcattaggatctggcgtgtgtgtgtgtgtgtgtgtgtgtgtgtgtgtgtgtgtctcccaggctggagtgcagtggcacaatcttgcattcacagcaccctttgcctccggggcaggtttaagtgattctcctgcctc

SEQ ID NO: 24167 - DNA, 361 bp, Homo sapiens
  AC074331.1_138692
  Located on chromosome 19
  Distance between a terminus base of telomere on chromosomal short arm and 5'-terminus of this base sequence : 61255995
  Distance between 3'-terminus of neighbour sequence of sequence listing upward to telomere on chrosomal short arm and 5'-terminus of this base sequence : 22107
cctgtaatctcagcactttgagaggccaaggtggcaggatcactcgaggccaggagtttaagaccagcctggacaacacagtgagaccgcacctctataaaaaaatttaaaaaattagctcacagctataactgtgccactgcactgtagcctgggcgacagagcaagaccctgtctcaaaaatacatacatacatacatacatacatacatacatacatttaattaaattaaatacccatctctttattctgcctttgtgattaatcatcaatcatcagctgacatattcatgtattacattttgtttacttttctatggtctctttccccattagagtacaacttcatgaacgtaagaa

SEQ ID NO: 24168 - DNA, 236 bp, Homo sapiens
  chr19.fa.O7frz.54542982
  Located on chromosome 19
  Distance between a terminus base of telomere on chromosomal short arm and 5'-terminus of this base sequence : 61325771
  Distance between 3'-terminus of neighbour sequence of sequence listing upward to telomere on chrosomal short arm and 5'-terminus of this base sequence : 69415
gcatttcagtataattgtaatgaacatttcttttgaaataaactgaacatctattcatatgtatacatatttctatgtgtgtatatgtgtatgtatatacatacacatacacacacacacacacacacacacacacacacacacaccctagctctatgtcctgagacaaagaaacatagatcatagatactacagtgaccatacctagcatccagactttggcattaaataccatt

SEQ ID NO: 24169 - DNA, 277 bp, Homo sapiens
  AF025422.1_513
  Located on chromosome 19
  Distance between a terminus base of telomere on chromosomal short arm and 5'-terminus of this base sequence : 61397590
  Distance between 3'-terminus of neighbour sequence of sequence listing upward to telomere on chrosomal short arm and 5'-terminus of this base sequence : 71583
cttggagcttacagcgtcttgcgacttggaagcggattcagaggacaggacagaacacttgggtaagtgaatctctgtctgtctgtctgtctgtttgtctcattggttggtttatttccattttcttaaggagcacatatttcacctcacacacacacggacacacacacacacacacacacacacacacactccttctttctgcgggttagaaaactggtaggcttctctgggagctacaggtttcctaatcatgtctgcacctaagaacagtagg

SEQ ID NO: 24170 - DNA, 131 bp, Homo sapiens
  HUMUT753
  Located on chromosome 19
  Distance between a terminus base of telomere on chromosomal short arm and 5'-terminus of this base sequence : 61446959
  Distance between 3'-terminus of neighbour sequence of sequence listing upward to telomere on chrosomal short arm and 5'-terminus of this base sequence : 49092
acccctaccaatttcctaacccgcagaatgaaggagtgtgtgtgtgtgtgtgtgtgtgtgtgtgtgtgtgtgtgtgtgtgtggtgtgaggtatgtgctccttgagaaaatggaaataaaccaaccaatgag

SEQ ID NO: 24171 - DNA, 371 bp, Homo sapiens
  AC073898.1_19123
  Located on chromosome 19
  Distance between a terminus base of telomere on chromosomal short arm and 5'-terminus of this base sequence : 61520284
  Distance between 3'-terminus of neighbour sequence of sequence listing upward to telomere on chrosomal short arm and 5'-terminus of this base sequence : 73194
ggttgcagctactcaggaggctgaagagggaggattgcttgggtctgggagttcgaggctgcagtgagccatgatcgcaccgctgcactccagcctgggtgatggagcaagactctgaaaaaaaaaaaagaaaaagaaagaaagaaagagaaagaaaggaaagaaagaaagaaagaaagaaagaaagaaagaaagaaagaaagaaagaaagaaagaaagaaagagaaaagaaagaaaggagggagggagggaaggaaggaaggaagaaaggaaggagaaaaaaaaaagagtggggtaaggaatatgattattccatcccatagttaaaaacactgaagctcacagaggtgagatgacttggataaagtcac

SEQ ID NO: 24172 - DNA, 162 bp, Homo sapiens
  D19S903
  Located on chromosome 19
  Distance between a terminus base of telomere on chromosomal short arm and 5'-terminus of this base sequence : 61529868
  Distance between 3'-terminus of neighbour sequence of sequence listing upward to telomere on chrosomal short arm and 5'-terminus of this base sequence : 9213
accgcactccaccctgggcgacagagtgagactctgtcaacacacacacacacacacacacacacacacacacacacacacacaatggagcaaatatataaagtgatgacaagcattataaaggagtagaataagatgctattcgaggatctcacaggagga

SEQ ID NO: 24173 - DNA, 320 bp, Homo sapiens
  AC073898.1_30759
  Located on chromosome 19
  Distance between a terminus base of telomere on chromosomal short arm and 5'-terminus of this base sequence : 61531823
  Distance between 3'-terminus of neighbour sequence of sequence listing upward to telomere on chrosomal short arm and 5'-terminus of this base sequence : 1793
ttagaaagaggtagaaatgctgagtcctgcccagatcatgggcttagagaagaacacccttagggaacacccttagggctgaaggaattcagcacacttgccaatcatccatccatgcacctgtccataagtccatctactctccaccaactcagcctttcctacattcattcacccaattgttcactcgtccagtcacccttctatttatccatccaccaatttgtccctcaatccacccatctatccatccgtcatccatccatccatccatccatccatccatccatccatccatcctatccataaatctaccttcc

SEQ ID NO: 24174 - DNA, 290 bp, Homo sapiens
  AC073898.1_35208
  Located on chromosome 19
  Distance between a terminus base of telomere on chromosomal short arm and 5'-terminus of this base sequence : 61536313
  Distance between 3'-terminus of neighbour sequence of sequence listing upward to telomere on chrosomal short arm and 5'-terminus of this base sequence : 4170
atgtcaaattcaaggagtctgtgtgctccagaggggccaagttctgggcttccaccgggggctggtgcagcttctctggggagaaggaaagagaaagaatggcgttataggacatgggaggatctggaaccctaggaatgatcagcagcacgaataggctggggaccttggaaacaccagtgttggctttgctgtttccaagatgaccaataagcacacacacacacacacacacacacacacacacacacacacacagccaacagctctacttccggaagttcttaact

SEQ ID NO: 24175 - DNA, 184 bp, Homo sapiens
  D19S574
  Located on chromosome 19
  Distance between a terminus base of telomere on chromosomal short arm and 5'-terminus of this base sequence : 61606679
  Distance between 3'-terminus of neighbour sequence of sequence listing upward to telomere on chrosomal short arm and 5'-terminus of this base sequence : 70076
ttatggaccgctgaggttcatccatctgtatttctgtgatttgatgactaattttgtgtgtgtgtgtgtgtgtgtgtgtgtgtgtgagatggagcctcgctctgtcgcccaggctggagtgaagtggtgcgatctcggctcactacaacctccaccacccgggttcaagcgagtctcctgcctc

SEQ ID NO: 24176 - DNA, 421 bp, Homo sapiens
  chr19.fa.O7frz.54894401
  Located on chromosome 19
  Distance between a terminus base of telomere on chromosomal short arm and 5'-terminus of this base sequence : 61681817
  Distance between 3'-terminus of neighbour sequence of sequence listing upward to telomere on chrosomal short arm and 5'-terminus of this base sequence : 74954
cttgaggttaggagtttgagaccagcctggccaacatgtcaaaaccctgtctgtactaaaaatattaaaattagccaggcatggtggcgcatgcttgtaatcccagctactcgggaggctgaggtgagagaatcgcttgaacctgggaggtggaggttgcagtgagccaagatcgcaccactgcactccagcctggatgacagatcaagactccatttaaaaaagaagaagaagaagaagaagaagaagaatgatatcagcagaatacatctacaagctgaccacttctcccatccctggttcagccgccactacctcctgcctggtccagcactacccaacaggagcaagagtggagccgcaaacacaattcaaccttttccagcctcatctcatgaagaaaggtgaaacgaatgtattt

SEQ ID NO: 24177 - DNA, 381 bp, Homo sapiens
  AC021988.4_100933
  Located on chromosome 19
  Distance between a terminus base of telomere on chromosomal short arm and 5'-terminus of this base sequence : 61719783
  Distance between 3'-terminus of neighbour sequence of sequence listing upward to telomere on chrosomal short arm and 5'-terminus of this base sequence : 37545
agctagcgtgcacctgtagtcccagctactcgggaggctgaggcatgagaatcgcttgcacctgggggacagaggttggcataagccaagaccgcaccactacactccagcctgggtgacagagtgagactccatctcaataaaaataaataaataaataaataaataaataaatagtgaatcttaagtttgccaaggatgcatttttatctctctttagttcttaagattctgatcattcttctttttttttcaagttccagggtatatgtgcaggatgtgcaggtttgttacatagtaaaaatgtgccacggtggtttgctgcacccatcaacccatcgcctaggtatgaagcccgtcatgcattagctattcttccta

SEQ ID NO: 24178 - DNA, 268 bp, Homo sapiens
  AC021988.4_159367
  Located on chromosome 19
  Distance between a terminus base of telomere on chromosomal short arm and 5'-terminus of this base sequence : 61730860
  Distance between 3'-terminus of neighbour sequence of sequence listing upward to telomere on chrosomal short arm and 5'-terminus of this base sequence : 10696
acataactagcacatggacgagccagggctcaaaactatgtctctaagcccagcatgttgaattctattttccccaatgaagcaggtcctgctattgaaaacacaggatatttgatgaggacaataataatatataatgttatattattattattattattattattataaaactaatagcagctaaattgcatcaagagccttctatacatcagaccccatgggacagagtcatattttcttgatgtgatccactctacagatgagg

SEQ ID NO: 24179 - DNA, 333 bp, Homo sapiens
  AC021988.4_139379
  Located on chromosome 19
  Distance between a terminus base of telomere on chromosomal short arm and 5'-terminus of this base sequence : 61750809
  Distance between 3'-terminus of neighbour sequence of sequence listing upward to telomere on chrosomal short arm and 5'-terminus of this base sequence : 19681
ttatttctatgtttcctggtcaacatagtgagacgctgtctctacagaagatcaaaaaatgtgttggctgagcatgagcctggtggtgtgtgcctgcagtcccagctacttaggaggctgaggttcaagcatcactttagcccgggatgtcaaggctgcagtgaactatgatcacgccactgcattccagcctgggtgccagagggagatcctgtctcttgttttgttttgttttgttttgttttgttttgttttgttgttactaagtctcactctgctgcacaggctggaggagtgcagtggtgcaatctctgctcactgcaatctccgtct

SEQ ID NO: 24180 - DNA, 186 bp, Homo sapiens
  HUMUT7544
  Located on chromosome 19
  Distance between a terminus base of telomere on chromosomal short arm and 5'-terminus of this base sequence : 61831021
  Distance between 3'-terminus of neighbour sequence of sequence listing upward to telomere on chrosomal short arm and 5'-terminus of this base sequence : 79879
actccagtctgtgtgacagagtgagaccctgtctttacatagatatagacagatgatgatagatagatgatagatagatagatagatagatagatagatagatagatagatgatagatagatagatagacagatagatgatagatagacagacagatatccacatagatacctcaaacctattatg

SEQ ID NO: 24181 - DNA, 193 bp, Homo sapiens
  AC006126.1_7039
  Located on chromosome 19
  Distance between a terminus base of telomere on chromosomal short arm and 5'-terminus of this base sequence : 61996999
  Distance between 3'-terminus of neighbour sequence of sequence listing upward to telomere on chrosomal short arm and 5'-terminus of this base sequence : 165792
acttcctttgtaggtgaccttctcggagcctcagtttcctcatccgttccatggggatagtagtattctcgtcatagggttattagggaaatttatcatcatcatcatcatcatcatcatccatgactatagtaacaattccagttctcactcaatgagttcttatttcagacctaaataagcatcttacatg

SEQ ID NO: 24182 - DNA, 427 bp, Homo sapiens
  chr19.fa.O7frz.55431947
  Located on chromosome 19
  Distance between a terminus base of telomere on chromosomal short arm and 5'-terminus of this base sequence : 62189025
  Distance between 3'-terminus of neighbour sequence of sequence listing upward to telomere on chrosomal short arm and 5'-terminus of this base sequence : 191833
ggtaaccatcctggctaacacggcgaaaccccgtctgtactaaaaatacaaaaaaaatagccgggtgtggtggtgggcgcctgcagtcccagctacttgcgaggctgaggcaggagaatcacttgaacccaggaggcagagcttgcagtgagccgagatcgcgccactgcattccagcctgggcgacagagcgagactctgtctgaaagaaagaaagaaagaaggacggaaggaaggaaggaaggaaggaaggaaggaaggaaggaaagaaaactgcaaattaaacaccaatgaagatgcctttgttttggggcactcatcaaaatagcaaaaatcaaaatgtttcataatactcggtgctggtgaggttgtggagaatcaggtgctctcacccattactgatgggtctgtaaattgcataacatgg

SEQ ID NO: 24183 - DNA, 159 bp, Homo sapiens
  D19S918
  Located on chromosome 19
  Distance between a terminus base of telomere on chromosomal short arm and 5'-terminus of this base sequence : 62200810
  Distance between 3'-terminus of neighbour sequence of sequence listing upward to telomere on chrosomal short arm and 5'-terminus of this base sequence : 11358
aaaggcttgattacccccgagacgttttccatcccatttatctctctctctctctctctctctctctctctctctctcacacacacacacacacacacacacacacacacacacacacagagtcagggaggccaggtgcggtggctcacgcctgtaatc

SEQ ID NO: 24184 - DNA, 228 bp, Homo sapiens
  D19S908
  Located on chromosome 19
  Distance between a terminus base of telomere on chromosomal short arm and 5'-terminus of this base sequence : 62464471
  Distance between 3'-terminus of neighbour sequence of sequence listing upward to telomere on chrosomal short arm and 5'-terminus of this base sequence : 263502
gtaagccaagatcactcccctgcactccaggctgggtgacagagtgagactccgtctcaaaaacaaaacaaaacaaaaatatatatatatatacacacacacacacacacacacacacacacacatataaaaacatatatacacacacatatatatgtaagtataatatatacacatatatacattctgtgggttaccacatgtaaagtattcagaacagtgcctggc

SEQ ID NO: 24185 - DNA, 338 bp, Homo sapiens
  L47234.1_15444
  Located on chromosome 19
  Distance between a terminus base of telomere on chromosomal short arm and 5'-terminus of this base sequence : 62469072
  Distance between 3'-terminus of neighbour sequence of sequence listing upward to telomere on chrosomal short arm and 5'-terminus of this base sequence : 4373
caaggcgagtacattgcttgagctcaggagctagagaccagcctgggcaacatggtgaaaacccgtctctacaaaaaatgcaaaaattagctgggcgtggtggcgtgcacctgtagtcccagatactcaggaggctgaggtgggagaatcacctgggcctgggaggcagaggttgcaatgggcagtgattgtgccactgcactccagcctgggcaacaggagtgaaaacctatctcaaatgtgtgtgtgtgtgtgtgtgtgtgtgtgtgtgcgcacgtgtataatcacaagtacaaaagtgctgtgaaggaaaacttcaagtcaccataaagattgat

SEQ ID NO: 24186 - DNA, 292 bp, Homo sapiens
  HUMUT579
  Located on chromosome 19
  Distance between a terminus base of telomere on chromosomal short arm and 5'-terminus of this base sequence : 62494254
  Distance between 3'-terminus of neighbour sequence of sequence listing upward to telomere on chrosomal short arm and 5'-terminus of this base sequence : 24844
tggctagcccattactctatgtcacctttatgccacttaggtaaacacctctttccttctgagggtccctttagatgtccacttccactggtcccctcttttctatttctttctttctttctttctctctctttcttttctttctttctttcctctctctccttccttcctttctctctctctccttccctccctccctccctccctgcttgcttgctttctctctctctctttctttctttctttctttctttctttctttctttctttcttttctatctcggctcattgc

SEQ ID NO: 24187 - DNA, 222 bp, Homo sapiens
  chr11.fa.O7frz.137648842
  Located on chromosome 19
  Distance between a terminus base of telomere on chromosomal short arm and 5'-terminus of this base sequence : 62529167
  Distance between 3'-terminus of neighbour sequence of sequence listing upward to telomere on chrosomal short arm and 5'-terminus of this base sequence : 34621
cggtgtttcaccatgttagccaggctgctctcgatctcctgacctcatgatccacccgccttggcctcccaaagtgctgggattacaggcatgagccaccacgcctggccaacacaaaattaatttattattattattattattattattattattagttatttttagagatgggggtcttgttgcgctgcccaggctggtctcaaactcaagcgatacttc

SEQ ID NO: 24188 - DNA, 175 bp, Homo sapiens
  Z23600.1_141
  Located on chromosome 19
  Distance between a terminus base of telomere on chromosomal short arm and 5'-terminus of this base sequence : 62587471
  Distance between 3'-terminus of neighbour sequence of sequence listing upward to telomere on chrosomal short arm and 5'-terminus of this base sequence : 58082
tcctggagtgactatttctgagacagattcccagggtggaattgctgggtggactggttgtgtgtctgtgtgtgtgtgtgtgtgtgtgtgtgtgtgtgtgttttgtttttgtttttattttttttgagacggattctcgctctattgcctaggctggagtgcaatggcacaatct

SEQ ID NO: 24189 - DNA, 174 bp, Homo sapiens
  D19S219
  Located on chromosome 19
  Distance between a terminus base of telomere on chromosomal short arm and 5'-terminus of this base sequence : 62587480
  Distance between 3'-terminus of neighbour sequence of sequence listing upward to telomere on chrosomal short arm and 5'-terminus of this base sequence : -166
gactatttctgagacagattcccagggtggaattgctgggtggactggttgtgtgtctgtgtgtgtgtgtgtgtgtgtgtgtgtgtgtgtgttttgtttttgtttttattttttttgagacggattctcgctctattgcctaggctggagtgcaatggcacaatcttggctcac

SEQ ID NO: 24190 - DNA, 109 bp, Homo sapiens
  D19S412
  Located on chromosome 19
  Distance between a terminus base of telomere on chromosomal short arm and 5'-terminus of this base sequence : 62856748
  Distance between 3'-terminus of neighbour sequence of sequence listing upward to telomere on chrosomal short arm and 5'-terminus of this base sequence : 269094
acatcttactgaatgcttgcttttattgtttttcatttgtgtgtgtgtgtgtgtgtgtgtgtgtgtgtgtgtgtgtgtgttttgagacagagtctcattctgtcgctca

SEQ ID NO: 24191 - DNA, 450 bp, Homo sapiens
  chr19.fa.O7frz.57584855
  Located on chromosome 19
  Distance between a terminus base of telomere on chromosomal short arm and 5'-terminus of this base sequence : 62965583
  Distance between 3'-terminus of neighbour sequence of sequence listing upward to telomere on chrosomal short arm and 5'-terminus of this base sequence : 108726
gtgcaggtttgttacatatgtatacgggacatttttaaatgttttatttatgggtgtagtaaagatcccatggagatcgagatcttgtacaaatatccatcctcatctgtacattttttaaaacaggataggaacattacaagaaatagcccgtttcattaaatcttctgttgtaggagtttgcacatgtatggctttttgtaaagcgggtactgagacaacttcaacagtggttttgaaagattaatctgaattttcataggttcagcattttttattttgcccacatctgtggaagaagaggcccatacagtgtcagggatctcagagagatccataaaaatctatgtatgtatgtatgtatgtatgtatgtatgtatctatctatctatctatctatctatctatctatctatttttttttttttgagacagtattttggctgttgc

SEQ ID NO: 24192 - DNA, 363 bp, Homo sapiens
  AC007193.1_41363
  Located on chromosome 19
  Distance between a terminus base of telomere on chromosomal short arm and 5'-terminus of this base sequence : 63068359
  Distance between 3'-terminus of neighbour sequence of sequence listing upward to telomere on chrosomal short arm and 5'-terminus of this base sequence : 102326
tgaaagcattacagttggataaggaacagagtgtgtgtgtgtgtgtgtgtgtgtgtgtgtgttggaccactattctggatttggttggcagggaagaggatactacagcagaagtggccttgttgaaccttgaacttgccaggcaagttgctcaccttagggcctttgcacttgctgttcccacagcttagcacactcttcctccaggaatccacacggctccccggctcacgccagttccccactctgttttcttttgggaaaccacttctctgtcctcttcatctatttaatttgaatagggcttggccactgctctgccttcaccagctccagggatggacataggatccaaacctggct

SEQ ID NO: 24193 - DNA, 335 bp, Homo sapiens
  chr19.fa.O7frz.57235494
  Located on chromosome 19
  Distance between a terminus base of telomere on chromosomal short arm and 5'-terminus of this base sequence : 63115160
  Distance between 3'-terminus of neighbour sequence of sequence listing upward to telomere on chrosomal short arm and 5'-terminus of this base sequence : 46438
aggagtgaggcctgactaccccaggagtgtgctcaagtaagggcagcccaggcggtggacagagttttgttgtgtgtattccatcaaggtgagcaatgcctgctgtgttcactagcttctttttgcgcaaccatcaatctctctctctctctctctccccctccactgccccactctcctctcttcccctccctgtcttttccctcctctccttccttctcttcctctctcaagttgaaagaagagtagctcagtcatcttccagaattgctttttagctccgagtcacctggctccacagcccccgaccactgtatgcctacttagctgttcct

SEQ ID NO: 24194 - DNA, 333 bp, Homo sapiens
  AC007785.1_143335
  Located on chromosome 19
  Distance between a terminus base of telomere on chromosomal short arm and 5'-terminus of this base sequence : 63218671
  Distance between 3'-terminus of neighbour sequence of sequence listing upward to telomere on chrosomal short arm and 5'-terminus of this base sequence : 103176
ctaacataggacttgaatccagagtatatgaaaaactctcaaaactcaaagtgaaacaacaaacaaaatcattaagcatcggcaaaatatctgaacagatgctttacaaaagaggacatacagatagcaaataagcacatgaaaagttgttcaacaccattagccatactggaactacaaattaaaaccagtgagatactatctcccatctactagaattggcaaaatttaaatatatatattaaataaataaataaataaatacacacacacacacacacacacacacacacacacatatatatgagtgtgtccttaattctctaccagtga

SEQ ID NO: 24195 - DNA, 348 bp, Homo sapiens
  AC007785.1_61071
  Located on chromosome 19
  Distance between a terminus base of telomere on chromosomal short arm and 5'-terminus of this base sequence : 63300980
  Distance between 3'-terminus of neighbour sequence of sequence listing upward to telomere on chrosomal short arm and 5'-terminus of this base sequence : 81976
gacatttctattgtagtgcaggacatgaaatggacattgaaaggataattattgaaataccatctcttttaaagtgcatgtagggaaagtaaagatttcaaatgggagttgataaaagggaaccttgacaaaatctggggagtgagtgagtgaatgcttctgaggaagtgctctttgaactgagttagtgatgacataaaagaggacagagggatcgtgtatgtgtgtgtgtgtgtgtgtgtgtgtgtgtgtgcatgcgtgtgtgttctaaatgttcttttgaatagagaaaagggaggctttggtgatagctctggagggcatctgtaatgattgcaatgaatttaa

SEQ ID NO: 24196 - DNA, 355 bp, Homo sapiens
  chr19.fa.O7frz.56941100
  Located on chromosome 19
  Distance between a terminus base of telomere on chromosomal short arm and 5'-terminus of this base sequence : 63409594
  Distance between 3'-terminus of neighbour sequence of sequence listing upward to telomere on chrosomal short arm and 5'-terminus of this base sequence : 108266
catagtctgttcataaggcagtctctgcactttatcttctacaaacacagattaggatcatctagctagtcctgctcaagtacacacacacacacacacacacacacacacacacacaccactcaccagcctcgcagacacacacactggtcacagtgtcacccagaatctctttcacacacatatcccaataccccccagtttctctctcccccgtgcccccactccctaacactctcatgcagaaatgagaaggatgcccaggacagagccacagccagtatctggagaatctccaggaaagaccctccctccccagttccttggtcctcactcctccatgagcagtctttga

SEQ ID NO: 24197 - DNA, 386 bp, Homo sapiens
  AC006132.1_32065
  Located on chromosome 19
  Distance between a terminus base of telomere on chromosomal short arm and 5'-terminus of this base sequence : 63691556
  Distance between 3'-terminus of neighbour sequence of sequence listing upward to telomere on chrosomal short arm and 5'-terminus of this base sequence : 281607
aatctactgcctttccatctctccctggactcctaacctgaagccctcacctcttcttaccagaaaggcctcattcttctctgggttctcacattgtgtatggtctctccaaagtccccattggccatcactgccacactggcggaggacgaaacctgcagccactgtggggaaagaagagagggaattaaggcacacagagaaagagataaatacagaaagacaaactgtgagacaataacagagagggagagagccgaagtggtgatgatgatgatgatgatgatgatgatgataaacccttatatggcatgttatttgtattaatttaatattcatactagcccatggaattagtaatatccttaacctagttctacatatgg

SEQ ID NO: 24198 - DNA, 443 bp, Homo sapiens
  chr19.fa.O7frz.58001127
  Located on chromosome 19
  Distance between a terminus base of telomere on chromosomal short arm and 5'-terminus of this base sequence : 63944524
  Distance between 3'-terminus of neighbour sequence of sequence listing upward to telomere on chrosomal short arm and 5'-terminus of this base sequence : 252582
ctctaactcctgagctcaagtcatcctcccatctcagcctcccgagtacctgggactacaggtgtgcaccaccaatacacacatacagatagatagatagatagatagatagatagatagatagatagatagatgatagatagatagattagtttgtttgtgatggagtcttgctctgttgcccaggctggagtgcagtggtgccatcttggctcactgcaacctctacctcccaagttcaagcgattctcctgcctcagactctcgagtagctgggactatgggcacatgccaccacacccggctaatttttgtatctttagtagagacagggtttcaccagaaaaaaaaaaaacttatttgctttatcttttcgctttcccctggtcctgccagcctgattccttttcccgaattaggactccacaactaatgtttatcga

SEQ ID NO: 24199 - DNA, 474 bp, Homo sapiens
  AC027709.2_22147
  Located on chromosome 19
  Distance between a terminus base of telomere on chromosomal short arm and 5'-terminus of this base sequence : 64047384
  Distance between 3'-terminus of neighbour sequence of sequence listing upward to telomere on chrosomal short arm and 5'-terminus of this base sequence : 102417
atttcaccgtgttagccaggatggtctcgatctcctgacctcgtgatccgcccgcctcggcctcccagagtgctgggattacaggcgtgagccaccgcacccggcccccattcattctgtttcttagcttctttttttgtttgtttgtttgtttgtttgttttttgagacggagtctcgctctgtccagcagtggcgcgaactcggctcactgcaagctccgcctcccgggttcacgccattctcctgtctcagcctcccgagtagctgggactacaggcgcccaccactatgaccggctaatttttttatttttagtagagacggggtttcaccatgttagccaggatggtctccatctcctgacctcgtgatccgcccgcctctgcctcccaaagtgctgggattacaggtgtgagccaccggccctttttcttagcttcttaggttggccttagcttcagtacaggtgcat

SEQ ID NO: 24200 - DNA, 301 bp, Homo sapiens
  AC024443.2_124947
  Located on chromosome 19
  Distance between a terminus base of telomere on chromosomal short arm and 5'-terminus of this base sequence : 64232786
  Distance between 3'-terminus of neighbour sequence of sequence listing upward to telomere on chrosomal short arm and 5'-terminus of this base sequence : 184928
ggtggaagttgcagtgaaccgagattgccccactgcactccagcctaggcgacagagcaagactccgtctcaataaataaataaataaataaataaataaataaacaaacaagacaaaacatttctcatccaaacccggacacccacgtgccaacgaatactgggtaaagtaatcataagatgatttgcggccgggcgcggtggctcacacctgtaatcccagcactttgagaggccgaggcaggcggatcacgaggtcaggagatggagaccatcctggctaagacggtgaaatcctgtc

SEQ ID NO: 24201 - DNA, 258 bp, Homo sapiens
  chr19.fa.O7frz.58672422
  Located on chromosome 19
  Distance between a terminus base of telomere on chromosomal short arm and 5'-terminus of this base sequence : 64424454
  Distance between 3'-terminus of neighbour sequence of sequence listing upward to telomere on chrosomal short arm and 5'-terminus of this base sequence : 191367
ctattagaatttcagcggactccacaaaatcagcaaagaaatagtgtgctgtcaatcaataccctttttgtccactagaggtcgcctgtctactttgagcagaggaaactaatctatatttttacatttagttgctgggagtttgcagacacttccagagatgtgggaggtaggagtgtggggatgagaggtggagacgtgtgtgtgtgtgtgtgtgtgtgtgtgtgcgcgtgtgtgtagtttagctattgcctttac

SEQ ID NO: 24202 - DNA, 455 bp, Homo sapiens
  AC073548.1_177543
  Located on chromosome 19
  Distance between a terminus base of telomere on chromosomal short arm and 5'-terminus of this base sequence : 64505176
  Distance between 3'-terminus of neighbour sequence of sequence listing upward to telomere on chrosomal short arm and 5'-terminus of this base sequence : 80464
tgcatactagaaacacctggagaatttaaaaaaaccccaggccctgccccctgcctctttaaattgagcttctaatgtaaaggttatttatttatttatttatttatttatttatttatttttgggacagagtctcactctgtcgcccaggctggagtgcagtggtgttatctcggctcactgcaacctccacctcccaggctcaagtggttctcctgccttggcctcccgagtagctgggaccacagatgggtgccaccaggcccagctaatttttgtaattttagtagagagggagtttcaccatgttgatcaggctggtcttgaacttctgacctcaggtgatctgcctgccttagcctcccaaagtgttgggattacaggcatgagccaccgcgcccggcctataaaggtttttaaatgagtattgggtgaactcatagacggcatcaagg

SEQ ID NO: 24203 - DNA, 148 bp, Homo sapiens
  chr19.fa.O7frz.60949412
  Located on chromosome 19
  Distance between a terminus base of telomere on chromosomal short arm and 5'-terminus of this base sequence : 64588225
  Distance between 3'-terminus of neighbour sequence of sequence listing upward to telomere on chrosomal short arm and 5'-terminus of this base sequence : 82594
atggataggtttaagagtggagggtgggcgtttgtgtgtgtgtgtgtgtgtgtgtgtgtttgtgtgtgtgtgtgtgtgtggtcacagggcctctggacattgccatcccccttcacctctgcacctgcctaattgtcattaaactatc

SEQ ID NO: 24204 - DNA, 345 bp, Homo sapiens
  AC073548.1_32894
  Located on chromosome 19
  Distance between a terminus base of telomere on chromosomal short arm and 5'-terminus of this base sequence : 64635524
  Distance between 3'-terminus of neighbour sequence of sequence listing upward to telomere on chrosomal short arm and 5'-terminus of this base sequence : 47151
acaactttgcctgagcaagaaataactttttttctctcttctccctccttccttcctttcttccttccttccttccttccttcctcccctccctccctctctctctctctttcttacttttctgagatggagtctcgctctgtcacccaggctggagtgcagtggcacgatctcggctcactgcaacctccactttccaggatcaagtgattctcctgccttaggctcctgagtaggtgggatcacaggtgcccaccaccatgcccggctaatttttgtatttttagtagagacagggtttcaccatgttggttaggctggtcttgaactcctgaccttaagtga

SEQ ID NO: 24205 - DNA, 250 bp, Homo sapiens
  AC010331.4_30159
  Located on chromosome 19
  Distance between a terminus base of telomere on chromosomal short arm and 5'-terminus of this base sequence : 64635524
  Distance between 3'-terminus of neighbour sequence of sequence listing upward to telomere on chrosomal short arm and 5'-terminus of this base sequence : -345
acaactttgcctgagcaagaaataactttttttctctcttctccctccttccttcctttcttccttccttccttccttccttcctcccctccctccctctctctctctctttcttacttttctgagatggagtctcgctctgtcacccaggctggagtgcagtggcacgatctcggctcactgcaacctccactttccaggatcaagtgattctcctgccttaggctcctgagtaggtgggatcacaggt

SEQ ID NO: 24206 - DNA, 178 bp, Homo sapiens
  D19S606
  Located on chromosome 19
  Distance between a terminus base of telomere on chromosomal short arm and 5'-terminus of this base sequence : 64666277
  Distance between 3'-terminus of neighbour sequence of sequence listing upward to telomere on chrosomal short arm and 5'-terminus of this base sequence : 30503
agggctgggacctcacctgcagccagggagacatcatacacacacacacacacacacacacacacacacacacacaccagggctacaggcacagcctcgtaccttttcgccatcactcactctcttgcccaccttctccagggcccccttctctcaaggaaggcagacagtgtgttgg

SEQ ID NO: 24207 - DNA, 350 bp, Homo sapiens
  AC010331.4_174537
  Located on chromosome 19
  Distance between a terminus base of telomere on chromosomal short arm and 5'-terminus of this base sequence : 64779136
  Distance between 3'-terminus of neighbour sequence of sequence listing upward to telomere on chrosomal short arm and 5'-terminus of this base sequence : 112681
ctgaagcaggagaattgcttgaacctgggaggtggaggttgcagtgagccaagatcacaccactgcactccagcttgggtgacagagactctgtctcataaataaataaataaataaataaataaataaataaataaataaaatacaacaaaatcacacaataaaatccaacatccctcgccacatcctgtaaatctggtctgtccaccctctggcctcacctccactctctgttcaggcttgctctcctccaagcacaccaacagagcaagttcctatatgctgttccctctttccagaagattcacctggcttcttccctcccctcctcagtctatgctcaattgtcc

SEQ ID NO: 24208 - DNA, 283 bp, Homo sapiens
  AC008985.6_36131
  Located on chromosome 19
  Distance between a terminus base of telomere on chromosomal short arm and 5'-terminus of this base sequence : 64868495
  Distance between 3'-terminus of neighbour sequence of sequence listing upward to telomere on chrosomal short arm and 5'-terminus of this base sequence : 89009
tttggagaaatgtttggaaagataaagaagtggatggatggatggatggatggaggcagggaagggagggatgttttggagggttggaggaatatttggaggggtgtttgaggggagggaaggctagatggatgggagggtggatgggtaaataaatacagagaacacctgcttcccctggtgtcagatgggactaacgatcccttccctatgggggtggaacaagctaacattgctgaagtgctcagacagtgcctggcacctagtgagcactcgacaaatg

SEQ ID NO: 24209 - DNA, 215 bp, Homo sapiens
  D19S902
  Located on chromosome 19
  Distance between a terminus base of telomere on chromosomal short arm and 5'-terminus of this base sequence : 65024747
  Distance between 3'-terminus of neighbour sequence of sequence listing upward to telomere on chrosomal short arm and 5'-terminus of this base sequence : 155969
ccatcctaatgagggcaatgaggaaccctcagagggttttcatgttctgtttgcttttttgaagattttattgttgtttttgcttttgacaagaacacacacacacacacacacacacacacacacacacacacacacacacaattaaaaagtaatccaaactatagagacaagatatggctttagcattccttcccagaggcagtcactggtgc

SEQ ID NO: 24210 - DNA, 470 bp, Homo sapiens
  AC011466.4_71753
  Located on chromosome 19
  Distance between a terminus base of telomere on chromosomal short arm and 5'-terminus of this base sequence : 65291063
  Distance between 3'-terminus of neighbour sequence of sequence listing upward to telomere on chrosomal short arm and 5'-terminus of this base sequence : 266101
cagtcaaggacatttaatcaagttctgattttactcactatgactgttttgtttttggtttttgttgtaattttttctggaaatgccccatttaaaaaaaattgtatgccccttgctttgctggtgcccaaaacacattctagttttttgtttgtttgtttgtttgtttgtttgttttgagacaagatctttctctgtcatccaggctggagtgcagtggggcgatcataactcactgcagccttgaactcccatgctgaagtgatccttccactgcctcagcctcctgagtagctgggaccacaggcacatgccacaatgcctggctaatttttaaatcttgtgtagagacacagtgttgctatgttgccgaggttggtctcaaactcccagtctcaagggatcctcccaggtcagcctcccaaagcaccatgtaatcccaaacacattctgaatctgcttattggaag

SEQ ID NO: 24211 - DNA, 405 bp, Homo sapiens
  AC011466.4_3949
  Located on chromosome 19
  Distance between a terminus base of telomere on chromosomal short arm and 5'-terminus of this base sequence : 65355881
  Distance between 3'-terminus of neighbour sequence of sequence listing upward to telomere on chrosomal short arm and 5'-terminus of this base sequence : 64348
taatcagctgaccttccgatagtgggattaccctggactatccaggtgggcctgatatagtcacaggggccttcaaagtggaagagggtggcaggagaggaaagtcagggtgagatgtggccacagaagaaaggcacagaaggaggcaatgccacttgcttatttatttatttatttatttattttttgagacagagtcttgctctgtcacccaggctggagtgcagtggcacgatcttggctcactgcaagctccgcctcccgggttcacgccattctcctgcctcatcctcccgagtagctgggactacaggcgcccgccaccacgcccagctaattttttgtatttttgatagagacatggtttcaccatgttagccaggatggtctcaatctccggacctt

SEQ ID NO: 24212 - DNA, 403 bp, Homo sapiens
  chr19.fa.O7frz.60536675
  Located on chromosome 19
  Distance between a terminus base of telomere on chromosomal short arm and 5'-terminus of this base sequence : 65498590
  Distance between 3'-terminus of neighbour sequence of sequence listing upward to telomere on chrosomal short arm and 5'-terminus of this base sequence : 142304
ataggacagatgaaggaatagatcctgaatggatgatggatataggacagttgaagggatagactctgaatggatggatggatataggataattggagagacagacgttgaatggatggatggatggatggatggatggatggatggatggatggatatgggacagttggagggatcaaccctagatggatggatggatgcattgatagatggatggatggatgggtgtaggacagttggagggacagatgatggatggatagatggacatgggacagttggagggatagaccctggttggaaagatggacagatatggggcaactgataagcaagtgaaccaggttgtccatgcaatgcctccaagccccgcgggctgatggtgtccttccaagtggagaag

SEQ ID NO: 24213 - DNA, 282 bp, Homo sapiens
  AC073131.5_120012
  Located on chromosome 19
  Distance between a terminus base of telomere on chromosomal short arm and 5'-terminus of this base sequence : 65598342
  Distance between 3'-terminus of neighbour sequence of sequence listing upward to telomere on chrosomal short arm and 5'-terminus of this base sequence : 99349
agaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagaaagaaagagagaaaagaaaacagagatgggtgggaaagttgtagatagctgggcaagaaagggtgacaatgagagttgtgacagtgatggcagtgaggagtggacaactggagctatctttgaacgtag

SEQ ID NO: 24214 - DNA, 440 bp, Homo sapiens
  chr19.fa.O7frz.60305864
  Located on chromosome 19
  Distance between a terminus base of telomere on chromosomal short arm and 5'-terminus of this base sequence : 65729494
  Distance between 3'-terminus of neighbour sequence of sequence listing upward to telomere on chrosomal short arm and 5'-terminus of this base sequence : 130870
gaaggtatttatcctcagtactcactgtttttaaatttctttgtgtgtgtgtgtgtgtgtgtgtgagagagagagagtctcactctcttgcccaggctgtagtacaacagctcaatctcaactcactgcaacctccatcttccaggctcaaatgatcctcccacttcagcctcccggaaagctgggggactacaggcgaccgccaccacgcccggctaattttttttttctttttttttttttttgagacggagtcttgctctgtcgcccaggctggagtgtagtggcgcgatctcgactcactgcaagctctgcctcccgggttcatgacattctcctgcctcagcctcccgaggtagctgggactacaggcgcccgccaccacgcccggctaattttttgtatttttagtagagacagggtttcaccatgttagccag

SEQ ID NO: 24215 - DNA, 301 bp, Homo sapiens
  AC008749.5_124745
  Located on chromosome 19
  Distance between a terminus base of telomere on chromosomal short arm and 5'-terminus of this base sequence : 66037374
  Distance between 3'-terminus of neighbour sequence of sequence listing upward to telomere on chrosomal short arm and 5'-terminus of this base sequence : 307440
ttccacgtcatttcagaaatacccccctcaccttatttatttatttatttatttatttatttatttatttatttatttatttatttattgaaacaaggtctgactctgtcgcccaggatggagggcagtggcgcgatctctgctcactgcaacctggaactcctggactcaagcgatcccccacctcagcctcccgagtatctgggattacaggtactcgctaccacgctcagctaatttttaaattttttgtagaaatggggttttgccatgttgcccaggctggtctcgagcttctgag

SEQ ID NO: 24216 - DNA, 419 bp, Homo sapiens
  AC024740.3_39412
  Located on chromosome 19
  Distance between a terminus base of telomere on chromosomal short arm and 5'-terminus of this base sequence : 66071291
  Distance between 3'-terminus of neighbour sequence of sequence listing upward to telomere on chrosomal short arm and 5'-terminus of this base sequence : 33616
caagccaggatcactagctcacacctgtaatccttgcactttgggaagccgaggagggaggattgcttgaacccaggtgtttgaggccagcatgggcagcttagcaagaccctttttctttctttctttctttctttctttctttctttctttctttcttttctttctctctctctctctctttctttcagatagggtatcactctgttgtctaggctggaatgcagtggtgcaatctcagctcattgcaacctccacttcccaggttcaagcaattctcctgcctcggcttcccgagtagctgggactacaggcatgtgcccccacaccaggataattttttttttttttttttttttttagtggagacagggtttcactatattagccaggctggtctcgaactcctgatctcacat

SEQ ID NO: 24217 - DNA, 358 bp, Homo sapiens
  AC024740.3_175165
  Located on chromosome 19
  Distance between a terminus base of telomere on chromosomal short arm and 5'-terminus of this base sequence : 66107675
  Distance between 3'-terminus of neighbour sequence of sequence listing upward to telomere on chrosomal short arm and 5'-terminus of this base sequence : 35965
cagaaacttccttgccaataccaacaataacaatgataatatcagctaacacttattgggcactgatcatgtgctaggcattgttctcaactctcatttaattcctatgaggtagttactattattgtctccattttacagataataattatagctgacacttaagtattgctttaccaagtaccaagtaccttaagtgttaaatattcattcattcattcattcattcattcactcattttcacgtatcacatataataattctcagagttacttaaggccgggcgcagtggctcatgcctgtaatcccagcactttgggaggctgaggcaggctgatcacctgaggttaggagttc

SEQ ID NO: 24218 - DNA, 363 bp, Homo sapiens
  AC008749.5_337644
  Located on chromosome 19
  Distance between a terminus base of telomere on chromosomal short arm and 5'-terminus of this base sequence : 66152635
  Distance between 3'-terminus of neighbour sequence of sequence listing upward to telomere on chrosomal short arm and 5'-terminus of this base sequence : 44602
agcacctaatctttagccttatttatttatttatttatttatttatttatgtatttagagacagctgagcctcgctctgtcgcccaggctgcagtgcagtggcgccatctcggccactgcaacctccacctcctgggttcaagcgattctcctgcctcagcctcccgagtagctgggactacaggcgtccgctattctgcctaatttttttgtattttagtagataccggttttcactatgttggccaggctggtgccggactcctgacctcaggtgatctgcccgccttggccttccaaagtgctaggattacaggcatgagccacagtgcccggcctgatccttacctttaaatttgcttc

SEQ ID NO: 24219 - DNA, 383 bp, Homo sapiens
  AC008749.5_172780
  Located on chromosome 19
  Distance between a terminus base of telomere on chromosomal short arm and 5'-terminus of this base sequence : 66208319
  Distance between 3'-terminus of neighbour sequence of sequence listing upward to telomere on chrosomal short arm and 5'-terminus of this base sequence : 55321
tcacttgaggtcaggagcttgagaccagcctgaccaacatagtgaaaccccatctttactaaaaatacaaaattagctgggcgtggtgtcgcatgcctgcaattccagctacttgggaggctgaggcaggagaattgcttgaacccggaggcagaggttgcagtaagccgagatcgtgccattgcactccatcctgggcaacaagagcaaaactccgtctcaaaataataataataataataataataataataataataatgtgtatacccatgtaaacaccattcagataaaaatatggcatatttggggcacccggggagtgtctcttgtggcccctcccctccataccctgctgatctatcagcacagattagtttctg

SEQ ID NO: 24220 - DNA, 253 bp, Homo sapiens
  D19S879
  Located on chromosome 19
  Distance between a terminus base of telomere on chromosomal short arm and 5'-terminus of this base sequence : 66313936
  Distance between 3'-terminus of neighbour sequence of sequence listing upward to telomere on chrosomal short arm and 5'-terminus of this base sequence : 105234
ctgagtgtgaacgaggcaacactgcctgctcccttagcgctcatgctgtaaataagtgtccttgttgtattctatttagtgctacgtttgtcacttttgttctttgagacagggtcttgctctgtcgcccaggctggagtgcagaggcacgatcatggcacactgcagcctcagtgcccaccacacacacacacacacacacacacacacacacacacacaccacccctgggactcaatcagtcctctggcct

SEQ ID NO: 24221 - DNA, 463 bp, Homo sapiens
  chr19.fa.O7frz.61620274
  Located on chromosome 19
  Distance between a terminus base of telomere on chromosomal short arm and 5'-terminus of this base sequence : 66412346
  Distance between 3'-terminus of neighbour sequence of sequence listing upward to telomere on chrosomal short arm and 5'-terminus of this base sequence : 98157
aaagttaaatggcaattctagaactagaaaacacaagtgaaattaagaattaagtaggtggtggccaggcatggtggctctgtaaactcaacactttgggaagccaaggtgggaggatcacttgagcccaggagatggagaccagcctgggcaacatcgcaaaagcctggtctctacaaaaaatacaaaaattagccaaacgtggtggcgtgcgcctatggtcccagataggaggctgaggtggaaggattacctgagcccagggaggtaaaggctgcagtgagccatgattgcacaactgctcttcagcctgggcaacaaagtgagaccctgtaacgacaacaacaacaaaacacacacacacacacacacacacacacacatatatatgtatatatagagagagaaatagcatgttacttagacacagaagcagctctcagactaaacatctgtaagttcc

SEQ ID NO: 24222 - DNA, 155 bp, Homo sapiens
  DISO7_00020743
  Located on chromosome 19
  Distance between a terminus base of telomere on chromosomal short arm and 5'-terminus of this base sequence : 66455880
  Distance between 3'-terminus of neighbour sequence of sequence listing upward to telomere on chrosomal short arm and 5'-terminus of this base sequence : 43071
gtccatactcagtggaggcctcctcttcctcctcctcctcctcctcctcctcttctccttcatcatcttccccatcatggcctcggtgtccatgcctgaggatatgatggtgatgctcactggacacaacttcatcctcatcctcgtcttgatgg

SEQ ID NO: 24223 - DNA, 400 bp, Homo sapiens
  AC011450.4_63418
  Located on chromosome 19
  Distance between a terminus base of telomere on chromosomal short arm and 5'-terminus of this base sequence : 66587457
  Distance between 3'-terminus of neighbour sequence of sequence listing upward to telomere on chrosomal short arm and 5'-terminus of this base sequence : 131422
gtttgcagtgagccaagaccgagacactgtactccagcctgggcaacagagcaaggctctgtcaaaaaagaaagaaagaaagagagagagagagagagagagagagagagagagggaaacacactaagagagaaataaaatattttttctttctttctttgagatggtaagcccctacttttcaatccccctctcccaagttccacctccaaaactggaccggggatggtggggaggtaggtgggaggggccttgaggcagaagggaggatgagtgccctggttcccaaaagggaggaggttgaagacccagactatttgatgagaaggaggagcccaccgccttctctctcccatccccacattacccgattcaatagtgcaagtcttcaagcagatag

SEQ ID NO: 24224 - DNA, 145 bp, Homo sapiens
  HUMUT2523
  Located on chromosome 19
  Distance between a terminus base of telomere on chromosomal short arm and 5'-terminus of this base sequence : 66656220
  Distance between 3'-terminus of neighbour sequence of sequence listing upward to telomere on chrosomal short arm and 5'-terminus of this base sequence : 68363
gttgcagtgagccgagatcgcaccactgtactccatccagcctgggcaacggagcaagactccatgtcaataaatacatacatacatgcatacatacatacatacatacatacataaatggggggacacaggagctagaaggtgg

SEQ ID NO: 24225 - DNA, 137 bp, Homo sapiens
  D19S604
  Located on chromosome 19
  Distance between a terminus base of telomere on chromosomal short arm and 5'-terminus of this base sequence : 66694892
  Distance between 3'-terminus of neighbour sequence of sequence listing upward to telomere on chrosomal short arm and 5'-terminus of this base sequence : 38527
atgtcatggagcatttgttgagcacctgccatctgcaggtgttgtggctacaacagtagacaaatagaccccaggacgtgtgtgtgtgtgtgtgtgtgtgtgtgtgtgtgtgtgtacatgcgtgtgcttcacataca

SEQ ID NO: 24226 - DNA, 190 bp, Homo sapiens
  DISO7_10000188
  Located on chromosome 19
  Distance between a terminus base of telomere on chromosomal short arm and 5'-terminus of this base sequence : 66713107
  Distance between 3'-terminus of neighbour sequence of sequence listing upward to telomere on chrosomal short arm and 5'-terminus of this base sequence : 18078
tgtcaggtcagagattggggaagatattgaaggaaaactgatacttgagtggaaggaaggaaggaaggaaggatggaaggagggagggagggaaggagggaaggaaggaaggaaggaaggaaggaaggaaggaaggaaggaaggaaggaaggaaagaaggaagccagcctttgaggcactagcacagcct

SEQ ID NO: 24227 - DNA, 101 bp, Homo sapiens
  DISO7_10000020
  Located on chromosome 19
  Distance between a terminus base of telomere on chromosomal short arm and 5'-terminus of this base sequence : 66961849
  Distance between 3'-terminus of neighbour sequence of sequence listing upward to telomere on chrosomal short arm and 5'-terminus of this base sequence : 248552
gaaccataggcctagggctgctgggagttgtagttttacacacacacacacacacacacacacacacacacacacacacaccccctgctgtaactgaacca

SEQ ID NO: 24228 - DNA, 187 bp, Homo sapiens
  chr19.fa.O7frz.63199405
  Located on chromosome 19
  Distance between a terminus base of telomere on chromosomal short arm and 5'-terminus of this base sequence : 67255502
  Distance between 3'-terminus of neighbour sequence of sequence listing upward to telomere on chrosomal short arm and 5'-terminus of this base sequence : 293552
ctctgccttctagatagcaatagcaaaattagtgaaagtactaaaagtctgatatgcagaaataatggcataagctgtctctctctctttctcctctctctctctgccttggctgccaggcagggaagggccccctgtccagtggacacgtgacccatgtgaccttacctatcactggagatgactc

SEQ ID NO: 24229 - DNA, 215 bp, Homo sapiens
  D19S866
  Located on chromosome 19
  Distance between a terminus base of telomere on chromosomal short arm and 5'-terminus of this base sequence : 67588267
  Distance between 3'-terminus of neighbour sequence of sequence listing upward to telomere on chrosomal short arm and 5'-terminus of this base sequence : 332578
catgagtttgactatgaagacataaatgaaggttctattcctatatatatatacacatatatatatacacacatatatatatacacacatatatatatacacactacacacacacacacacacacacacacacacacacacacacacacacacatatatatatgtatttttttttatttgagacagagtctccctctgttacccaggctggagtg

SEQ ID NO: 24230 - DNA, 219 bp, Homo sapiens
  AC073646.5_39897
  Located on chromosome 19
  Distance between a terminus base of telomere on chromosomal short arm and 5'-terminus of this base sequence : 67806814
  Distance between 3'-terminus of neighbour sequence of sequence listing upward to telomere on chrosomal short arm and 5'-terminus of this base sequence : 218332
aaatctcacaaatcactaccaaacagcttactcatgtaaccaaacaccacctgtttcccaataacctgtggaaataaaataaataaataaataaataaataaataaataaataaatgaaaagaaatactctgcggaccaggcatggtggctcacacctgtaatcccagcactttgggaggctgaggcgggtggatcacttaaggtcaggaattcgagac

SEQ ID NO: 24231 - DNA, 406 bp, Homo sapiens
  chr19.fa.O7frz.63753376
  Located on chromosome 19
  Distance between a terminus base of telomere on chromosomal short arm and 5'-terminus of this base sequence : 67810654
  Distance between 3'-terminus of neighbour sequence of sequence listing upward to telomere on chrosomal short arm and 5'-terminus of this base sequence : 3621
tctattccttggtccatctatccaggtatccactcatccacccagtccatccatccatccatccatccatccatccatccatccatccatccatctgcttaaccatccatccactcatgcatccatccatccactcatccatccatccatccatccatccacttaaccatccatccatctacttaaccatctgtccatccattcatccatccatccatccatccatccatccatccatccatccatccatcccattgacccattcatccatctactcattcatatatccactcttccatttaggttgccatctagccatccatcgacctatcaatccagagatctatccatccactcactcactcacctgcatacttgcccaccatctacctatccattcatccat

SEQ ID NO: 24232 - DNA, 440 bp, Homo sapiens
  AC020909.4_102225
  Located on chromosome 19
  Distance between a terminus base of telomere on chromosomal short arm and 5'-terminus of this base sequence : 67910743
  Distance between 3'-terminus of neighbour sequence of sequence listing upward to telomere on chrosomal short arm and 5'-terminus of this base sequence : 99683
tccaaactttgacaccaaatcccacttggtggcaaaacccgatcagaactcatgtgaagctattttatttattatttatttatttatttatttatttatttattttgagatggagtctcgctctgtcgcccagcctggagtgcagaggcgtgatctcggctcactgcaacctctgcctgccgggttcaagtgattctcctgcctcagcctcacaagtagctgggattacaggcacgcatcaacacgcttggctaattttttgtatttttagtagagacagggttttgccatgttggccaggctggtctcgaactcctggcctcaggtgatccacccgccttggccttccaaagtgctgggattaccggcgtgagccacctcacccagccacatgaaagtaaagcttttattgatcccactcgtgactatccaaacatttc

SEQ ID NO: 24233 - DNA, 215 bp, Homo sapiens
  D19S907
  Located on chromosome 19
  Distance between a terminus base of telomere on chromosomal short arm and 5'-terminus of this base sequence : 67946427
  Distance between 3'-terminus of neighbour sequence of sequence listing upward to telomere on chrosomal short arm and 5'-terminus of this base sequence : 35244
gtgtccaatcaacagaacactattaggagttaagttttaggggagtcaaaagttacaggcagattttcaactgcacagggggctggcacccctagcccccaagttggtcaggggtcaactgtatacatacacacacacacacacacacacacacatacacacacacatacatacatacacacacacacatcacacaaatttctgctggagtgcag

SEQ ID NO: 24234 - DNA, 341 bp, Homo sapiens
  AC010325.4_78873
  Located on chromosome 19
  Distance between a terminus base of telomere on chromosomal short arm and 5'-terminus of this base sequence : 68096126
  Distance between 3'-terminus of neighbour sequence of sequence listing upward to telomere on chrosomal short arm and 5'-terminus of this base sequence : 149484
ctagactgttaactcctgccatgtgtacttttgcgtgtttttcttttcttttcttttcttttcttttcttttcttttcttttcttttcttttcttttcttttcttttcttttcttttcttttcttttgagatggagtctcactctgttacccaggctggagtgcaatggcgcgatctcagctcactacaacctctgcttcctgagttcaggcaattctctgcctcagcctcccaagtagctgggattacaggtgcccgccaccatgcctggctaatttttgtctttttagtagagacagggtttcaccatcttggccagacttgtcttgaactcctgacct

SEQ ID NO: 24235 - DNA, 430 bp, Homo sapiens
  chr19.fa.O7frz.65385639
  Located on chromosome 19
  Distance between a terminus base of telomere on chromosomal short arm and 5'-terminus of this base sequence : 68156086
  Distance between 3'-terminus of neighbour sequence of sequence listing upward to telomere on chrosomal short arm and 5'-terminus of this base sequence : 59619
cctcagataatgagaattgttaacaagttccttcctttccctccttccttccctccttccttccttccttccttccttccttccttccttccttccttccttctttccttccttccttccttcctccctttcctccttcctttctttaaatagagatgggttctcaccatgttgcccaggctggtctcaaacccatcctgggctcaagtgatcctcctgccttggcctcccaaagtgctgggattacaggcatgagccaccgtgcccacctaagtctttcttttgagggctttctctctgccttttatttctcttcacgtattcattcacgcaccaggcacaggtggagccccgccatgcacgcccgcatctgtgcgtgttccacagtgtgcaccattcctgggctccctcatgcatttcacctaacagc

SEQ ID NO: 24236 - DNA, 298 bp, Homo sapiens
  AC010325.4_107556
  Located on chromosome 19
  Distance between a terminus base of telomere on chromosomal short arm and 5'-terminus of this base sequence : 68181560
  Distance between 3'-terminus of neighbour sequence of sequence listing upward to telomere on chrosomal short arm and 5'-terminus of this base sequence : 25044
agcctaggcaatagagtgagactctgtctcaaaacaaaacaaaacaaaacaaaaagaggtggcaaaaaggggctgaaagttctgggccacctcctctgggtgaggaatgttctcatgccatatgcgtgaactgtgcctgatcagaggtatttgactgtcttcatcactgcggtatccccagcgcttaggatagtgtatggcgtacgatttgggctcaatgcataattttacactaaatgaatgaatccatcctcagatgacaaaggagagattgtcctccttaatgatcactcatcca

SEQ ID NO: 24237 - DNA, 289 bp, Homo sapiens
  AF149289.1_4120
  Located on chromosome 19
  Distance between a terminus base of telomere on chromosomal short arm and 5'-terminus of this base sequence : 68384787
  Distance between 3'-terminus of neighbour sequence of sequence listing upward to telomere on chrosomal short arm and 5'-terminus of this base sequence : 202929
tcaacatgaactccagtcaagattggtcaggtgcagtggcttatgcctgtaatcccagctgaggcaggaggatcgcttgagcccaggagtttgagaccagcctcggtaacacagtgagacctcatctccacacacacacacacacacacacacacacacacacacacaaattagcagggtatggtggcatacgcctgtagtcccagctacttgggaggctgaggtgggagggtcacttgagacccaagagttcaagtctgcagtgaactatggatcatgccactacact

SEQ ID NO: 24238 - DNA, 381 bp, Homo sapiens
  AF135024.2_4066
  Located on chromosome 19
  Distance between a terminus base of telomere on chromosomal short arm and 5'-terminus of this base sequence : 68478459
  Distance between 3'-terminus of neighbour sequence of sequence listing upward to telomere on chrosomal short arm and 5'-terminus of this base sequence : 93383
ctatccattcatccatttaggtagtcatctaaccatctatccatccatccatccatccatccatccaaccatccatccactcatctgtccctccatccactggtccatttattcatccatccatccatccatccatccatccatccatccatccatccatccaatccaaccatccatccatccatctatccatatatccatccatgcatccatccaatcatctttccacccatctctctatcctttcactgcatatatactggttgcctccatggctttaaataccagctataggctaatcatctccagccctgaactcttctttaagctcaaaactcaaacactgttgatttggatgccttacaggcatcttaagctttg

SEQ ID NO: 24239 - DNA, 191 bp, Homo sapiens
  DISD22_0011767
  Located on chromosome 19
  Distance between a terminus base of telomere on chromosomal short arm and 5'-terminus of this base sequence : 68789247
  Distance between 3'-terminus of neighbour sequence of sequence listing upward to telomere on chrosomal short arm and 5'-terminus of this base sequence : 310407
ctaatattcctgaccctcggtttgctcctttatcaactgtaaagtctagtctctcactttcagaagtgtgtgtgtgtgtgtgtgacagagagaaagagagagagagagagagagagagagagagagagagagagagagagagactggtataaagcaaggtatttaaagagcagtacagagatcagtaaaca

SEQ ID NO: 24240 - DNA, 224 bp, Homo sapiens
  chr19.fa.O7frz.64582076
  Located on chromosome 19
  Distance between a terminus base of telomere on chromosomal short arm and 5'-terminus of this base sequence : 68972714
  Distance between 3'-terminus of neighbour sequence of sequence listing upward to telomere on chrosomal short arm and 5'-terminus of this base sequence : 183276
gtgttactgagttgccaaatacctattaaaatgttagatacacgcacatacccagaaacatacacacagccggacacacatacacacacacacacacacacacacacacacacacacacacacgaatacactctgagcacagcatttgttatgttttgaataaatgactaactaaacatccattactactactcccaataaaaacacttattgcagctggtcac

SEQ ID NO: 24241 - DNA, 136 bp, Homo sapiens
  DISO7_10004459
  Located on chromosome 19
  Distance between a terminus base of telomere on chromosomal short arm and 5'-terminus of this base sequence : 69163050
  Distance between 3'-terminus of neighbour sequence of sequence listing upward to telomere on chrosomal short arm and 5'-terminus of this base sequence : 190112
ttagcctacagatcctgaagcatatatacataatatatatattatatatatgatatatgacatatatatatatatgtaatcttttaggattgggcacaaagctaaagactgaaaaggaccatgagtcttgttcttt

SEQ ID NO: 24242 - DNA, 392 bp, Homo sapiens
  AC018755.3_56421
  Located on chromosome 19
  Distance between a terminus base of telomere on chromosomal short arm and 5'-terminus of this base sequence : 69239698
  Distance between 3'-terminus of neighbour sequence of sequence listing upward to telomere on chrosomal short arm and 5'-terminus of this base sequence : 76512
ctatgccgttcctgaagatggtgatggtctgtggagcatctgggataaaaagatataaacttggcttcagcagtgaggagtgagatgggcatgggcccaggaggtacccaaagaggagccacagaaacccaccaagcggggaaggctgtcctgtctcactccccgcagatcccaaggcttagatccacacacaaggtttctcaagttattgttttgtttctctctgtcttccttacacacacacacacacacacacacacacacacacccctcactcccactgcccttgaggactcagctgtgtccccagcaccactcacaggagacattgagctggacagttctctccgtggtcacctgagctccttggcgtttcatctgacaggtgaggt

SEQ ID NO: 24243 - DNA, 309 bp, Homo sapiens
  AC018755.3_114408
  Located on chromosome 19
  Distance between a terminus base of telomere on chromosomal short arm and 5'-terminus of this base sequence : 69297701
  Distance between 3'-terminus of neighbour sequence of sequence listing upward to telomere on chrosomal short arm and 5'-terminus of this base sequence : 57611
cacttgaggtcagaagttcaagaccagtccagcaaacgtggcaaaaccccatctctacagaatacacaaaaattagccgggcctggtggcgcaggcctgtagttccaaccacgtgggaggctgaggtgggagaatggcttgaacctggaaggcagaggttgcagtgatctgagataatgccactgcactccagcctgggcaatccgtctcaaaaataaatacatacatacatacatacatacatacatacatacatacatacataagcaaatctgtaaatatcaatatgcataaccattagtttcttga

SEQ ID NO: 24244 - DNA, 280 bp, Homo sapiens
  AC018755.3_168491
  Located on chromosome 19
  Distance between a terminus base of telomere on chromosomal short arm and 5'-terminus of this base sequence : 69351849
  Distance between 3'-terminus of neighbour sequence of sequence listing upward to telomere on chrosomal short arm and 5'-terminus of this base sequence : 53839
tggtttaataaaggacagatgaactctcttttcttctgtatccaaaccattgcaataattttgttttttgttttttgtttttgtttgtttgttttgaggcagggtctcactctgtcacccaggctgggcaacatcgtgagatcccatctctgcaaataaataaataaataaataaataaataaattagttgggcatggtggcatgcacctgtagtcctaactacctgggaggctgaggtgggagtttgaagctgcagtgagctatgatcataccactgca

SEQ ID NO: 24245 - DNA, 383 bp, Homo sapiens
  AC005946.1_22365
  Located on chromosome 19
  Distance between a terminus base of telomere on chromosomal short arm and 5'-terminus of this base sequence : 69423560
  Distance between 3'-terminus of neighbour sequence of sequence listing upward to telomere on chrosomal short arm and 5'-terminus of this base sequence : 71431
cacctgaggttacaagtttgagaccagcctggccaacatggtgaaactctgtctctacccaaaaatacaaaaattagcaggcatggtggtgaacctgtagttctagctactggggaggctgaggtaagggaattggttgaaccctggagatggaggttgcaatgggccgagatcacgccactgcactccagcatgggtgacagagtgatgctctgtctcaacacacacacacacacacacacacacacacacacacacacaccccataaatttattgatcacagttctgggggctgtaaagtccaagatcaaggtgctagcagatgcagtatctggtgagggccattactcacagacagtgctttctatgagtcctcacatgg

SEQ ID NO: 24246 - DNA, 427 bp, Homo sapiens
  AC006272.1_36715
  Located on chromosome 19
  Distance between a terminus base of telomere on chromosomal short arm and 5'-terminus of this base sequence : 69465728
  Distance between 3'-terminus of neighbour sequence of sequence listing upward to telomere on chrosomal short arm and 5'-terminus of this base sequence : 41785
tttcagttgacaacctcatttcctgaatatggactatacttttctgattgtgtgtcacaaatttttgttgaatatagaaattttagatcatataaagttgttactttggaaatcagattccctctctccccagggtttattgttgcgattgttgttgcagtttgttcagtggcattcctggagtaatttatgtattccctgcagtgtgcagtcacttgaagtcttttcttagttagctaatgattaatcaagatttccttcatttctctgagcaagttttccactctttgctgagggtgctgtgtgtgtgtgtgtgtgtgtgtgtgtgtgtgtgtgtgtgtctacttcaatgctcaagcagtttgtaagtctactttagccttctcttccttcttctcaagggcttcaagatcagctagaagtgaac

SEQ ID NO: 24247 - DNA, 253 bp, Homo sapiens
  HUMUT963
  Located on chromosome 19
  Distance between a terminus base of telomere on chromosomal short arm and 5'-terminus of this base sequence : 69560779
  Distance between 3'-terminus of neighbour sequence of sequence listing upward to telomere on chrosomal short arm and 5'-terminus of this base sequence : 94624
ctcacagttttcacaattgcaatactttgggtaaatatttgatttcatcacttaaattctcatcacaaacatacatacatgtatgtatatatagtatatatatctatatttctgtctctatatacatctgtctatgtatgtatgtatgtatctatctatctatctatctatctatctatctatctatctatctatctatctttctatacagagagagtcagtcttgccctgtctcccaggctggagtacaatg

SEQ ID NO: 24248 - DNA, 351 bp, Homo sapiens
  AC011468.4_10433
  Located on chromosome 19
  Distance between a terminus base of telomere on chromosomal short arm and 5'-terminus of this base sequence : 69712905
  Distance between 3'-terminus of neighbour sequence of sequence listing upward to telomere on chrosomal short arm and 5'-terminus of this base sequence : 151873
gttgttcttgacttcacctgatgacatccctaatacagtatcagaaagtatgccttccttgtgcagtaagcacctttctccagctacttctatttatttatttatttatttatttatttatttatttatttatttatttttaagacaggctctgttgcccaggctggagtgcagtggcactatctcggctcactgcaaccttcacctcccagattcaagtgatcctcctgcctcagcctccagagtacccagctacttcattcccacaaaaatttaccatccaaaggattattataaatctatatttagttttgtttttagaaaatactatggactggtagaagtctcaaa

SEQ ID NO: 24249 - DNA, 326 bp, Homo sapiens
  AC021112.3_5030
  Located on chromosome 19
  Distance between a terminus base of telomere on chromosomal short arm and 5'-terminus of this base sequence : 70091341
  Distance between 3'-terminus of neighbour sequence of sequence listing upward to telomere on chrosomal short arm and 5'-terminus of this base sequence : 378085
aggtcaggagttcaagacgagcgtggccaagatggtgaaaccccgtctctaccaaaaataacaaaaattagccgggcatggtggcacttgcctataatcccagctactcgggtggctgaggcagagagttgcttgaacctgggaggcagaggttgcaatgagccgtgatcacgccaccgcaccccagtctgggtgacagagtgagactccatctcaaaagataataataataataataataataataataataataataataataatttggcaccaaataaatatgagtagcatcctttggcctatgaaatagagtcaggatttgc

SEQ ID NO: 24250 - DNA, 398 bp, Homo sapiens
  AC021848.4_137247
  Located on chromosome 19
  Distance between a terminus base of telomere on chromosomal short arm and 5'-terminus of this base sequence : 70178817
  Distance between 3'-terminus of neighbour sequence of sequence listing upward to telomere on chrosomal short arm and 5'-terminus of this base sequence : 87150
acgtcaggaattagaaaccagcctggccaacatggggaaaccccgtctctactgaaaatacaaagccattagccgggcatggtggcgcacgcctgtattttcagctatttgggaggctgaggcaggagaactgcttgaacccaggacgtggaggtcgtagtgagccgagatcacatcactgcattccagcctgggcgacagagcaggacgccttcccaaaacaaaacaaaacaaaacaaaatgtgctatacaatttagtttcctaatatcaattttaaaaagttttcgtgtaaataattaggaaaactaagcagccccagagataagacctcctggcatcattgtcccttcttatggagtgataatgtaaccttccttgaagtgtatcactccatcac

SEQ ID NO: 24251 - DNA, 240 bp, Homo sapiens
  AC022150.5_89436
  Located on chromosome 19
  Distance between a terminus base of telomere on chromosomal short arm and 5'-terminus of this base sequence : 70190343
  Distance between 3'-terminus of neighbour sequence of sequence listing upward to telomere on chrosomal short arm and 5'-terminus of this base sequence : 11128
agttaacatggtgaaacttcgtctctagtaaaattacaaaaattatccaggcacggtcgtgggtggcagtaatcccagctactcaggaggctgaggcacgagagttgcttgaacccgggaggtagaggttgcagtgagctgagatcgcaccgtcgcactccagcatgggagacagagtgagactccatctcaaaataaataaataaataaataaataaataaagtttcataacctgcaaa

SEQ ID NO: 24252 - DNA, 321 bp, Homo sapiens
  chr19.fa.O7frz.66644756
  Located on chromosome 19
  Distance between a terminus base of telomere on chromosomal short arm and 5'-terminus of this base sequence : 70293750
  Distance between 3'-terminus of neighbour sequence of sequence listing upward to telomere on chrosomal short arm and 5'-terminus of this base sequence : 103167
aaactcctgacttcaagtgatccacccgccttggcctcccaaagtgctggcattacaggggtgagccaccacagccagccccacatttacattatggcatcttgacttgatcctcagctcctcagctgccctgtgactctgtgtgtgtgtgtgtgtgtgtgtgtgtgtgtgtgtgtgtgtgtgtgtgtgtgtatgctcacgtgttgtgacaggcaaggaaaagccagtagagcatcatcgccactggcctggcaggaggaggtggccctcgggctgcagttcactgtgctgtttgcactctgattcttggaagaatctttc

SEQ ID NO: 24253 - DNA, 413 bp, Homo sapiens
  chr19.fa.O7frz.66730957
  Located on chromosome 19
  Distance between a terminus base of telomere on chromosomal short arm and 5'-terminus of this base sequence : 70379763
  Distance between 3'-terminus of neighbour sequence of sequence listing upward to telomere on chrosomal short arm and 5'-terminus of this base sequence : 85692
atggtctagtggtagcatcagtgccaaggaacaacacccgccacttagcagaccgggaaagggagtctccctttccccgggggagtttagagaacactctcctccaccacctcttgcggagggcctgacatcagtcaggcccacctgcagttatccggaggcctaaccgtctccctgtgatgctgtgcttcagtggtcacgctcctagtccaccttcgtgttccgtcctgtacacctggctctgccttctagataacagtagcaaaatgagtgaaagtactaaaagtgtctgatatgcagaaataatggcgcaagctatctctctctctccctctctctgcctcggctgccaggaagggaagggccccctgtctagtggacaggtgacccacgtgaccttacctatcactgga

SEQ ID NO: 24254 - DNA, 228 bp, Homo sapiens
  D19S571
  Located on chromosome 19
  Distance between a terminus base of telomere on chromosomal short arm and 5'-terminus of this base sequence : 70404379
  Distance between 3'-terminus of neighbour sequence of sequence listing upward to telomere on chrosomal short arm and 5'-terminus of this base sequence : 24203
attgagccactgaactccagcctgggtgagaagagccaaactctgccacacacacacacacacacacacacacacacacacacacacacacacacacacaaaagtgatgtatcttctcagtcatttcatgtatacgtgtaactttctctttatattataaattacaacatttacaaataaaggaatttatctcccatatttcaaaaacatgctgtcaagtttggctaa

SEQ ID NO: 24255 - DNA, 259 bp, Homo sapiens
  chr19.fa.O7frz.67379239
  Located on chromosome 19
  Distance between a terminus base of telomere on chromosomal short arm and 5'-terminus of this base sequence : 70547738
  Distance between 3'-terminus of neighbour sequence of sequence listing upward to telomere on chrosomal short arm and 5'-terminus of this base sequence : 143131
cacatttacattatagcatcttgaccttcggctccccagctgccttgtgactcggtgtgtgtgtgtgtgtgtgtgtgtgtgtgcatgctcgcgtgttgtgacaggcaagaaaaagccactagagcatcatcgccactggcctggtaggaggaggttgcccttgggctgcagttcactgtgctgtttgcactcttgatccttggaagaatcttcctgaagtcacggagcctccagctcctctggaacagaactagttgtg

SEQ ID NO: 24256 - DNA, 122 bp, Homo sapiens
  D19S888
  Located on chromosome 19
  Distance between a terminus base of telomere on chromosomal short arm and 5'-terminus of this base sequence : 70832935
  Distance between 3'-terminus of neighbour sequence of sequence listing upward to telomere on chrosomal short arm and 5'-terminus of this base sequence : 284938
tagcctgggcaacagagtgagaccctgtctcaaaaacaaaaaacaaacacacacacacacacacacacacacacacacacacacacagaataaagtctttttttcttctacgctccatcttt

SEQ ID NO: 24257 - DNA, 372 bp, Homo sapiens
  chr19.fa.O7frz.67781016
  Located on chromosome 19
  Distance between a terminus base of telomere on chromosomal short arm and 5'-terminus of this base sequence : 70845622
  Distance between 3'-terminus of neighbour sequence of sequence listing upward to telomere on chrosomal short arm and 5'-terminus of this base sequence : 12565
ctcatgcttataatttcagcattttgggaggctgaggcaggcagatcacctgaagtcgggagttcaagacttgcctgaccaacatggagaaatcccgtttctactaaaaaagaaaaaatacaaaaatcatccaggcgttgtggcacatgcctgtaatcccagctacctgggaggctgtggaaggagaattgcttgaagcagggaggcggaggttgtggtgagctgagattgtgccattacactccagcatgggcaacaagagtgaaactccatcccaaaataaaataaaataaaataaaataaaataaaataaaataaataaaataaaataaaaatcaatgtagggttctcgttacagaaatgttagaaact

SEQ ID NO: 24258 - DNA, 228 bp, Homo sapiens
  D19S921
  Located on chromosome 19
  Distance between a terminus base of telomere on chromosomal short arm and 5'-terminus of this base sequence : 70922912
  Distance between 3'-terminus of neighbour sequence of sequence listing upward to telomere on chrosomal short arm and 5'-terminus of this base sequence : 76918
caagactgaaatataatgacaaggaataaaaacaaaggggtgtgtgtgtgtatgtgtgtgtgtgtgtgtgtgtgtgtgtgtgtgtgtgtcttattcaaagaacacagctatctagctttgttagtcaactataacggctaaatgcactgtctttgcaataaaaccaggcaggttcaagttcgcattttgcctgtaagtagggtggaaatgttgccagccacttcacct

SEQ ID NO: 24259 - DNA, 396 bp, Homo sapiens
  chr19.fa.O7frz.67853295
  Located on chromosome 19
  Distance between a terminus base of telomere on chromosomal short arm and 5'-terminus of this base sequence : 71082721
  Distance between 3'-terminus of neighbour sequence of sequence listing upward to telomere on chrosomal short arm and 5'-terminus of this base sequence : 159581
cacaagtcctattcacgagtagtcaacacccatgaccaaattgtctcaaaggccccatctgcagaacatccttttggagaataagaactctgaacatggcttttggccaatatgaacattcagaccagggaggctgcatcatattgtttgtgtttttattgtatgatttgatttataaaatgttttcactgatctcagtttaaaaattttcccagtacacattctatgttttatattttgtgcatagtgaactagataattaataccaactatatatatatatatatatatatatatatatatatatatatatatataaaattgctgtattgcctggctgtttcataaatgtagttgtgacatcataattgcaccctctgacaccgttagtcaatt

SEQ ID NO: 24260 - DNA, 440 bp, Homo sapiens
  chr19.fa.O7frz.67968693
  Located on chromosome 19
  Distance between a terminus base of telomere on chromosomal short arm and 5'-terminus of this base sequence : 71198061
  Distance between 3'-terminus of neighbour sequence of sequence listing upward to telomere on chrosomal short arm and 5'-terminus of this base sequence : 114944
ctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctg

SEQ ID NO: 24261 - DNA, 413 bp, Homo sapiens
  AC011487.4_65278
  Located on chromosome 19
  Distance between a terminus base of telomere on chromosomal short arm and 5'-terminus of this base sequence : 71269760
  Distance between 3'-terminus of neighbour sequence of sequence listing upward to telomere on chrosomal short arm and 5'-terminus of this base sequence : 71259
ctaccaaagtgcaaagattacaggcgtgagccactgtgcctggtctttggcaggttttgttttgttttgttttgttttgttttgttttgttttgagacagagtctcgctctgccacccaggctggagtgcagtggcatgatctcagcttactgcaagctccacctcccgggttcacgccattctcctgcctcagcctcctgagtagctgggactacaggcgcccgccaccatgcccggttaattttttgtatttttagtagagacgggatttcaccgtgttagccaggatggtctagatctcctgacctggtgatccgcccgcctcggcctcccaaagtgctgggattacaggcgtgagccaccgcgcccggcctggcaggttttatattggactgtgcagttcaacctacag

SEQ ID NO: 24262 - DNA, 132 bp, Homo sapiens
  D19S572
  Located on chromosome 19
  Distance between a terminus base of telomere on chromosomal short arm and 5'-terminus of this base sequence : 71279299
  Distance between 3'-terminus of neighbour sequence of sequence listing upward to telomere on chrosomal short arm and 5'-terminus of this base sequence : 9126
gggccacatcctatcccccaaaccatatatatgggtatgggtgtgtgtgtgtgtgtgtgtgtgtgtgtgtgtgtgtgtgtgtgtgccagcctcccaagtagggactacaggcacgtgtcagcacacccaaat

SEQ ID NO: 24263 - DNA, 191 bp, Homo sapiens
  AC011453.4_105946
  Located on chromosome 19
  Distance between a terminus base of telomere on chromosomal short arm and 5'-terminus of this base sequence : 71336628
  Distance between 3'-terminus of neighbour sequence of sequence listing upward to telomere on chrosomal short arm and 5'-terminus of this base sequence : 57197
cttctgaagtcatttaaatggaactgaattatatgaagtcaaatgtcagttggggaaaaagtcaaactttattatttatttatttatttgtaattgtgcgtatacatatatatatatatatatatatatatatatatatatatatatataattttttttaaattatgatctccgtgatagtaccaaatcaa

SEQ ID NO: 24264 - DNA, 402 bp, Homo sapiens
  AC011453.4_81655
  Located on chromosome 19
  Distance between a terminus base of telomere on chromosomal short arm and 5'-terminus of this base sequence : 71360838
  Distance between 3'-terminus of neighbour sequence of sequence listing upward to telomere on chrosomal short arm and 5'-terminus of this base sequence : 24019
ggcacttaggtggagaaattactcttcgtgtgagcattcagtatatagaacttccttttctgggggcagtgtcttatatatgatacacattttatcatatcatcttctatagataatataatgattaacacaaaacactcttctacacacacagaatactcttgtatcactttgggttttttttccttcgtgtgtgtgtgtgtgtgtgtgtgtgtgtgtgtgtgtgtgtgttatgagacaaggtctggctctgtcacccaggctgcagtgcagtgttgcagtcttggcccatgccccaccgcagcctctggaatagctgtctgcaggccaggcacggtagctcaggcatgtcgtctcagcactcttggagaccaaagcaggctaatcacctggagtcaggag

SEQ ID NO: 24265 - DNA, 200 bp, Homo sapiens
  AC011453.4_75527
  Located on chromosome 19
  Distance between a terminus base of telomere on chromosomal short arm and 5'-terminus of this base sequence : 71367129
  Distance between 3'-terminus of neighbour sequence of sequence listing upward to telomere on chrosomal short arm and 5'-terminus of this base sequence : 5889
tgaggcaggagactatcactttgagtgtgtgtctttgtgtgtgtgtgtgtgtgtgtgtgtgtgtgtgtatgtgtttctagtttttacaagacacagcctgactatatcaccgaggctggagtgcagtggtgcaatgttggctcactgcaacctccacctgccaccgcagcctcctgaattagtgtctacaggtatgcacc

SEQ ID NO: 24266 - DNA, 288 bp, Homo sapiens
  AC011453.4_37530
  Located on chromosome 19
  Distance between a terminus base of telomere on chromosomal short arm and 5'-terminus of this base sequence : 71405119
  Distance between 3'-terminus of neighbour sequence of sequence listing upward to telomere on chrosomal short arm and 5'-terminus of this base sequence : 37790
tttgatttccagactattccatgcactgatcacaccttgtttttttgtttgtttgtttgtttgtttgtttgtttgacagagtctcagtttgttgcctggcgggagtgcaatgatgtgatctcgggtgactgcaacctctgcctccaaggttcaagtgattctcctgcctcaccctccaaagtagctgcggttacaggcatgcaccaccacacccagctcagtttttgcatttggtagagacaggttttcaccatgttggtcaggctggtctcgaactcctgatttcag

SEQ ID NO: 24267 - DNA, 344 bp, Homo sapiens
  AC011453.4_20332
  Located on chromosome 19
  Distance between a terminus base of telomere on chromosomal short arm and 5'-terminus of this base sequence : 71422173
  Distance between 3'-terminus of neighbour sequence of sequence listing upward to telomere on chrosomal short arm and 5'-terminus of this base sequence : 16766
gcactcatgtaggaattatccttcctgtgagcatataatatatggaacattctttgagacagggtctcaaaaatatgatgtgtatttcatcatatatataatataatcgtatacacacaaaatactgtttaaatacagagaataccctgatatcaccttgggtatttttctttgtttctgtgtgtgtgtgtgtgtgtgtgtgtgtgtgtgtgtgtgtgtttgtttggttatttctgagacaaggtctggctctatcgcccaggctggagtgtagtggtgtgatctcaactcactgcaacctccgccccccacctaaacctgctgaattagtgtctacaggcatg

SEQ ID NO: 24268 - DNA, 324 bp, Homo sapiens
  chr19.fa.O7frz.68308639
  Located on chromosome 19
  Distance between a terminus base of telomere on chromosomal short arm and 5'-terminus of this base sequence : 71521210
  Distance between 3'-terminus of neighbour sequence of sequence listing upward to telomere on chrosomal short arm and 5'-terminus of this base sequence : 98693
taatgagtaaacctgtgctcacttatgtcatagctgcttgaaggtttttgttttgttttgttttgttttttttgagaccgagtcttgctgtgtcacccaggctggagtgcagtggcatgatctcgggtcactgcaagctccgcctcctgggttcacaccattctcttgcctcagcctcccgagtagctgggactacaggtgcccgccaccacgcctggcttttgtgtgtgtgtgtgtgtgtgtgtgtgtgtgtgtgtgtgtgtgtgtgttaaaagagacggggtttcaccatgttactcaggatggtctcgatctcctgacctc

SEQ ID NO: 24269 - DNA, 99 bp, Homo sapiens
  DISO7_10004464
  Located on chromosome 19
  Distance between a terminus base of telomere on chromosomal short arm and 5'-terminus of this base sequence : 71553285
  Distance between 3'-terminus of neighbour sequence of sequence listing upward to telomere on chrosomal short arm and 5'-terminus of this base sequence : 31751
tgtctgggactcacatacataacgtgatatatatatatatatataaatgtataaatatatattttatttttttttaaatccttggagcttctggttcct

SEQ ID NO: 24270 - DNA, 479 bp, Homo sapiens
  chr19.fa.O7frz.68789588
  Located on chromosome 19
  Distance between a terminus base of telomere on chromosomal short arm and 5'-terminus of this base sequence : 71664917
  Distance between 3'-terminus of neighbour sequence of sequence listing upward to telomere on chrosomal short arm and 5'-terminus of this base sequence : 111533
cttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggt

SEQ ID NO: 24271 - DNA, 267 bp, Homo sapiens
  D9S923
  Located on chromosome 19
  Distance between a terminus base of telomere on chromosomal short arm and 5'-terminus of this base sequence : 71778370
  Distance between 3'-terminus of neighbour sequence of sequence listing upward to telomere on chrosomal short arm and 5'-terminus of this base sequence : 112974
gggtgatagagtgagaccatgtctttaaatatagatagacagatagaaagatatctgtctgttttaaaaataagaacctattatgtgccagactcttgctgtcattgattgacagatagataaaaatttgcacctattatgtgccaggcccttgctgtgattgaaagatagatagatggatggatggatagatagatagatagatagatagatagataaaaattagcacctgttaagtgccaggcccttgctgtgattgattgatgg

SEQ ID NO: 24272 - DNA, 253 bp, Homo sapiens
  AC009968.6_40995
  Located on chromosome 19
  Distance between a terminus base of telomere on chromosomal short arm and 5'-terminus of this base sequence : 71778458
  Distance between 3'-terminus of neighbour sequence of sequence listing upward to telomere on chrosomal short arm and 5'-terminus of this base sequence : -179
cagactcttgctgtcattgattgacagatagataaaaatttgcacctattatgtgccaggcccttgctgtgattgaaagatagatagatggatggatggatagatagatagatagatagatagatagataaaaattagcacctgttaagtgccaggcccttgctgtgattgattgatggatagataaaaattaacaccaattatgtgccaggcccttgctgtgattaattgatcgattgatagattggttgac

SEQ ID NO: 24273 - DNA, 318 bp, Homo sapiens
  chr19.fa.O7frz.69193427
  Located on chromosome 19
  Distance between a terminus base of telomere on chromosomal short arm and 5'-terminus of this base sequence : 71895310
  Distance between 3'-terminus of neighbour sequence of sequence listing upward to telomere on chrosomal short arm and 5'-terminus of this base sequence : 116599
ggataaatcctagaacataaggagactcggggcactcgtgacccgtcaggtcaggcggtggccttatgaggaataaggagggcgttttcagtgtccttttatcaggtactatgataacaacagagaaagagagagattgagacagacagagagagacggagagacagagagagattgagacagagagagagagggagagggagacacacacacacacacacacggagagagacagagacagagaagcaggcatcgcttgagctgcaaggctgcagacatgtttgcatctgggctctttctgaaagcaatactaaacaa

SEQ ID NO: 24274 - DNA, 115 bp, Homo sapiens
  DISD22_0011778
  Located on chromosome 19
  Distance between a terminus base of telomere on chromosomal short arm and 5'-terminus of this base sequence : 71997151
  Distance between 3'-terminus of neighbour sequence of sequence listing upward to telomere on chrosomal short arm and 5'-terminus of this base sequence : 101523
aatctttcttctcctacctacagcttacacacacacacacacacacacacacacacacacacacgcccttctctgtgagctgccagtttcatttgtctcctgacttgtctgaggg

SEQ ID NO: 24275 - DNA, 447 bp, Homo sapiens
  chr19.fa.O7frz.69591538
  Located on chromosome 19
  Distance between a terminus base of telomere on chromosomal short arm and 5'-terminus of this base sequence : 72275262
  Distance between 3'-terminus of neighbour sequence of sequence listing upward to telomere on chrosomal short arm and 5'-terminus of this base sequence : 277996
acctagatagttatcacctggattctagtctactgttaatcttttctccttccttccttccttccttccttccttccttccttccttctctctctctttttccttccctttctttctttccttcctttctctctgtttctttcctttctctcccttctcttttcctctttctttctttcctttctctccctctttctttctttcctttcctttcccttcccttcccttccactcactcactccctctctctctctctctctctttcctttctttctttctttctttctctctctctccctccctccctccctccctccctctctgtctctctctctttctttctttctttctttctttctttctttctttctttctttctttcttctttcttaagacagggtctcgctatgttgtcccggctacagtgtagtggttattcacaggtg

SEQ ID NO: 24276 - DNA, 201 bp, Homo sapiens
  chr19.fa.O7frz.69672097
  Located on chromosome 19
  Distance between a terminus base of telomere on chromosomal short arm and 5'-terminus of this base sequence : 72306603
  Distance between 3'-terminus of neighbour sequence of sequence listing upward to telomere on chrosomal short arm and 5'-terminus of this base sequence : 30894
gaatagatggcctagaaatagatctaactgtgtgtgtgtgtgtgtgtgtgtgtatatatatatatatacacacatgacagaagacagatttcaagtcagtgtggaaaggacggttggtttagcagcagtagtgacatatcggctctccatctggccaaaaacttctatagataagatgggtggaagatctagatgtatgca

SEQ ID NO: 24277 - DNA, 137 bp, Homo sapiens
  DISD22_0011782
  Located on chromosome 19
  Distance between a terminus base of telomere on chromosomal short arm and 5'-terminus of this base sequence : 72496904
  Distance between 3'-terminus of neighbour sequence of sequence listing upward to telomere on chrosomal short arm and 5'-terminus of this base sequence : 190100
ccattgttaattcctgaagtctcatttgaaaattactaaatgtctgttattttttggtgtttacattatatgtagacagataaactacacacacacacacacacacacatgcacacagaagaatggattggttcatg

SEQ ID NO: 24278 - DNA, 334 bp, Homo sapiens
  AL139117.7_34381
  Located on chromosome 19
  Distance between a terminus base of telomere on chromosomal short arm and 5'-terminus of this base sequence : 72689146
  Distance between 3'-terminus of neighbour sequence of sequence listing upward to telomere on chrosomal short arm and 5'-terminus of this base sequence : 192105
acctaatgctagatgacgagttagtgggtgcagcgcaccagcatggcacatgtatacatatgtaactaacctgcccaatgtgcgcatgtaccctaaaacttaaagtataattaaaaataaataaataaataaataaataaataaaaaagaagatctaactttcctaaatatctatgcatccaacacagcagcacccagattcataaaagaaatttgtaaagaccttcaaagagacttagactcccacacaataatagtgggagactttaataccccacttacaatagtagacagatcatcaagacagaaaattgactaagataatcaggacctg

SEQ ID NO: 24279 - DNA, 139 bp, Homo sapiens
  DISO7_10004466
  Located on chromosome 19
  Distance between a terminus base of telomere on chromosomal short arm and 5'-terminus of this base sequence : 72873648
  Distance between 3'-terminus of neighbour sequence of sequence listing upward to telomere on chrosomal short arm and 5'-terminus of this base sequence : 184168
ccattgttaattcctgaagtctcatttgaaaattactaaatgtctgttattttttggtgtttacattatatgtagacagataaactacacacacacacacacacacacacatgcacacagaagaatggattgtttcatg

SEQ ID NO: 24280 - DNA, 101 bp, Homo sapiens
  D19S926
  Located on chromosome 19
  Distance between a terminus base of telomere on chromosomal short arm and 5'-terminus of this base sequence : 73051640
  Distance between 3'-terminus of neighbour sequence of sequence listing upward to telomere on chrosomal short arm and 5'-terminus of this base sequence : 177853
ggccttatgcgtgagtagtttgtgtgtgtgtgtgtgtgtgtgtgtgtgtgtgtgtgtctttcacaccatgtgttctgaactacttaggaattctcaccaga

SEQ ID NO: 24281 - DNA, 226 bp, Homo sapiens
  AC019238.5_73447
  Located on chromosome 19
  Distance between a terminus base of telomere on chromosomal short arm and 5'-terminus of this base sequence : 73099299
  Distance between 3'-terminus of neighbour sequence of sequence listing upward to telomere on chrosomal short arm and 5'-terminus of this base sequence : 47558
gtgattcttatgctcatggaagtttgagaaccgctgatcaatgcattcagtgactcagaaacagagtcccggactctacaggtttgttggttggttggttggttggttggttggttagtttgtttgtttttgtcacccatattcaaccagctggactccacagtatagcaagccactccgattattcttctgcatgttatatgtgataaaccatccacctagagta

SEQ ID NO: 24282 - DNA, 83 bp, Homo sapiens
  D19S418
  Located on chromosome 19
  Distance between a terminus base of telomere on chromosomal short arm and 5'-terminus of this base sequence : 73109185
  Distance between 3'-terminus of neighbour sequence of sequence listing upward to telomere on chrosomal short arm and 5'-terminus of this base sequence : 9660
accaggcatccagtgttttatctggtaaccctcattcttacacacacacacacacacacacacacacaaaggcgggatagttg

SEQ ID NO: 24283 - DNA, 191 bp, Homo sapiens
  D19S880
  Located on chromosome 19
  Distance between a terminus base of telomere on chromosomal short arm and 5'-terminus of this base sequence : 73283087
  Distance between 3'-terminus of neighbour sequence of sequence listing upward to telomere on chrosomal short arm and 5'-terminus of this base sequence : 173819
cagtttggactcatttgtcaactgggaataatgatcatgtttatttcatgagtttgctgtgaggattattattggcagtaatagtagtaacataaagggctgtcttcataaagacatgctctacagccacacacacacacacacacacacacacacacacacacacactcacacacatgaaaagttactga

SEQ ID NO: 24284 - DNA, 117 bp, Homo sapiens
  D19S605
  Located on chromosome 19
  Distance between a terminus base of telomere on chromosomal short arm and 5'-terminus of this base sequence : 73352559
  Distance between 3'-terminus of neighbour sequence of sequence listing upward to telomere on chrosomal short arm and 5'-terminus of this base sequence : 69281
tccacccaagtctctctggtctttctacaaaagaatatgtggtgcatacacacacacacacacacacacacacacacacacacacacacatgcatgcactaacggacacacacatgc

SEQ ID NO: 24285 - DNA, 101 bp, Homo sapiens
  DISO7_10000002
  Located on chromosome 19
  Distance between a terminus base of telomere on chromosomal short arm and 5'-terminus of this base sequence : 73425133
  Distance between 3'-terminus of neighbour sequence of sequence listing upward to telomere on chrosomal short arm and 5'-terminus of this base sequence : 72457
acaggaagaccaaacagataggttgtgtgtgtatgtgtgtgtgtgtgtgtgtgtgtgtgtgtgtgtggtgtttctagcactgtgctgtgagatgcatctgg

SEQ ID NO: 24286 - DNA, 267 bp, Homo sapiens
  D19S877
  Located on chromosome 19
  Distance between a terminus base of telomere on chromosomal short arm and 5'-terminus of this base sequence : 73482421
  Distance between 3'-terminus of neighbour sequence of sequence listing upward to telomere on chrosomal short arm and 5'-terminus of this base sequence : 57187
gctacttgggaggctgaggcaggagaatcgtttgaacctgggaagcagaggctgcagtgagccgagatcactccactgcactctagcctgggcgagagagcgatactctgtctctgtctctctctctctctctctctctctctctctctctctctctctctctctctcacacacacacacacacacacacacacacacaccaaaacaccaaaaacagcacaccaaaacagcacctactctgtggcatgcattgttttaagtgcccac

SEQ ID NO: 24287 - DNA, 467 bp, Homo sapiens
  chr19.fa.O7frz.71200961
  Located on chromosome 19
  Distance between a terminus base of telomere on chromosomal short arm and 5'-terminus of this base sequence : 73775014
  Distance between 3'-terminus of neighbour sequence of sequence listing upward to telomere on chrosomal short arm and 5'-terminus of this base sequence : 292326
agcagtcatattggagtaggactcctcctctccagtacagcctcatcttaactaatttcatcaaaacgacccgatttccaaataaggccacattctgtggtactgagggttaggacttcaacatatatatatatatatatatatatatatatatatatatatagaaatatatatatagaaatatataaaaaaatatatatagaaatatatatatatatatatatataaattttttttttccagagacagaatctcactctgttgtccaggctggagtgcagtgatgcaatcacagatcacagctcactacagcctcaaacttctgggctcaagcaatcctcccaccttagccttccaagtaactgggactacaggcatgcaccaccatacccagctaattttaaaatttttttagtagagacaatgtctcactatgttgctcaggctagtcttgaactcctggattc

SEQ ID NO: 24288 - DNA, 462 bp, Homo sapiens
  chr19.fa.O7frz.71665969
  Located on chromosome 19
  Distance between a terminus base of telomere on chromosomal short arm and 5'-terminus of this base sequence : 73995496
  Distance between 3'-terminus of neighbour sequence of sequence listing upward to telomere on chrosomal short arm and 5'-terminus of this base sequence : 220015
tatgaggtactaggcttagtacgtgggtgatgaaataatctgcactaactcccatgacacaagtttacctgtgtaacaaacctgaacacgcatccctgaagctaaaagtaaactaaaaagagttaagtctacccttgtagtaaaactgatatatcaaaaaataaagctatgttttgcttcaaacacacacacacacactcacacacacacacacaccggaaaacaaaacaatccaaactagatgaaagttgcccttctacactcttttccatgtagcaagcaaaggtgtggacaggtaggaagatgctcaagtactgcagataggtgggagatgggttggtctatcatgcttagcagtaaaggaagcaggaaggagtcagatggatccactctaacaacagacctagaaaatttgtctaagccaggccacaagaaaatctgtatttgaaatgcctatttaaa

SEQ ID NO: 24289 - DNA, 333 bp, Homo sapiens
  chr19.fa.O7frz.71429372
  Located on chromosome 19
  Distance between a terminus base of telomere on chromosomal short arm and 5'-terminus of this base sequence : 74305871
  Distance between 3'-terminus of neighbour sequence of sequence listing upward to telomere on chrosomal short arm and 5'-terminus of this base sequence : 309913
cttaaagtgaaatcagtgtggtacatcgtcgcctgaaactggctttgctccatcagcgcttgagatccacccaagcagtcaagtgttacacactttcttcctttctgttgatgatggccattcaatgctatggagtaccacagtttaaccattcaccatccagggacacgttggttggttggttggttggtcggtcccagtttgtggctcttactgtggtttgtaagtcctgggaaggtggttttttcattagattagcttggtttagagatacaactatttaatgtttatatagttttcttttctttttgactgagtctagctcagttgctc

SEQ ID NO: 24290 - DNA, 314 bp, Homo sapiens
  AC011506.3_6385
  Located on chromosome 19
  Distance between a terminus base of telomere on chromosomal short arm and 5'-terminus of this base sequence : 74459797
  Distance between 3'-terminus of neighbour sequence of sequence listing upward to telomere on chrosomal short arm and 5'-terminus of this base sequence : 153593
ccaacatggtgaaatcctatctctactgaaaatacaaaactcagcctgctacagtggcaggcgcctgtaatcccagctactcgagaggctgaggcaggagaatcgcttggacccgggaggcagaggttgctatgagccgagatctgacactgcactccggcctgggtgacaaagctagactctgtctcaaaaataaataaataaataaataaataaataaataaataaataaattattgccttctaatatttttttagcagcccaagtccaatgattgcattaaaaaaatttgttgcatctatgccatgaatac

SEQ ID NO: 24291 - DNA, 405 bp, Homo sapiens
  AC011506.3_48219
  Located on chromosome 19
  Distance between a terminus base of telomere on chromosomal short arm and 5'-terminus of this base sequence : 74501657
  Distance between 3'-terminus of neighbour sequence of sequence listing upward to telomere on chrosomal short arm and 5'-terminus of this base sequence : 41546
cgtcagaaccaagctagttaacatctccatcacctcacatagataccatgttctttccttcttattagttatttaactcttgggctcaagcaatcctgcttcagcctccctagcagctggggttacaggcacgagccacatctggctttctttttatttcttgatgtgtgtgtgtgtgtgtgtgtgtgtgtgtgtgtgtgtgtgttggaaacatttaagatacaccctctgagcaaatttcaagtatacagtacagatgctcctcgacttacaatgaagttacatcctgataaaccctattgtgaatgtaaaatatagaaaataaaaatgcatttactattaggtcacttactgaacatcagcacttagcctagcctaccttcgacgtgctcagaacatttacat

SEQ ID NO: 24292 - DNA, 260 bp, Homo sapiens
  AC006116.1_50644
  Located on chromosome 19
  Distance between a terminus base of telomere on chromosomal short arm and 5'-terminus of this base sequence : 74597364
  Distance between 3'-terminus of neighbour sequence of sequence listing upward to telomere on chrosomal short arm and 5'-terminus of this base sequence : 95302
gatctcctgacctcgtgatcggcccgcctcggcctcccaaaatgctgggattacaggcgtgagccaccacgcctggcctgatatacgtatatattgtaaaatgtctaaaacaagctaataaatatatccacatctcacagttaccattgtgtgtgtgtgtgtgtgtgtgtgtgtgtgtggtgagaacatttgagataactcttgaaaaatttcaagtacacattaggattctctatgttcaccatgctatacattaggtc

SEQ ID NO: 24293 - DNA, 227 bp, Homo sapiens
  AC011499.3_8983
  Located on chromosome 19
  Distance between a terminus base of telomere on chromosomal short arm and 5'-terminus of this base sequence : 74801982
  Distance between 3'-terminus of neighbour sequence of sequence listing upward to telomere on chrosomal short arm and 5'-terminus of this base sequence : 204358
ccagtctgagcaatagagtgagacttgtcttaaataaataaataaataaataaataaaaataaaaagctaatgagaggtcagccggtctcactgtgttgcccaggctggtctctaactcctgggctcaaggaatcctcctgcctcggcttccaaactgccaaaattacaggcatgaaccactgctcgcagccccaggcagaaaattcttgaagcaatatctgaccat

SEQ ID NO: 24294 - DNA, 102 bp, Homo sapiens
  D19S404
  Located on chromosome 19
  Distance between a terminus base of telomere on chromosomal short arm and 5'-terminus of this base sequence : 74807053
  Distance between 3'-terminus of neighbour sequence of sequence listing upward to telomere on chrosomal short arm and 5'-terminus of this base sequence : 4844
agcttggggtgtttgttatggagcgaccagaacacacacacacacacacacacacacacacacacacaaacacacactcataagtggtgcaaagactgctta

SEQ ID NO: 24295 - DNA, 259 bp, Homo sapiens
  Z67494
  Located on chromosome 19
  Distance between a terminus base of telomere on chromosomal short arm and 5'-terminus of this base sequence : 74889428
  Distance between 3'-terminus of neighbour sequence of sequence listing upward to telomere on chrosomal short arm and 5'-terminus of this base sequence : 82273
cctcaggccaatccactcccccaacccatacatctcccaaagactcaccttcagggatgcagatctgagagatgttctcccacctccttccttggtgctcttgcaaataaatcttttctcttttgcaaagcctgtgtcagtgattgatttactgtgtgtgcacagagtggacctggacctgactggtaacagaatgaaacgtgtgtgtgtgtgtgtgtgtgtgtgtgtgtatgtgtggtacaatatgatgttctgatct

SEQ ID NO: 24296 - DNA, 406 bp, Homo sapiens
  AC025588.1_64467
  Located on chromosome 19
  Distance between a terminus base of telomere on chromosomal short arm and 5'-terminus of this base sequence : 75008113
  Distance between 3'-terminus of neighbour sequence of sequence listing upward to telomere on chrosomal short arm and 5'-terminus of this base sequence : 118426
gattactggaggtcaggagttcgagacctgggcaacatagcaagaccttgtctctattaaaaaatagatagatagatagatagatagatacatagaacatcaaaagagggagagagaaagcagacagatgtggcaaaatatacacaattggtaaatttgggtgaagggaatataagttatttctactaatcttgcaattcttatgtatatttgcaatgatttctaaataaaagtttttaattaccaattgaaataaagtaaaataagtcactatctagccttttctagacaaatattttaaactcttacacagagataagttaatcaagaaacgtatttcctggaaaaacccgtgatatgggtggagccacctgggaataaaaggtcggaacatcataatcactgt

SEQ ID NO: 24297 - DNA, 252 bp, Homo sapiens
  D19S887
  Located on chromosome 19
  Distance between a terminus base of telomere on chromosomal short arm and 5'-terminus of this base sequence : 75008711
  Distance between 3'-terminus of neighbour sequence of sequence listing upward to telomere on chrosomal short arm and 5'-terminus of this base sequence : 192
aaggtttgcttgtttgggtgatgggatgtgtgtgtgtgtgtgtgtgtgtgtgtgtgtgtgtgtgtgtgtatgtgtgtgtgagtgttggaaggagggtctgtctaaacttaatgccctaaagatattgtcagatattgtgatgaggggaatttcatcttctaccctttatgaggttgaattgtaaattcgaaaatcctgattctgggtttttattttgaggggatagttttctgttttctgtggcattggata

SEQ ID NO: 24298 - DNA, 165 bp, Homo sapiens
  D19S214
  Located on chromosome 19
  Distance between a terminus base of telomere on chromosomal short arm and 5'-terminus of this base sequence : 75156941
  Distance between 3'-terminus of neighbour sequence of sequence listing upward to telomere on chrosomal short arm and 5'-terminus of this base sequence : 147978
caactggctttatcccactctcactgattcttaatctgctctagtttgtcttatctccgcaacactcctaaccttctatattgtttaggagttttggattattattattttgtgtgtgtgtgtgtgtgtgtgtgtgtgtggtatgtatgtgtctccattgtgact

SEQ ID NO: 24299 - DNA, 432 bp, Homo sapiens
  chr19.fa.O7frz.73624359
  Located on chromosome 19
  Distance between a terminus base of telomere on chromosomal short arm and 5'-terminus of this base sequence : 75319290
  Distance between 3'-terminus of neighbour sequence of sequence listing upward to telomere on chrosomal short arm and 5'-terminus of this base sequence : 162184
gtaaagtattaggtatgccatgactggaggctatagtcttgaggagtgtgtgtgtgtgtgtgtgtgtgtgtgtgtgtgtgtgtgtgtgaaggggttatttagaaggttgacatcctatgtgattggctagtgatgcactgactttctccagttggtcctaagttgaacatatgggcaacaattagaaagctgtcagttcttagtcatgtcttagccattttaagcgagttgttatgtgggatgttgtctggcttcctggccttgttgctagacatagtattctgacttgggagtggttactgtagataccacattagatttctgaatgggttggtgtagattatgggtcagagtcaatttttatatttggtgtagccgttgtccatttgtatagcaaatttctcacacctaaataaggaactatccacgtta

SEQ ID NO: 24300 - DNA, 213 bp, Homo sapiens
  AC003682.1_99125
  Located on chromosome 19
  Distance between a terminus base of telomere on chromosomal short arm and 5'-terminus of this base sequence : 75496580
  Distance between 3'-terminus of neighbour sequence of sequence listing upward to telomere on chrosomal short arm and 5'-terminus of this base sequence : 176858
aggtgacagatatgtccaacaccattgatagggtgatgatttcaaaagtgtacatatgtgtgtgtgtgtgtgtgtgtgtgtgtgtgtgtgtgtatacttactgttttaatatgtgcagtacattgcatgttgattacacctcaatgaacctataaaaagttattccatttaaaaatctgggcctcccacttctattggaaactggacaacttg

SEQ ID NO: 24301 - DNA, 249 bp, Homo sapiens
  AC003682.1_111671
  Located on chromosome 19
  Distance between a terminus base of telomere on chromosomal short arm and 5'-terminus of this base sequence : 75509015
  Distance between 3'-terminus of neighbour sequence of sequence listing upward to telomere on chrosomal short arm and 5'-terminus of this base sequence : 12222
gtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacacttgaaactatcaccctatcagtggtattggacatatctgttacc

SEQ ID NO: 24302 - DNA, 254 bp, Homo sapiens
  D19S218
  Located on chromosome 19
  Distance between a terminus base of telomere on chromosomal short arm and 5'-terminus of this base sequence : 75576563
  Distance between 3'-terminus of neighbour sequence of sequence listing upward to telomere on chrosomal short arm and 5'-terminus of this base sequence : 67299
tttgcattttctggagtttttactgagatacatacacacacacacacacacacacacacacacgtatacgcatatacgtatacgtatatatatacatatgtgtttatatatgtgtgtgtgtatatatatatacttactggttttcttcatgctgtataattattttgagattcaaaaatgatgaatctttgtattgctgagtatcatgctgttctatggataagtcagtgtttatccatgtgtttagggacatt

SEQ ID NO: 24303 - DNA, 377 bp, Homo sapiens
  chr19.fa.O7frz.74391831
  Located on chromosome 19
  Distance between a terminus base of telomere on chromosomal short arm and 5'-terminus of this base sequence : 75990651
  Distance between 3'-terminus of neighbour sequence of sequence listing upward to telomere on chrosomal short arm and 5'-terminus of this base sequence : 413834
tggctcatgcctgtaataccagcactttgggaggcagagatgggcagatcacctgaggtcaggagtttgagaacagcttggtcaacgtggcgaaaccccatctctgctaaaaatacaaaaaaaattagccaggcatggtggcaagtgcctgtaatccctgctactcaagaggctgaggcatgagaattgcttgaacccaggtggcagaggttggcagtgagccgagatcatgccactgcacactagcctaggcaaaagagtgagactccatctcaataaaataaaataaaataaaataaaataaaataaaataaaataaaaaagtctgaagctagcagaggttggttcatgaagtttaagtcatctccgtaacataa

SEQ ID NO: 24304 - DNA, 274 bp, Homo sapiens
  chr19.fa.O7frz.74634331
  Located on chromosome 19
  Distance between a terminus base of telomere on chromosomal short arm and 5'-terminus of this base sequence : 76289569
  Distance between 3'-terminus of neighbour sequence of sequence listing upward to telomere on chrosomal short arm and 5'-terminus of this base sequence : 298541
ctgtgctaccaagttatgaaaggcatggaggagtctgaaatgcacattggtaagtgacagaagccagactgaaaaagctacatactgtatgattacaagtttatgacattctggaaaaggtaaagctatagagacagtaaagcagtgactgccagggactcagtgggagggagggagggagggagggaggaatgaatagtagcacaagtaatttttgggggcagtaaaagtattttgtactatattgtaatggtggatacatgaatttatgcat

SEQ ID NO: 24305 - DNA, 206 bp, Homo sapiens
  AC006115.1_17590
  Located on chromosome 19
  Distance between a terminus base of telomere on chromosomal short arm and 5'-terminus of this base sequence : 76628280
  Distance between 3'-terminus of neighbour sequence of sequence listing upward to telomere on chrosomal short arm and 5'-terminus of this base sequence : 338437
aaactccaataaagtcacagacacacacacacacacacacacacacacacacacactaagctagcctagcttatatgcaggagattgtaatagtatgaatcacatgttttcacgcaaggccatgcagaataaatggtcttcaaaccacttcttaagcatgcacacatccacacgcaaacacactgttatgatctgaatactgcctc

SEQ ID NO: 24306 - DNA, 230 bp, Homo sapiens
  D19S573
  Located on chromosome 19
  Distance between a terminus base of telomere on chromosomal short arm and 5'-terminus of this base sequence : 76629001
  Distance between 3'-terminus of neighbour sequence of sequence listing upward to telomere on chrosomal short arm and 5'-terminus of this base sequence : 515
agaatcaccagcatttcctgatcaaacatagacacattcacacagaaagacacaaacacacaatgtgctgcaggcttatttgaactcaaatacaaatacagacacacacacacacacacacacacacacatacacatagttatatccaatcatccattcaagacaagacattctcaaccacacagaatcatagagaaatacaaccacaaacaaggtaacgcacactcaca

SEQ ID NO: 24307 - DNA, 309 bp, Homo sapiens
  HUMUT1342B
  Located on chromosome 19
  Distance between a terminus base of telomere on chromosomal short arm and 5'-terminus of this base sequence : 76642886
  Distance between 3'-terminus of neighbour sequence of sequence listing upward to telomere on chrosomal short arm and 5'-terminus of this base sequence : 13655
agaagaggaaatcctgcctcaagatttcagcatcaatgtctgcttgagtttcccacctgctggctggccctacaaaccaactcccacaactgtgtgagacaattccttaaaataaatctcaacctctgcatacattagatgatagacagacagacagacagacaggcaggcaggcaggcaggcaggcagatagatagacagatggatagatagatagatagatagatagatagatagatagatagatagatagatagatagatagatagatagggacaggtatatatacacacatatatctgaatttcc

SEQ ID NO: 24308 - DNA, 362 bp, Homo sapiens
  AC006115.1_2767
  Located on chromosome 19
  Distance between a terminus base of telomere on chromosomal short arm and 5'-terminus of this base sequence : 76643000
  Distance between 3'-terminus of neighbour sequence of sequence listing upward to telomere on chrosomal short arm and 5'-terminus of this base sequence : -195
aatctcaacctctgcatacattagatgatagacagacagacagacagacaggcaggcaggcaggcaggcaggcagatagatagacagatggatagatagatagatagatagatagatagatagatagatagatagatagatagatagatagatagatagggacaggtatatatacacacatatatctgaatttcctgggtctgcagagctgaggaccccaatctgtcttggagtgactttttcatggcctgcctcccttcccccttgatctcagagccttccaccagaatctctattatatatgtatacatatagacaacacagagagagataagagaaagattttaaggaattggctcacg

SEQ ID NO: 24309 - DNA, 178 bp, Homo sapiens
  AC007228.1_101249
  Located on chromosome 19
  Distance between a terminus base of telomere on chromosomal short arm and 5'-terminus of this base sequence : 76674629
  Distance between 3'-terminus of neighbour sequence of sequence listing upward to telomere on chrosomal short arm and 5'-terminus of this base sequence : 31267
ggattgatggcatctgaataaaagggtgaatgagtatgtatatggataactggatatatggatggatgaatgggtggatggatggatggatggatggatggatggatggaatgggtatatggatgcataagggatgaaaggttgggtaaatgaatgagtggacagatgaatagttggt

SEQ ID NO: 24310 - DNA, 253 bp, Homo sapiens
  AC007228.1_101005
  Located on chromosome 19
  Distance between a terminus base of telomere on chromosomal short arm and 5'-terminus of this base sequence : 76674894
  Distance between 3'-terminus of neighbour sequence of sequence listing upward to telomere on chrosomal short arm and 5'-terminus of this base sequence : 87
aagtggatagacagctgaggtatagggatgggttgatgcatggatggatggatggatggatggatggatggatggatggatggatggataagtggataaacagatgaagtatagggatggatggatggatggatggatggatggatggatggatggatggatggatggaatgggtatacaagcaagtaggtgaataaaagtttaggtggatgaaagagtggacagatgagtgaatggctagtagatgtttgag

SEQ ID NO: 24311 - DNA, 360 bp, Homo sapiens
  AC004696.1_30123
  Located on chromosome 19
  Distance between a terminus base of telomere on chromosomal short arm and 5'-terminus of this base sequence : 76813164
  Distance between 3'-terminus of neighbour sequence of sequence listing upward to telomere on chrosomal short arm and 5'-terminus of this base sequence : 138017
agcctcatacttgttcatctttcacacaggcacatctatttctctcacacattgatataccctggtctcacactctggattctcacaatccagtccctgataacacactcaggtgacaaagaggaaaaacaaactgtttctcctactccactcacacaacacaaaacagttctaagaccagatgtgtggggatctacacacacacacacacacacacacacacacacacacacaccaggcaagcaataagttcttcagtgaataccaggtgggtgacctctagggcaacccagtgaataccaggtgggtgacctctagggcaacccaattctgacactatctacctggagacagcataag

SEQ ID NO: 24312 - DNA, 169 bp, Homo sapiens
  D19S210
  Located on chromosome 19
  Distance between a terminus base of telomere on chromosomal short arm and 5'-terminus of this base sequence : 76814775
  Distance between 3'-terminus of neighbour sequence of sequence listing upward to telomere on chrosomal short arm and 5'-terminus of this base sequence : 1251
tcacactcactggtctctcacactggcccgtctcgctctgtcacacacgaacataccctggtctcacactggactctcggtctgtcacacacacacacacacacacacagaaaccacaccctctcacggagcctcacactctgacagatcttttacacacaggcacacc

SEQ ID NO: 24313 - DNA, 379 bp, Homo sapiens
  chr19.fa.O7frz.74753431
  Located on chromosome 19
  Distance between a terminus base of telomere on chromosomal short arm and 5'-terminus of this base sequence : 76844973
  Distance between 3'-terminus of neighbour sequence of sequence listing upward to telomere on chrosomal short arm and 5'-terminus of this base sequence : 30029
atcaggagttccagcctagccaacatggcaaaaccccgtctccactaaaagtacaaaaattagccaggcgtggtggtggtgggcccctataatcccagctactcgggaggctgaggcaggagaataccttgaacccgggaggcggttgttgcagtgagccgagatcgcgccactgcacttcagcctgggcgacaagagcaagactccgtctcaaaataataataataataataaaaagaatgtgtatatatatgtgtgtgtgtgtgtgtgtgtgttcatatatgtgtgtgtgtgtgtgtgtgtgtgtgtgtgtgtgtgtgtatgaacccaaagaccttaaccctggttgtgggggcatttcaaggaataaatgtgtacc

SEQ ID NO: 24314 - DNA, 318 bp, Homo sapiens
  chr20.fa.O7frz.76631
  Located on chromosome 20
  Distance between a terminus base of telomere on chromosomal short arm and 5'-terminus of this base sequence : 126395
  Distance between 3'-terminus of neighbour sequence of sequence listing upward to telomere on chrosomal short arm and 5'-terminus of this base sequence : 0
agatggctaaagtttatccaacatcatcagaaatttcctctttctggagccttattccatgttactatccttaaagaggagtactcactgagctaaaaagaggtcataatttcttctgggaaagatgtgttgttatagaaaggaatgatgccaatatctagggatacctttatgtctttggatatggtttttactctgatgctcagctatatttccttttactcaaatatatatatgtgtgtgtgtgtgtgtgtgtgtgtgtgtgtgcatgaatagaggaagaagcaaattttggagttaggtttaagaaacatgcct

SEQ ID NO: 24315 - DNA, 226 bp, Homo sapiens
  D20S864
  Located on chromosome 20
  Distance between a terminus base of telomere on chromosomal short arm and 5'-terminus of this base sequence : 186314
  Distance between 3'-terminus of neighbour sequence of sequence listing upward to telomere on chrosomal short arm and 5'-terminus of this base sequence : 59601
tcaaggctgtactgcactgtgttcacacctgtgaatagccactgcactccaacctgagcaacacagtgcctcttaaatatgtatatgtatatatatatatatgtgtgtgtgtgtgtgtgtgtgtgtgtgtgtgtgtgtgtatatatatatatatatactcttttaaatttactctgttttaaatattttgaggcagaagcaagacgttttgatacagaaagccagc

SEQ ID NO: 24316 - DNA, 167 bp, Homo sapiens
  Z66755
  Located on chromosome 20
  Distance between a terminus base of telomere on chromosomal short arm and 5'-terminus of this base sequence : 215605
  Distance between 3'-terminus of neighbour sequence of sequence listing upward to telomere on chrosomal short arm and 5'-terminus of this base sequence : 29065
aaaccctggattaaacgcatctttttataaatggaaataattaatgaagaactgagatggaatcaaaatagcaaatcatgcacacacacacacacacacaaattctgtttagagaactaaaacaatatgtcagaaacgttgaagagttcatgtgcatcagttagttc

SEQ ID NO: 24317 - DNA, 279 bp, Homo sapiens
  chr20.fa.O7frz.414108
  Located on chromosome 20
  Distance between a terminus base of telomere on chromosomal short arm and 5'-terminus of this base sequence : 453174
  Distance between 3'-terminus of neighbour sequence of sequence listing upward to telomere on chrosomal short arm and 5'-terminus of this base sequence : 237402
tcaattgtaattaaatagcctcacgtggctagtcactaccatactgaacagcacatgactgcagtcaaagctcatgtgctcttacaccatgctgtcttgatagctggcagctttcaaaattactgaaagtcaatttgaatggggaaagagcattttctaagataaaattgtgttttggaatttatttccatttgatttcttccacctctctaatcatgtttttgtgtgtgtgtgtgtgtgtgtgtgtgtgtgtacacacaggtaatacattcacatggt

SEQ ID NO: 24318 - DNA, 303 bp, Homo sapiens
  AL133231.14_12626
  Located on chromosome 20
  Distance between a terminus base of telomere on chromosomal short arm and 5'-terminus of this base sequence : 547164
  Distance between 3'-terminus of neighbour sequence of sequence listing upward to telomere on chrosomal short arm and 5'-terminus of this base sequence : 93711
ttctgagccttggtgatctcattgggaacataaaggggttgaactccaggatgctcaaggtggctctttttgcattgatgtcctgtggtttttctctgggtctggcaatgagggcagttcaggaaaagtgtgataaaatagctctactttagttcatagagggacaagacacagtcacatgggcacacatgtacacacacacacacacacacacacacacacacaaatgtgattaaccaaacatcatggtagccaagaagatatgtagcattaaggtttagaatacaggctttgaagtcaaac

SEQ ID NO: 24319 - DNA, 98 bp, Homo sapiens
  D20S103
  Located on chromosome 20
  Distance between a terminus base of telomere on chromosomal short arm and 5'-terminus of this base sequence : 547315
  Distance between 3'-terminus of neighbour sequence of sequence listing upward to telomere on chrosomal short arm and 5'-terminus of this base sequence : -152
gttcatagagggacaagacacagtcacatgggcacacatgtacacacacacacacacacacacacacacacacaaatgtgattaaccaaacatcatgg

SEQ ID NO: 24320 - DNA, 453 bp, Homo sapiens
  AL121758.24_56519
  Located on chromosome 20
  Distance between a terminus base of telomere on chromosomal short arm and 5'-terminus of this base sequence : 640799
  Distance between 3'-terminus of neighbour sequence of sequence listing upward to telomere on chrosomal short arm and 5'-terminus of this base sequence : 93386
agactgagtctgtgctcagaatcacccaggggagaagaggggaagggaaagcagtggaggagcaagagaggcatcttacttgaggggacaatgaaattagatctattcccacttatcagggagctctgcagagagacctggtgctttcttcatttgaggggctccccttccctgtttaggagttctgtgggcttggggggaccctggagcacagacagacttgctgcaccctctgttctgcctggcggtagaggctgaaagggagtaggaaggcaaagaagagcattgctcgtgtgtgtgtgtgtgtgtgtgtgtgtgtgtgtgtgcgcgcgtgcgtgtgtgtgtatggaggaggagcaggagtcctccaggaattctccagcattctcaggcattcccagagctggggtacacctctttaatttggggttctgcatctttatcagctaggag

SEQ ID NO: 24321 - DNA, 251 bp, Homo sapiens
  D20S105
  Located on chromosome 20
  Distance between a terminus base of telomere on chromosomal short arm and 5'-terminus of this base sequence : 640944
  Distance between 3'-terminus of neighbour sequence of sequence listing upward to telomere on chrosomal short arm and 5'-terminus of this base sequence : -308
ttcttcatttgaggggctccccttccctgtttaggagttctgtgggcttggggggaccctggagcacagacagacttgctgcaccctctgttctgcctggcggtagaggctgaaagggagtaggaaggcaaagaagagcattgctcgtgtgtgtgtgtgtgtgtgtgtgtgtgtgtgtgtgcgcgcgtgcgtgtgtgtgtatggaggaggagcaggagtcctccaggaattctccagcattctcaggcatt

SEQ ID NO: 24322 - DNA, 178 bp, Homo sapiens
  D20S117
  Located on chromosome 20
  Distance between a terminus base of telomere on chromosomal short arm and 5'-terminus of this base sequence : 643301
  Distance between 3'-terminus of neighbour sequence of sequence listing upward to telomere on chrosomal short arm and 5'-terminus of this base sequence : 2106
tccagagatcacccccttctgcacctgaatgacttctcttgttcctcaaacccttgtccctgcaggaacttgttctgagaagagatggagtgtgtgtgtgtgtgtgtgtgtgtgtgtgtgtgtgtgtgtgtgtatgtgtagtgaggagggggcttacgaggagcagcagggttggttc

SEQ ID NO: 24323 - DNA, 199 bp, Homo sapiens
  AL118502.38_28413
  Located on chromosome 20
  Distance between a terminus base of telomere on chromosomal short arm and 5'-terminus of this base sequence : 727615
  Distance between 3'-terminus of neighbour sequence of sequence listing upward to telomere on chrosomal short arm and 5'-terminus of this base sequence : 84136
gctgtatttgccatttgtataatctctggaagggtaaacagcgactgataaaagtgctcgtgtgtgtgtgtgtgtgtgtgtgtgtgtgtgtgttaagagaaactgggcagatgagggagaggaaagggatgaaaacctttctctgtacaccttatattttctgattttttgaaacacgtgactgtattacctattcaca

SEQ ID NO: 24324 - DNA, 400 bp, Homo sapiens
  chr20.fa.O7frz.817300
  Located on chromosome 20
  Distance between a terminus base of telomere on chromosomal short arm and 5'-terminus of this base sequence : 856460
  Distance between 3'-terminus of neighbour sequence of sequence listing upward to telomere on chrosomal short arm and 5'-terminus of this base sequence : 128646
tcgtagatagcaccagatttatttatttgcaaagaagtaaagccaataaagtttaccggatgaatagtatggtgggtgaattagatctcaataaagctgttaaaatttacgagataaataaaagaaggaggaaggaaggaaggaaggaaggaaagggaaagaaagaatcagggtgtcctgggccccaggaagatgcctatcccctgtcccacccagtgcaggggccaggcaatgtgtttgcctggctcctagcccagccccgtatccactctcatttccagcctcagtctagactccaaccctggtttcagtccttccccagcaggggctattcccagctctagtttcagccctaactcccaggatacctccttgccccaatcctaatccaagctcctag

SEQ ID NO: 24325 - DNA, 108 bp, Homo sapiens
  D20S199
  Located on chromosome 20
  Distance between a terminus base of telomere on chromosomal short arm and 5'-terminus of this base sequence : 1082119
  Distance between 3'-terminus of neighbour sequence of sequence listing upward to telomere on chrosomal short arm and 5'-terminus of this base sequence : 225259
cagaaagtgctggatggatcaggggcaacacacacacacacacacacacacacacacacacacacacacacacaccagccccaggagttcctcccatttgttcccatc

SEQ ID NO: 24326 - DNA, 459 bp, Homo sapiens
  chr20.fa.O7frz.1278709
  Located on chromosome 20
  Distance between a terminus base of telomere on chromosomal short arm and 5'-terminus of this base sequence : 1318501
  Distance between 3'-terminus of neighbour sequence of sequence listing upward to telomere on chrosomal short arm and 5'-terminus of this base sequence : 236274
ttctgcaactttagtgaatttatctaacagttttttggtggagcctttaggtttttccaaatagaagatcagattgtctaaaaacaagggtaatttgacttcttctttcccagtttggatgccctttctttctttctttcttttgtctgattgctctagctaggacttctagtactatgttgaataatagtgtactgggcatccttggcttattccagatcgtaaaggaaaggattttagtttttctccattcagtatgatagtagtgatgggtctgtcatatatgtcatatatgggttttattatattgcagtacattccttctctacccagttttttgagggtttttatcatgaagggatgttgaattttatcaaatgctttttcagcatcaattaaaatgatcatgtagtttttgtccttcattcttgttgataagatgtatcactgattgaattg

SEQ ID NO: 24327 - DNA, 380 bp, Homo sapiens
  chr20.fa.O7frz.1414419
  Located on chromosome 20
  Distance between a terminus base of telomere on chromosomal short arm and 5'-terminus of this base sequence : 1454231
  Distance between 3'-terminus of neighbour sequence of sequence listing upward to telomere on chrosomal short arm and 5'-terminus of this base sequence : 135271
cactttccaccttaagaaactagaaaaaaaggccaataaactaaactcaaagtagtgaaagaaaggaaatcatcaagctggaaatgaaacttaatacagtagaacacacacacacacacacacaccacacacacacacacacacagaaaaaatcaatgagaagaagaaaatctttgagaagatcactaaaactgataaatctctagtcagattgaacagaggggacacacacagaaagaacctaaattattaaaataaggaataagattggtgatactactacagattttactcttattaatagaataataaaagaatattatggaaaacttcaagtcatacatatttgacaaattaggtaacatgaacaaattccttga

SEQ ID NO: 24328 - DNA, 249 bp, Homo sapiens
  D20S906
  Located on chromosome 20
  Distance between a terminus base of telomere on chromosomal short arm and 5'-terminus of this base sequence : 1493633
  Distance between 3'-terminus of neighbour sequence of sequence listing upward to telomere on chrosomal short arm and 5'-terminus of this base sequence : 39022
tgagccgagatcgagccactgcactccagcctgggcgacagagcaagactccatctcaaaaaaaggaaaacacacacacacacacacacacacacacacacacacacacacacacacacacaaaaccacaagagacaatatacacatgcttgtatttctcactcttgtaaacataaaaggtagtgtgctccacacactcttctatatattttcctgtttaatgatatgctgtgggtcactctgaagtgg

SEQ ID NO: 24329 - DNA, 400 bp, Homo sapiens
  AL109809.18_84870
  Located on chromosome 20
  Distance between a terminus base of telomere on chromosomal short arm and 5'-terminus of this base sequence : 1634610
  Distance between 3'-terminus of neighbour sequence of sequence listing upward to telomere on chrosomal short arm and 5'-terminus of this base sequence : 140728
agatctaatgtgcaatatgaggactagagttaatagcattgcattgaattcagtatttttgctcaaagagtctatcttagatgccctacacacacacacacacacacacacacacacacacacacacacacggtaactatgtgagagggtggatatgttcatttgcttgactgtaataaccattacactatgtctatgtatacgaaagcaccatgttttaccccttaaataagaggtgtcagcaaagctgtgtgtattctagaggctctgttccttgctgccacattcctttcctcacagttacatcttcccatcactcccacatcttgcttccattgtcatatgtcctacaaagacccttgtcatatattgggccctttctgacactagaccaagatgt

SEQ ID NO: 24330 - DNA, 335 bp, Homo sapiens
  AL109809.18_33775
  Located on chromosome 20
  Distance between a terminus base of telomere on chromosomal short arm and 5'-terminus of this base sequence : 1685596
  Distance between 3'-terminus of neighbour sequence of sequence listing upward to telomere on chrosomal short arm and 5'-terminus of this base sequence : 50586
tttaactcaaggtggatcaaagatttaaatgcaagagctaaaactgtaaatctcttaaaagaaaatgtagggataaatcttcatgaccttggataataaagtaaaaaaatacttcatggaatgggagaaaatattccaaattatatatctaagaaggaactggtatctagaaaatagatatagacagatagatgataaatgatagatagatagatagatagatagatagatagatagataatcacttacaactcaataataaaaatacaaataactcaattttcaaaaagagaaagtatctaagtagatatttctccaaagataagcacatgaaa

SEQ ID NO: 24331 - DNA, 283 bp, Homo sapiens
  AC012503.6_185833
  Located on chromosome 20
  Distance between a terminus base of telomere on chromosomal short arm and 5'-terminus of this base sequence : 1705218
  Distance between 3'-terminus of neighbour sequence of sequence listing upward to telomere on chrosomal short arm and 5'-terminus of this base sequence : 19287
aggtattggttaacaaatgcacacataaggaaatgcatgattgaatgacagcgtaaattcatgagtgaatgcatgcctggatggatggatggatggatggatggatggatggatggatggatggatcgatggatagatagatggatgggtgggtggatggatgagcggatggatggatagatggatggatgggtgggtggatggatgagtggatggatggatgggattgaagaaagtcatttaatctttcttttctttttcactttggccattaaagatgaaa

SEQ ID NO: 24332 - DNA, 227 bp, Homo sapiens
  Z67179
  Located on chromosome 20
  Distance between a terminus base of telomere on chromosomal short arm and 5'-terminus of this base sequence : 1727181
  Distance between 3'-terminus of neighbour sequence of sequence listing upward to telomere on chrosomal short arm and 5'-terminus of this base sequence : 21680
ggattgcttgatcccagcagttcaaggccagcctgggcaacataacaacactccatctctatatatattttacacacacacacacacacacacacacacacacacagagtatatgtgtgtattttatacacatagtataaaattatacactataattttatatgcatagtacatagtattagtccattttcatgctgctgataaagatatacccaagactgggcaat

SEQ ID NO: 24333 - DNA, 287 bp, Homo sapiens
  HUMUT655
  Located on chromosome 20
  Distance between a terminus base of telomere on chromosomal short arm and 5'-terminus of this base sequence : 1727212
  Distance between 3'-terminus of neighbour sequence of sequence listing upward to telomere on chrosomal short arm and 5'-terminus of this base sequence : -196
cctgggcaacataacaacactccatctctatatatattttacacacacacacacacacacacacacacacacacagagtatatgtgtgtattttatacacatagtataaaattatacactataattttatatgcatagtacatagtattagtccattttcatgctgctgataaagatatacccaagactgggcaatttacaaaagaaagaagtttaattggacttacagttccacgtggctggggaagcctcacaatcatggtggaaggcaaggagaagcaagtcat

SEQ ID NO: 24334 - DNA, 289 bp, Homo sapiens
  AL121760.11_25367
  Located on chromosome 20
  Distance between a terminus base of telomere on chromosomal short arm and 5'-terminus of this base sequence : 1785909
  Distance between 3'-terminus of neighbour sequence of sequence listing upward to telomere on chrosomal short arm and 5'-terminus of this base sequence : 58410
ctggatttataagcacctactcagtgccaggccctctgtgttgtcctggagaaagagatgaataagacacttaaccctgccctccaggaagccatggactaaaggtgaagggagtgtggtgtgtgtgtgcgtgtgtgtgtgtgtgtgtgtgtgtgtgtgtgtgtgtgtgtgttgcatgtaggcaactggggatgaaaaaatcagttttaacctgtcacccagctgaggctctctaggctacttggagcttcctggaatttcctttgtgtctaattgcaattagcattct

SEQ ID NO: 24335 - DNA, 284 bp, Homo sapiens
  AL034562.2_3852
  Located on chromosome 20
  Distance between a terminus base of telomere on chromosomal short arm and 5'-terminus of this base sequence : 1859533
  Distance between 3'-terminus of neighbour sequence of sequence listing upward to telomere on chrosomal short arm and 5'-terminus of this base sequence : 73335
gattatcttgctcagcattgtagcttcagggcctgaccacagtaagcactcagtaaatgctttttgagtgaaagaggataaaagagtcagttggttggctggttggttggttggttggttggttggttggttggttggttggttacataatccttagttagccaatgaggtagagatgactgttggccccagtaacagaagaagcagccagggtttggagggaggcttaactgacttgtccagggtcacacagctacttagtagcatagatttgaaagcacttt

SEQ ID NO: 24336 - DNA, 148 bp, Homo sapiens
  G09329
  Located on chromosome 20
  Distance between a terminus base of telomere on chromosomal short arm and 5'-terminus of this base sequence : 1922841
  Distance between 3'-terminus of neighbour sequence of sequence listing upward to telomere on chrosomal short arm and 5'-terminus of this base sequence : 63024
caagggagagtttgcatttgatctaaatgtgactggaagactaaggaagtttgagtgattgatgaatgaatgaatgaatgaatgaatgaatggtgtcccagtacctcatacagggctagaatgagagcaggagctgcacaccaattag

SEQ ID NO: 24337 - DNA, 365 bp, Homo sapiens
  AL034562.2_76639
  Located on chromosome 20
  Distance between a terminus base of telomere on chromosomal short arm and 5'-terminus of this base sequence : 1932297
  Distance between 3'-terminus of neighbour sequence of sequence listing upward to telomere on chrosomal short arm and 5'-terminus of this base sequence : 9308
cactcatggataatcctcattaagccattgatgtctgatatccttcaccccctgagtctactgttgcctcaagagcaaatagttcctgcatttgcctttcctctccttccgcagcctcctttacacacacacacacacacacacacacacacacacacatagaaggccaggagcagccttcccccttagtcctggagaaccttgccataaagctcaccctctcctgggctcagtgatgcaccaatcatggtgctggccctgtgggcagcagtcccgggggtgggtaccatggctcagccaggctcacttcagcttagatcccgacgccactgcttcctcactgtgtgacaactgatggatacttc

SEQ ID NO: 24338 - DNA, 136 bp, Homo sapiens
  D20S179
  Located on chromosome 20
  Distance between a terminus base of telomere on chromosomal short arm and 5'-terminus of this base sequence : 1932342
  Distance between 3'-terminus of neighbour sequence of sequence listing upward to telomere on chrosomal short arm and 5'-terminus of this base sequence : -320
caccccctgagtctactgttgcctcaagagcaaatagttcctgcatttgcctttcctctccttccgcagcctcctttacacacacacacacacacacacacacacacacacacatagaaggccaggagcagccttc

SEQ ID NO: 24339 - DNA, 295 bp, Homo sapiens
  AL034562.2_91105
  Located on chromosome 20
  Distance between a terminus base of telomere on chromosomal short arm and 5'-terminus of this base sequence : 1946751
  Distance between 3'-terminus of neighbour sequence of sequence listing upward to telomere on chrosomal short arm and 5'-terminus of this base sequence : 14273
agtattggcacaagtgattgagaagtctggagaccaagcacagattgaccatgggctcaaacaatatcccctagactggctagggattctcagcatcctcagctctggatgctcacctgctgatgtatgtctccctctctctctctctctctctctctctctctctctctctctctctctgccacttaccttcaggaggcagctgaagaaggggatctaataaagtagtctatgtattcctgggcttatccctgaaataagcatatatgcatccaatcctaaacatataccaaag

SEQ ID NO: 24340 - DNA, 195 bp, Homo sapiens
  Z16911.1_191
  Located on chromosome 20
  Distance between a terminus base of telomere on chromosomal short arm and 5'-terminus of this base sequence : 1990564
  Distance between 3'-terminus of neighbour sequence of sequence listing upward to telomere on chrosomal short arm and 5'-terminus of this base sequence : 43518
tgttaacagtggttgactctcagaggatgatgggatgacaggtgattttatcctattgcttcttcaaacttttctggtatgtctctacatcttaccagtttttgtgttacttttataataaacacacacacacacacacacacacacacacacacatatatacaatgaataaatatgtgacagcacctcttccac

SEQ ID NO: 24341 - DNA, 188 bp, Homo sapiens
  D20S113
  Located on chromosome 20
  Distance between a terminus base of telomere on chromosomal short arm and 5'-terminus of this base sequence : 1990567
  Distance between 3'-terminus of neighbour sequence of sequence listing upward to telomere on chrosomal short arm and 5'-terminus of this base sequence : -192
taacagtggttgactctcagaggatgatgggatgacaggtgattttatcctattgcttcttcaaacttttctggtatgtctctacatcttaccagtttttgtgttacttttataataaacacacacacacacacacacacacacacacacacatatatacaatgaataaatatgtgacagcacctctt

SEQ ID NO: 24342 - DNA, 483 bp, Homo sapiens
  AL031678.2_90137
  Located on chromosome 20
  Distance between a terminus base of telomere on chromosomal short arm and 5'-terminus of this base sequence : 2250009
  Distance between 3'-terminus of neighbour sequence of sequence listing upward to telomere on chrosomal short arm and 5'-terminus of this base sequence : 259254
atctaaacctagatcaacctgctcaaaagttgtaagttaagatgcaaaaagtcgtgatcaggcacagtggttcacacctgtaatcccaggactttgggaggctaaggcagagaatcacttgagcccaggagtgtgagaccagcctggacaacatagtgagacctcatctacacatacacacacacacacacacacacacacacacacacacacacaggagccaggcatcgtgacacatgcctgtagtcccagctacttgggaggctgagctgggggaattgcatgagtccgttagttgcaggctgcagtgatctgtgattgcgccactgcacttcagcctgggtgacacagcaaaagcctatctccaaaaaaaaaggcgaaaagtcaaagtgaattctttactttaatcctcttaaactaagtaattacccagaaatcctgtaacctttatttatttatttctatgtttcatggtttaggcat

SEQ ID NO: 24343 - DNA, 300 bp, Homo sapiens
  AL049712.12_35456
  Located on chromosome 20
  Distance between a terminus base of telomere on chromosomal short arm and 5'-terminus of this base sequence : 2571942
  Distance between 3'-terminus of neighbour sequence of sequence listing upward to telomere on chrosomal short arm and 5'-terminus of this base sequence : 321450
gtatccacaataactcctacaggttaaagtgaatatttaaatactaaaagaaatgttgtcaaaatcacgtatttcttgtgccctttagcctaaaagatctcctgagtccccttcacacatgggaagcctctctcaacatcccagctgacaccctacttctgactgctgtctacacacacacacacacacacacacacacacacacgcacacaccctaaaattcagaccctaaccctccctaagccctgttcttgctttctctgtccctcttctggagtgaatttcatctgtcttgctact

SEQ ID NO: 24344 - DNA, 227 bp, Homo sapiens
  D20S198
  Located on chromosome 20
  Distance between a terminus base of telomere on chromosomal short arm and 5'-terminus of this base sequence : 2596700
  Distance between 3'-terminus of neighbour sequence of sequence listing upward to telomere on chrosomal short arm and 5'-terminus of this base sequence : 24458
taggaacatcatgtaacccagactcccatctcccattcccacatcagtaaacttttaaattgtctctgggggcaagggacaaaagagaataatgtagttaaagccagaaacatttcatctattgcattttctgtgtgtgtgtgtgtgtgtgtgtgtgcgtgtgtgagagacacagggtctcactctgtcgcccaggctggagtgcagtggcacgacctgggctcact

SEQ ID NO: 24345 - DNA, 168 bp, Homo sapiens
  D20S842
  Located on chromosome 20
  Distance between a terminus base of telomere on chromosomal short arm and 5'-terminus of this base sequence : 2641349
  Distance between 3'-terminus of neighbour sequence of sequence listing upward to telomere on chrosomal short arm and 5'-terminus of this base sequence : 44422
agcgcacagccttcatcgacttcgtggaaaaggaccgagtgagaggctcatgggcttggctgggactggccccgggagggaacccccaaccacacacacacacacacacacacacacacacacacacacacacacacacacactgggacagatgaatggatggaagct

SEQ ID NO: 24346 - DNA, 203 bp, Homo sapiens
  chr20.fa.O7frz.2710348
  Located on chromosome 20
  Distance between a terminus base of telomere on chromosomal short arm and 5'-terminus of this base sequence : 2746659
  Distance between 3'-terminus of neighbour sequence of sequence listing upward to telomere on chrosomal short arm and 5'-terminus of this base sequence : 105142
agaacatatggtatttggctttccattccttagttacttcacttagaataatgacctccagttccatccaaaagacattatttcactcttttttatggctgagtagtattccatggtgtgtgtgtgtgtgtgtgtgtgtgtgtgtgtgtgtgtgtgcatgcacacacatagcacattccctctattcactcatcagttgatgg

SEQ ID NO: 24347 - DNA, 312 bp, Homo sapiens
  AL138803.3_91395
  Located on chromosome 20
  Distance between a terminus base of telomere on chromosomal short arm and 5'-terminus of this base sequence : 2892182
  Distance between 3'-terminus of neighbour sequence of sequence listing upward to telomere on chrosomal short arm and 5'-terminus of this base sequence : 145320
ccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaa

SEQ ID NO: 24348 - DNA, 385 bp, Homo sapiens
  chr20.fa.O7frz.2944668
  Located on chromosome 20
  Distance between a terminus base of telomere on chromosomal short arm and 5'-terminus of this base sequence : 2982716
  Distance between 3'-terminus of neighbour sequence of sequence listing upward to telomere on chrosomal short arm and 5'-terminus of this base sequence : 90222
cacttaggagtaatgcagtgagaatggatgaggcttgatttaaagtatagaagggtggctgggagcggtggttcacgcctgtaatcccagtactatgggaggccgaagcgggcgtatcacttgaggtcgggagttcgagtccagcctggccaagccccgtctctcctaaaaatacaaaaattagccgggcgtggtgtgcgccagtaatcgcagctactcgggaggctgaggcatgagaatcgcttgaacccaggaggcagaggttgcagtgagccgagatggcgccactgcactccatcctgggcgacagtgagactccgtctcaaaataaataaataaataaataaataaagtaatggggggaaggatgagttagagtgattca

SEQ ID NO: 24349 - DNA, 271 bp, Homo sapiens
  Z67154
  Located on chromosome 20
  Distance between a terminus base of telomere on chromosomal short arm and 5'-terminus of this base sequence : 3052791
  Distance between 3'-terminus of neighbour sequence of sequence listing upward to telomere on chrosomal short arm and 5'-terminus of this base sequence : 69690
caccaagcactgacaatcacaaggacttctactagacaggcagagtgggtattccaatactattcaattgttccacagcacagaaaagaaaaaattctaaattctttctatggaacaaaaaaatcatcaatgacacctgaccaaagatggcacacacacacacacacacacacacacacacacacacacactacagtccaaccccactaatgaatacaaaaatcctaacactagcaaacagaaccattaaaatctattaacaggggccagg

SEQ ID NO: 24350 - DNA, 240 bp, Homo sapiens
  AL121891.22_32394
  Located on chromosome 20
  Distance between a terminus base of telomere on chromosomal short arm and 5'-terminus of this base sequence : 3052799
  Distance between 3'-terminus of neighbour sequence of sequence listing upward to telomere on chrosomal short arm and 5'-terminus of this base sequence : -263
actgacaatcacaaggacttctactagacaggcagagtgggtattccaatactattcaattgttccacagcacagaaaagaaaaaattctaaattctttctatggaacaaaaaaatcatcaatgacacctgaccaaagatggcacacacacacacacacacacacacacacacacacacacactacagtccaaccccactaatgaatacaaaaatcctaacactagcaaacagaaccatt

SEQ ID NO: 24351 - DNA, 160 bp, Homo sapiens
  D20S181
  Located on chromosome 20
  Distance between a terminus base of telomere on chromosomal short arm and 5'-terminus of this base sequence : 3127520
  Distance between 3'-terminus of neighbour sequence of sequence listing upward to telomere on chrosomal short arm and 5'-terminus of this base sequence : 74481
atccctctaagcatgggcaccctccaggtttgcattctgatctgatctgttctcggtggctggaaaaacactgtacacactcctgtaggacagccttgctcccctgacacacacacacacacacacacacacactcactatcacccattgacagagaccc

SEQ ID NO: 24352 - DNA, 300 bp, Homo sapiens
  chr20.fa.O7frz.3162970
  Located on chromosome 20
  Distance between a terminus base of telomere on chromosomal short arm and 5'-terminus of this base sequence : 3170813
  Distance between 3'-terminus of neighbour sequence of sequence listing upward to telomere on chrosomal short arm and 5'-terminus of this base sequence : 43133
acatgtccactccagacacattggggcaggcacggagtgcaataatgcagatgagactgcctggcccctgccctcccaaagtagggaacacagggaaggcagagaagctgcagtatccacgtctctctctctctctctctctctctctctcacacacacacacacacacacacacacacacacacacacacacacgctgccttgtgggcacagggtcttagagctccgcctccccaggagggcaggtggggagaagcatcgaggctgagagacccaggacaggtatcagacaaggtctag

SEQ ID NO: 24353 - DNA, 150 bp, Homo sapiens
  D20S193
  Located on chromosome 20
  Distance between a terminus base of telomere on chromosomal short arm and 5'-terminus of this base sequence : 3268501
  Distance between 3'-terminus of neighbour sequence of sequence listing upward to telomere on chrosomal short arm and 5'-terminus of this base sequence : 97388
ggtatcttttggtgcgtgtgcgtgcgtgcatgcgtgtgtgcgtgtgtgcgtgtggtgtgtgtgtgtgtgtgtgtgtgtgtgtgtgtgtgtggtttaaaccttggctatattgtgagggtgctgttggatactcagttagcccagggatgc

SEQ ID NO: 24354 - DNA, 343 bp, Homo sapiens
  AL117334.29_20535
  Located on chromosome 20
  Distance between a terminus base of telomere on chromosomal short arm and 5'-terminus of this base sequence : 3285673
  Distance between 3'-terminus of neighbour sequence of sequence listing upward to telomere on chrosomal short arm and 5'-terminus of this base sequence : 17022
gtgctagccaagtactgactctacttctggccctagacataaagcacaaggcaacactgctgggaagacaatgtaaacattgtctacttgctgcccagactatcagacacacagacacacagacacacagacacacagacacacacacacacacacacacacacacacacacaaattctggccaggtatggtggctcatgcctgcaatcccagcactttgggaggctgagggggaggatcatttgggcccaggagttcgagatcagcctgggcaacatagtgacaccccatctctaccaaaaaaattccttttagtcatcatgtaggtgacagtgctgatagt

SEQ ID NO: 24355 - DNA, 197 bp, Homo sapiens
  AL117334.29_88579
  Located on chromosome 20
  Distance between a terminus base of telomere on chromosomal short arm and 5'-terminus of this base sequence : 3353750
  Distance between 3'-terminus of neighbour sequence of sequence listing upward to telomere on chrosomal short arm and 5'-terminus of this base sequence : 67734
gcaattgtgaaactattaccactccctccccaaatcagtgtcattccatgaccacagaaaattctgggagactctcaatgaaaagtaataacaaaataacaacatacacacacacacacacacacacacacacacacaagtcgagacccttttgcagtcaaatccctcacctaaccctaggcaaccactgatttcat

SEQ ID NO: 24356 - DNA, 359 bp, Homo sapiens
  AL109805.14_11148
  Located on chromosome 20
  Distance between a terminus base of telomere on chromosomal short arm and 5'-terminus of this base sequence : 3420319
  Distance between 3'-terminus of neighbour sequence of sequence listing upward to telomere on chrosomal short arm and 5'-terminus of this base sequence : 66372
tttcacctgatgttgagataagcctggggaaatctgtcatctttattatagagggtctttccatccttcgcatccttctggaaagatgctttatatttccagtttaggtctcatatctttcagtaaattcttatagcttttttcaaatgatctgacacacttttattagatttactactcgatagagaattttgttattactagaaactaattgattactatagtacctaggaatggattttaaaattattattattattattattattattattattattattgcactgagtaatatttagctcatgagtatctgtatttatctgggcacctctctgaagtctggtaaacttattcac

SEQ ID NO: 24357 - DNA, 180 bp, Homo sapiens
  D20S473
  Located on chromosome 20
  Distance between a terminus base of telomere on chromosomal short arm and 5'-terminus of this base sequence : 3420448
  Distance between 3'-terminus of neighbour sequence of sequence listing upward to telomere on chrosomal short arm and 5'-terminus of this base sequence : -230
cttatagcttttttcaaatgatctgacacacttttattagatttactactcgatagagaattttgttattactagaaactaattgattactatagtacctaggaatggattttaaaattattattattattattattattattattattattattgcactgagtaatatttagctcatga

SEQ ID NO: 24358 - DNA, 379 bp, Homo sapiens
  AL109805.14_18407
  Located on chromosome 20
  Distance between a terminus base of telomere on chromosomal short arm and 5'-terminus of this base sequence : 3427659
  Distance between 3'-terminus of neighbour sequence of sequence listing upward to telomere on chrosomal short arm and 5'-terminus of this base sequence : 7031
ttacgtggactctttcaaagagattatagttacagagacctgatagccaacaggttgaatgtaagccttatttgtgcttatttttgcctaatattcagggccctgtgagagattctggttgttgaatatacaagaagggttgagagcatattctagataggggagtgtgtgtgtgtgtgtgtgtgtgtgtgtgtgtgtgtatccgttctctgggcagggaggggaatatggtaggagcaaaagcacaagagaggtaggagtgggcactgagtgtctgggggaccatgagaattggcttcgcaggtgagaggagaaggattgacattcttaatagttagaatgtcaggaacaggaggagttcagacttcattccacagtc

SEQ ID NO: 24359 - DNA, 383 bp, Homo sapiens
  AL132773.14_40500
  Located on chromosome 20
  Distance between a terminus base of telomere on chromosomal short arm and 5'-terminus of this base sequence : 3523441
  Distance between 3'-terminus of neighbour sequence of sequence listing upward to telomere on chrosomal short arm and 5'-terminus of this base sequence : 95403
ggtttgcattgaatctactgaccaatttggggtgtattgcctgtttgtttgtttgtttgtttgtttgtttgtttgttgagagagggtctcactctgtcacccaggctggagcgcagtggtgctatcttggctcactgcagcctccgctttcccaggctcaagtgattctccagcctcagcctctcgagtaactggtactacaggcatgagctaccaacacccagctaatttttatatttttttagagacagggtttcgccatgttgcccaggctggtcttgaactcctgagctcaaagcaatcctcctgcctctgcctccctaagttctgggattacaggtgtgagccaccacgcctggcccttgccatcttaacaaggttaa

SEQ ID NO: 24360 - DNA, 185 bp, Homo sapiens
  AL132773.14_62387
  Located on chromosome 20
  Distance between a terminus base of telomere on chromosomal short arm and 5'-terminus of this base sequence : 3545326
  Distance between 3'-terminus of neighbour sequence of sequence listing upward to telomere on chrosomal short arm and 5'-terminus of this base sequence : 21502
ctatcagtggatgaatggataaacaaaatgtggtatgtatgtatgtgtgtgtgtgtgtgtgtgtgtgtgtgtgtgtgtgtataaaataaaatgttattcagcattaaaaaggaatgaaattctgatacatgcgacaacacaagtgaaccttgaaaacatgctaagtgaaataagctagttgcaag

SEQ ID NO: 24361 - DNA, 271 bp, Homo sapiens
  D20S867
  Located on chromosome 20
  Distance between a terminus base of telomere on chromosomal short arm and 5'-terminus of this base sequence : 3631725
  Distance between 3'-terminus of neighbour sequence of sequence listing upward to telomere on chrosomal short arm and 5'-terminus of this base sequence : 86214
tacaggcatgagccatggtgcccggcctgagggaggatttttatagagactatatatatacacacacacaaacacacacacacacacacacacacacgtatgtgtatataaataaagaatatgaatatattatgcataagaatacacataatgtatatttgtatgtgtatatactcatacataaacatatatgcataatataaatatacatatgtatgagaatgtttactatgtaacaaaattatatgatcacaaaacaagttatttcaga

SEQ ID NO: 24362 - DNA, 246 bp, Homo sapiens
  AC017113.4_148473
  Located on chromosome 20
  Distance between a terminus base of telomere on chromosomal short arm and 5'-terminus of this base sequence : 3672645
  Distance between 3'-terminus of neighbour sequence of sequence listing upward to telomere on chrosomal short arm and 5'-terminus of this base sequence : 40649
gtgagctgagaactgagatcacgccactgcactccagcctgggggacagagtgagactctgcctcaaaaataaataaataaataaataaataaataaataaataaataaataaatatgaaatacatgttctgattcagcaggtctgggctggggcctgaggttctgcatttctaacaagcttccaggtgataccaatgctgctgatcctcagcccacactttgagtaacaaagctgttgatggttt

SEQ ID NO: 24363 - DNA, 280 bp, Homo sapiens
  AL353194.13_17703
  Located on chromosome 20
  Distance between a terminus base of telomere on chromosomal short arm and 5'-terminus of this base sequence : 3814276
  Distance between 3'-terminus of neighbour sequence of sequence listing upward to telomere on chrosomal short arm and 5'-terminus of this base sequence : 141385
ggtcaggatttcgagactagactggccaacatgttgaaaccccatctctactaaaaatacaaaagaaaagtagctgggtgtcgtggtgcacagccgtaatcccagctactcgggaagccggggcaggagaatcgcttgaacctgggaggaggaagttgcggtgagctgaggtcgtgtcactgcactccagcctgggtgacagagtgagactctgtcacacacacacacacacacacacacacacacacacacacaaattccagttaaccaagcatagaag

SEQ ID NO: 24364 - DNA, 266 bp, Homo sapiens
  D20S889
  Located on chromosome 20
  Distance between a terminus base of telomere on chromosomal short arm and 5'-terminus of this base sequence : 3901989
  Distance between 3'-terminus of neighbour sequence of sequence listing upward to telomere on chrosomal short arm and 5'-terminus of this base sequence : 87433
catctttcaaatgggataatgggatattcaaatgggataatctaacaactttaaggaattcctgaaaggataaaatgagatagcagataatgaagtgtctgaaaactcaaagaggacaaaactattaaggctttagtgtgtgtgtgtgtgtgtgtgtgtgtgtgtgtgtgtgtttggggaaagggaatgacattaaatgaaagtagtaaataccataaaggaagccttgacaaaaatcatgtctctggagaggattccaccaaacc

SEQ ID NO: 24365 - DNA, 272 bp, Homo sapiens
  AL031670.6_33091
  Located on chromosome 20
  Distance between a terminus base of telomere on chromosomal short arm and 5'-terminus of this base sequence : 3950262
  Distance between 3'-terminus of neighbour sequence of sequence listing upward to telomere on chrosomal short arm and 5'-terminus of this base sequence : 48007
ctgtttgaaataacatcaggtaaagaattgggtaaaggtgtgatgaagttatatcccctccccttttcctcataccctttttgacaatctctgattctctcatttcatagatgtccctttcacttgaatgcgcacacacacacacacacacacacacacacacacacacatcattaggtctccagaaacaaaggagggtccttaattctccggcctgtggaaccacacacgccccctgcccacagatggtgactttcattaatgagtaagcc

SEQ ID NO: 24366 - DNA, 361 bp, Homo sapiens
  chr20.fa.O7frz.4135144
  Located on chromosome 20
  Distance between a terminus base of telomere on chromosomal short arm and 5'-terminus of this base sequence : 4078840
  Distance between 3'-terminus of neighbour sequence of sequence listing upward to telomere on chrosomal short arm and 5'-terminus of this base sequence : 128306
cacaagatatgaccttagttgaagataaggcatgatatattgtttgtgtgtatgtgtgtatgtatatatatacaccgtatattgtgtgtgtgtgtgtatattacacacacaatatactgtgtatatatatacgcacacacacacgatattgtgtatgtacatatacacccacacatacacacacgattatattgtgtatgtgtatacacacacacacacacacacacacacacacatgtttttgtccatggttcttagttcataactcccatagcccttattatttcctaaatgaccaaaacatatcttttgttaaaattatttgtccttttgtctttggttcctgaagtagcttcagaac

SEQ ID NO: 24367 - DNA, 446 bp, Homo sapiens
  AL139350.17_43439
  Located on chromosome 20
  Distance between a terminus base of telomere on chromosomal short arm and 5'-terminus of this base sequence : 4234840
  Distance between 3'-terminus of neighbour sequence of sequence listing upward to telomere on chrosomal short arm and 5'-terminus of this base sequence : 155639
aaacctaccatattctaggcactttctgggtgctagggagacaaagattgaaaataagttttcgtgcttgagaagctcacagcctggtgggagaaacatacccacaaatagcccctccaggagcatgccattttggagcaaccaaccttgcctgaaaagatgggctgggaaagttccccagtagagttgacattgagccaaacttcaatgttgagtggaatgagggagatgactgatgtctttggtgatgatgatgatgatgatgatgatgatgatcatgatggtcattatgaagagaaagaagatggtaaaactcacaggggtggtaatgatgaacagggagaccaccattatcaggatgtggtggtgggctgagggaggtccctcaccttggtgactctgttggttatagagaccaggcagtgatatcagtcatcctgaactag

SEQ ID NO: 24368 - DNA, 422 bp, Homo sapiens
  AC021974.4_182814
  Located on chromosome 20
  Distance between a terminus base of telomere on chromosomal short arm and 5'-terminus of this base sequence : 4333853
  Distance between 3'-terminus of neighbour sequence of sequence listing upward to telomere on chrosomal short arm and 5'-terminus of this base sequence : 98567
gagacaacttatggattggtagaacatatttgcaaaccatacatctgataaagggctaatatccaaaatctataaggaactcaaacaactcaacagcaaaacaaacaaacaacaacaacaacaacaacaaaacctgattaaaaagtgggcaaacgacatgaacagacatttctcaaaataagacatacaaattacatcacattttttatttccaagattcctagttggctcttttgtcagacagcatgttcttatttgatagatatttatgtttctccttgtcccaggtgttggtttttcttctttgttgagttgggattctgtttgtgaatggtgttagtttccctcaagactttgattagccgtgtgtgtgtgtgtgtgtgtgtgtgtgtgtgtgtgtgtatttctctatttgaagcctg

SEQ ID NO: 24369 - DNA, 316 bp, Homo sapiens
  AL139350.17_142571
  Located on chromosome 20
  Distance between a terminus base of telomere on chromosomal short arm and 5'-terminus of this base sequence : 4334092
  Distance between 3'-terminus of neighbour sequence of sequence listing upward to telomere on chrosomal short arm and 5'-terminus of this base sequence : -183
gacagcatgttcttatttgatagatatttatgtttctccttgtcccaggtgttggtttttcttctttgttgagttgggattctgtttgtgaatggtgttagtttccctcaagactttgattagccgtgtgtgtgtgtgtgtgtgtgtgtgtgtgtgtgtgtgtatttctctatttgaagcctgcatttgttacctgcagcctatctccagtaggagcagggatggatatgatgccaattgtgtaagatattatctgggcttgatggctgcctgccccttttggaaaccactagcctttatgataaagcactggcac

SEQ ID NO: 24370 - DNA, 445 bp, Homo sapiens
  AL121781.38_132602
  Located on chromosome 20
  Distance between a terminus base of telomere on chromosomal short arm and 5'-terminus of this base sequence : 4419012
  Distance between 3'-terminus of neighbour sequence of sequence listing upward to telomere on chrosomal short arm and 5'-terminus of this base sequence : 84604
acagaactcaggaacatgctacacttatgatgacagttttattatgaaggatatagatcaggaacagccaaatgaagggatgcacagagcaaagttagagggatgcagagcttctctccctgtggaatcgggaggcatttgcccgacacatctgtgctttcaccaacaatgaagctccactgagctttggcctagagtttttactggggtttcattatataggcataattgagtaaattattggctacatctttgaactcaatcttcagcctctctcccctcctcagaggtccctctgacccaaatttccaatctctccttccttccttccttccttccttcctccctccctccctccctttcctgagtcacctcattagcatagcaaagatacttctctcactcaggatgttgcaagggtttttgaaactatgccaggaactag

SEQ ID NO: 24371 - DNA, 157 bp, Homo sapiens
  D20S482
  Located on chromosome 20
  Distance between a terminus base of telomere on chromosomal short arm and 5'-terminus of this base sequence : 4461286
  Distance between 3'-terminus of neighbour sequence of sequence listing upward to telomere on chrosomal short arm and 5'-terminus of this base sequence : 41829
gaacctaaaactctaaggaagcgtgtactagagttcttcagagacaccgaaccaataagagatagatagatagatagatagatagatagatagatagatagatagatagatagatagagatttattataggaattgattcatgtggatatggaggct

SEQ ID NO: 24372 - DNA, 337 bp, Homo sapiens
  AL121916.14_1327
  Located on chromosome 20
  Distance between a terminus base of telomere on chromosomal short arm and 5'-terminus of this base sequence : 4466343
  Distance between 3'-terminus of neighbour sequence of sequence listing upward to telomere on chrosomal short arm and 5'-terminus of this base sequence : 4900
acattatgtacaacagccaagatatgaaaccaacctaagtatccattgatggaaaaatgaattttaaaaactgtggggtaattaattatagatatatctctatctatgcctctctctcttttcctccctccctctctctctctctatctctttctctctctctctccctctctctctcacacacacacacacacacacacacacacacacacacacacatatacacatacacacatactggaatattattcagcctttaaatagaggaaaaatctgccatttgtgacaacaaaggttaaactggaggacattatgctaagtgcagccagttagacac

SEQ ID NO: 24373 - DNA, 272 bp, Homo sapiens
  D20S97
  Located on chromosome 20
  Distance between a terminus base of telomere on chromosomal short arm and 5'-terminus of this base sequence : 4479222
  Distance between 3'-terminus of neighbour sequence of sequence listing upward to telomere on chrosomal short arm and 5'-terminus of this base sequence : 12542
tatacgcacccataccaccatcaccacaatcaaggtaataaatatacccatcaacccctgaagttccttgtgtctctgtgctttagtgtgtgtgtgtgtgtgtgtgtgtgtgtgtgtgtgatcatgtatcatgagatctactctcctcaatgtttaagtgaaaacactgtattattaaccacaggcacaatgttgtacagcagatctctagaatttattcatcttgtataatggtgactttatacccactgagcaacaactctccatctccc

SEQ ID NO: 24374 - DNA, 434 bp, Homo sapiens
  HUMUT235A
  Located on chromosome 20
  Distance between a terminus base of telomere on chromosomal short arm and 5'-terminus of this base sequence : 4485774
  Distance between 3'-terminus of neighbour sequence of sequence listing upward to telomere on chrosomal short arm and 5'-terminus of this base sequence : 6280
gtttctctgttcagcacttcagttttctcatctacacacggaaattattagattagatgattgctcaagtctcaccaagttttaacattttctttctttttccctcccttcctccctttctctccctctccctctctttctttctctctctctctttctccccttctttctttctttctctctctctttttctttctttctttctttctttctctctctccctctctttctttctctctctccctctctttctctctttctctctttctctctttctctctttctctctctctctctctctttctttctttctttctttctttctttctttctttctttctttctttctttctttctttcacttctttctttctttctgtcacccaggcaactccagtgcacaccactggagtatagccatatgaactcactgc

SEQ ID NO: 24375 - DNA, 359 bp, Homo sapiens
  AL133396.1_108993
  Located on chromosome 20
  Distance between a terminus base of telomere on chromosomal short arm and 5'-terminus of this base sequence : 4604609
  Distance between 3'-terminus of neighbour sequence of sequence listing upward to telomere on chrosomal short arm and 5'-terminus of this base sequence : 118401
aaactcctgacctcaagtgactgcccacctcggcctcccaaagtgctgggatttataggcataagcgcctggccacaattttacatttctacactgtaaaggtatgtttgtgcttgtgtgtgtgtgtgtgtgtgtgtgtgtgtgtgtgtgtgtgtgtcttaaatgaaatcaaaagaaaatatctgtaatgaaaaagaccaaaattaatttcccacttatcaaaaagtttgcataaatcagtagtgagaaaaaccaccttattaaaaaaattagagaagtatgtgaacagacttattacagggcaaaaaatacaaatgatcaatacacatgaaaagatgtccaaccttccaataacataa

SEQ ID NO: 24376 - DNA, 413 bp, Homo sapiens
  chr20.fa.O7frz.4798334
  Located on chromosome 20
  Distance between a terminus base of telomere on chromosomal short arm and 5'-terminus of this base sequence : 4713078
  Distance between 3'-terminus of neighbour sequence of sequence listing upward to telomere on chrosomal short arm and 5'-terminus of this base sequence : 108110
acaaatgttcagtaacaaggtaagttctagggatctaatatacagtgctgtgactatagttaatagtactgtattgtttacttgtaattcactaagaaagtagatctttgacattttgggctggatgaagaaaaaaacagtagatctgaagtgtcctgacatcacacacacatacacacacacacacacacacacacaatggcaactgtgtgatgatggacgtgttaatgtgatgtggtaatcgtttcacaatgtatatgcgaaatgtgtatgtacaacaatcatcaggttgtacaccttgaatatatgtcatttttatttgccagttatgccacaataaaactgaaaaataaatactttttaaattaaaaaataataatattcatgtttatggcttatgaattagtaagtcc

SEQ ID NO: 24377 - DNA, 161 bp, Homo sapiens
  DISO7_10004476
  Located on chromosome 20
  Distance between a terminus base of telomere on chromosomal short arm and 5'-terminus of this base sequence : 4805082
  Distance between 3'-terminus of neighbour sequence of sequence listing upward to telomere on chrosomal short arm and 5'-terminus of this base sequence : 91591
ttggaaaggcaagataacagaaaatcaaagtagtgctctctatctctctctctctctctatatatatatatagacagagctactttgattttatctatctaatctccaaatgacacacacacacacacacaccccaaaaaaagcaaagaacaagtgcagtg

SEQ ID NO: 24378 - DNA, 222 bp, Homo sapiens
  D20S895
  Located on chromosome 20
  Distance between a terminus base of telomere on chromosomal short arm and 5'-terminus of this base sequence : 5041641
  Distance between 3'-terminus of neighbour sequence of sequence listing upward to telomere on chrosomal short arm and 5'-terminus of this base sequence : 236398
cccagggaggtaaaggttgtgccactgcactctagcttggatgacagagcaagaccctgtctcaaaaaaaacagaccactgggacggacaaacacacacacacacacacacacacacacacacacacacacacgcacactagagccttggctaacattttaaaaatctcacaacttattcccacatgcccgtcagcttacccctttgctgatgtagcctgac

SEQ ID NO: 24379 - DNA, 230 bp, Homo sapiens
  D20S849
  Located on chromosome 20
  Distance between a terminus base of telomere on chromosomal short arm and 5'-terminus of this base sequence : 5149101
  Distance between 3'-terminus of neighbour sequence of sequence listing upward to telomere on chrosomal short arm and 5'-terminus of this base sequence : 107238
tggcacacgtttacctacataacaaacctgtacgtcctgcacctgtatcctggaacttaaaatcaaataaattttttttaaaaaaaggtagtgtgtgtgtgtgtgtgtgtgtgtgtgtgtgtgtgtgtgtgtgtatgcctgcatgaggcggcagggggcggggggagggggcggtgaggaggagagacagagtccaacttccccgttgccttcctgaaggtatgagcagc

SEQ ID NO: 24380 - DNA, 322 bp, Homo sapiens
  AL121755.23_40948
  Located on chromosome 20
  Distance between a terminus base of telomere on chromosomal short arm and 5'-terminus of this base sequence : 5149124
  Distance between 3'-terminus of neighbour sequence of sequence listing upward to telomere on chrosomal short arm and 5'-terminus of this base sequence : -207
aaacctgtacgtcctgcacctgtatcctggaacttaaaatcaaataaattttttttaaaaaaaggtagtgtgtgtgtgtgtgtgtgtgtgtgtgtgtgtgtgtgtgtgtgtatgcctgcatgaggcggcagggggcggggggagggggcggtgaggaggagagacagagtccaacttccccgttgccttcctgaaggtatgagcagctcatcctctcatcctccctgtctgtccctaggaagccacagcaagtttttgctgatgctttagggatagggatttgagtcctcttagaaacaaatagaaccagtgagcacttcat

SEQ ID NO: 24381 - DNA, 242 bp, Homo sapiens
  AL121757.7_149039
  Located on chromosome 20
  Distance between a terminus base of telomere on chromosomal short arm and 5'-terminus of this base sequence : 5269799
  Distance between 3'-terminus of neighbour sequence of sequence listing upward to telomere on chrosomal short arm and 5'-terminus of this base sequence : 120353
aattagattcgttattgcaaacagcctgccaagggggtctgccaccttgatgccaccaattctcccagcttctgcattaccttttattttaatatgagaatagaatggctcaagccttcatctcataaactctgggtatccctttattccccttcctggtatctccaaaggtccatggtgtgtgtgtgtgtgtgtgtgtgtgtgtgtgtgtgtgtggtgtgtaaaggaagtgatgcaggata

SEQ ID NO: 24382 - DNA, 210 bp, Homo sapiens
  D20S835
  Located on chromosome 20
  Distance between a terminus base of telomere on chromosomal short arm and 5'-terminus of this base sequence : 5269903
  Distance between 3'-terminus of neighbour sequence of sequence listing upward to telomere on chrosomal short arm and 5'-terminus of this base sequence : -138
atggctcaagccttcatctcataaactctgggtatccctttattccccttcctggtatctccaaaggtccatggtgtgtgtgtgtgtgtgtgtgtgtgtgtgtgtgtgtgtggtgtgtaaaggaagtgatgcaggatagggggcacttctttttatttttatttttaatattttaagttccagattcatgtgcaggacatgcaggtttgt

SEQ ID NO: 24383 - DNA, 375 bp, Homo sapiens
  AL121757.7_29190
  Located on chromosome 20
  Distance between a terminus base of telomere on chromosomal short arm and 5'-terminus of this base sequence : 5389612
  Distance between 3'-terminus of neighbour sequence of sequence listing upward to telomere on chrosomal short arm and 5'-terminus of this base sequence : 119499
gcatgctcgttaagagtcatcaccactccctaatctcaagtacccagggacacaaacacggcagaaagccgcagggacctcttcctaggaaaaccagagacctttgttcatgtgtttatctgctgaccttctctccactattgtcctacgaccctgccacatccccctctctgagaaacacccaagaatgatcaataaatactaaaatatatatatatatatatatatatatatatatatatatatatatattctttgggcaatcattattctaaccctaggttagttttttatgagtctctgaagcattttcattacagcagcaatctgacaggtttttctggactgtagtttgaatcaagtgtttaaatgaac

SEQ ID NO: 24384 - DNA, 276 bp, Homo sapiens
  AL109935.39_7722
  Located on chromosome 20
  Distance between a terminus base of telomere on chromosomal short arm and 5'-terminus of this base sequence : 5426536
  Distance between 3'-terminus of neighbour sequence of sequence listing upward to telomere on chrosomal short arm and 5'-terminus of this base sequence : 36549
atgactgatttgaccagtaaagatacaaaagccattttttgatttagattgtttattatgtacgtagacgtagacactgaaaggaagaatagtcaaaggtgacagctccctgtggttcttgtcccccaaccacatccctacacacacacacacacacacacacacacacacacacacacatacacacacacgaaactgaaatgaaaggagccagatgactgcaagacaagttggagggtacccactgctgaggatccaattctgcaactctgttat

SEQ ID NO: 24385 - DNA, 416 bp, Homo sapiens
  AL118504.3_35355
  Located on chromosome 20
  Distance between a terminus base of telomere on chromosomal short arm and 5'-terminus of this base sequence : 5430727
  Distance between 3'-terminus of neighbour sequence of sequence listing upward to telomere on chrosomal short arm and 5'-terminus of this base sequence : 3915
tttgagtgtcatgatttggagagtcgctgtggctgttccaagcaaggagagaggggagaaggaaacagctacaggaggaggagcagcagggaggaggggcattggccattccatactgctctggaaggctcttcttatttatttatttatttatttatttatttatttattcatgtttttttgagacagggtctcactccggttgcccaggctggagtgtactggtgcgatctcagctcactgcagccttgaccttccaggctcaggtgattctcccacctcagcctcccaagtggctgtaaccacacatgcgtgccaccatgcttggctaatttgttgtattttcagtaaagatggggtttcaccttttgccacacttaaagtatcattgggtctgttgagtcagaaggacaagt

SEQ ID NO: 24386 - DNA, 379 bp, Homo sapiens
  AL118504.3_6670
  Located on chromosome 20
  Distance between a terminus base of telomere on chromosomal short arm and 5'-terminus of this base sequence : 5460362
  Distance between 3'-terminus of neighbour sequence of sequence listing upward to telomere on chrosomal short arm and 5'-terminus of this base sequence : 29219
ctgccatagccttgacaacatggcaaaaccccatctctacagaaaatacaaaaattagccaggtgtagtggtgcatgcctgtggtcccagctactcgggaggcctgagcccaggaggcagaggttgcagtcagccaagatcatgccactgtgctccagcctggggcaacagagcaagaccctgtcaaaaaaaaaaagaaaaaagaaaagaaaagaaagagaggaagggagggaggaaagaaggaaggaaggaaggaaggaaggaaggaaggaaggaaggaaggaaggaaaagcattgccttagagcaaagacaactgtgacccgaattgttgcaacaaattatgatgtaataatcctgagatctagccacttacagaac

SEQ ID NO: 24387 - DNA, 345 bp, Homo sapiens
  AL109935.39_121475
  Located on chromosome 20
  Distance between a terminus base of telomere on chromosomal short arm and 5'-terminus of this base sequence : 5540161
  Distance between 3'-terminus of neighbour sequence of sequence listing upward to telomere on chrosomal short arm and 5'-terminus of this base sequence : 79420
caacttcaaccaagagctatttatatttttaaaagcaatatttaatgtctttgcagttttatggtgggattgtttttgtttttgttttaaagtaactttagtgcgggggggggggggcgggaaagaaacaagtgaaaaagcaaaaaaataaaccaggcacagtgcctcatgcctgtaatacaaacacttaaggaggctgaggcaggaggatgacttgagcccaggagtttgagaccaatttgggcaatatagtgaggcctcatgtctacacacacacacacacacacacacacacacacgccaggcatggggagcatgcctgtagttccagctacagattgagac

SEQ ID NO: 24388 - DNA, 199 bp, Homo sapiens
  D20S873
  Located on chromosome 20
  Distance between a terminus base of telomere on chromosomal short arm and 5'-terminus of this base sequence : 5551848
  Distance between 3'-terminus of neighbour sequence of sequence listing upward to telomere on chrosomal short arm and 5'-terminus of this base sequence : 11342
cggttgctgagactatgggtggacatcaccatgcctggctaatttggggtatgtgtgtgtgtgtgtgtgtgtgtgtgtgtgtgtgtgttagagatgtagtctcactatgttgcccaggatcatagagtgattttttttttttttgagacgagatcttactctgtcacccaggctgaagtgcaagtgatgcaatctcagc

SEQ ID NO: 24389 - DNA, 120 bp, Homo sapiens
  D20S882
  Located on chromosome 20
  Distance between a terminus base of telomere on chromosomal short arm and 5'-terminus of this base sequence : 5590191
  Distance between 3'-terminus of neighbour sequence of sequence listing upward to telomere on chrosomal short arm and 5'-terminus of this base sequence : 38144
ctgtgcctctcaacaactgctgtcagctacacaaagacccagctaaagctccaaaatgaatattgtgtgtgtgtgtgtgtgtgtgtgtgtagttattacttcgggctatttgtcctacat

SEQ ID NO: 24390 - DNA, 94 bp, Homo sapiens
  D20S95
  Located on chromosome 20
  Distance between a terminus base of telomere on chromosomal short arm and 5'-terminus of this base sequence : 5671386
  Distance between 3'-terminus of neighbour sequence of sequence listing upward to telomere on chrosomal short arm and 5'-terminus of this base sequence : 81075
aaagcaaggcttcgtcttaaaaaaaaaaaaaatcacacacacacacacacacacacacacacacacacacgcacgcacacaataaaatgaagaa

SEQ ID NO: 24391 - DNA, 176 bp, Homo sapiens
  AL117377.18_73965
  Located on chromosome 20
  Distance between a terminus base of telomere on chromosomal short arm and 5'-terminus of this base sequence : 5671386
  Distance between 3'-terminus of neighbour sequence of sequence listing upward to telomere on chrosomal short arm and 5'-terminus of this base sequence : -94
aaagcaaggcttcgtcttaaaaaaaaaaaaaatcacacacacacacacacacacacacacacacacacacgcacgcacacaataaaatgaagaaattttgcatgacaaaaagtacaataagcaaactaaaaaataaccccaccataaataaagtcaaaagacaggtaaatgacttg

SEQ ID NO: 24392 - DNA, 224 bp, Homo sapiens
  AL035249.6_73549
  Located on chromosome 20
  Distance between a terminus base of telomere on chromosomal short arm and 5'-terminus of this base sequence : 5752999
  Distance between 3'-terminus of neighbour sequence of sequence listing upward to telomere on chrosomal short arm and 5'-terminus of this base sequence : 81437
ttatcaacttgatcctttcaagacttgtttttaagctcacgggatattttctctctctctctctctctctctctctctctctctctctgtgtgtgtgtgtgtgtgtgtgtgtgtgtgtgtgtgtgtgttgggattacaggcgtgagccactgcatccagcctaaactcactagggagattttttgaatagcctgtactctgtagctagtttagcttgctaccaa

SEQ ID NO: 24393 - DNA, 407 bp, Homo sapiens
  HUMUT760B
  Located on chromosome 20
  Distance between a terminus base of telomere on chromosomal short arm and 5'-terminus of this base sequence : 5776578
  Distance between 3'-terminus of neighbour sequence of sequence listing upward to telomere on chrosomal short arm and 5'-terminus of this base sequence : 23355
tattcttagggcttgttctggccttagtcaatggaacacctacaaccataaataaaagatatttattagtttctttgttcattcattcattcatttattcattcactgaaacaaatatttagtgaatgtcttgtcaaggcatgtttcagtagccttaggatagtggttaccaattagaaccatctaggaatctttttgaaaaaacttaatttctatgccacatccataacttactgaaaatagcgagtgtgtgtgtgtgtgtgtgtgtgtgtgtgtgtgcacatgcatatgtatacataaatatttttttaattggaataccatttacatatagtaaagtacataaatcttatgtgttacagtttggtgaatttttatatatgtgggtgtatacccacataaccact

SEQ ID NO: 24394 - DNA, 269 bp, Homo sapiens
  AC027092.2_35471
  Located on chromosome 20
  Distance between a terminus base of telomere on chromosomal short arm and 5'-terminus of this base sequence : 5785665
  Distance between 3'-terminus of neighbour sequence of sequence listing upward to telomere on chrosomal short arm and 5'-terminus of this base sequence : 8680
cttatgcctgtaatctcagcactttgggaggccggagcaggaggatcacctgagcccaggaattcaagaccagcctgggcaacacagcaagaccccgtctcaataataataataataataataataataataataataattaactgagacaacaggcctaaaccaggactgtcctgggcaaactttccagtcactctattgagtaccagtccctctagtaagagcacacgtttatggaaaggaatgcctgaagttgaaaggttagcaga

SEQ ID NO: 24395 - DNA, 275 bp, Homo sapiens
  AC027092.2_69822
  Located on chromosome 20
  Distance between a terminus base of telomere on chromosomal short arm and 5'-terminus of this base sequence : 5811234
  Distance between 3'-terminus of neighbour sequence of sequence listing upward to telomere on chrosomal short arm and 5'-terminus of this base sequence : 25300
acaagcctgttagtcctagctactagggaggctgaggtggaaggttgtttgggcccaggagttcaaggctacagtgagctataattgcaccaccgcaatccagcctgggtgacagtgagaccctatttctaaataaataaataaataaataaataaataaataaataaataaacaaaaaacaggggtgactatattgatatcatataaaatgaacttcaaagcaaagaaaacatattacacaattatgaaacaatcaatctgacaaagcaatctt

SEQ ID NO: 24396 - DNA, 268 bp, Homo sapiens
  D20S916
  Located on chromosome 20
  Distance between a terminus base of telomere on chromosomal short arm and 5'-terminus of this base sequence : 5817113
  Distance between 3'-terminus of neighbour sequence of sequence listing upward to telomere on chrosomal short arm and 5'-terminus of this base sequence : 5604
ctgctgtgagccatgattgtgccattgcactccagcctggggggcagagtgagaccctgtctcaaacacacacacacacacacacacacacacacacacacacacaacctcttacacctgccttgtctttttcttcccaacaccatcacctgcatcattttcatctccttaaggacctcctgaaggttttccctgctgccagttctccccttttcagcctcttccattcactgttgctaccacgttgattttcccaaatcaccgaggg

SEQ ID NO: 24397 - DNA, 89 bp, Homo sapiens
  D20S905
  Located on chromosome 20
  Distance between a terminus base of telomere on chromosomal short arm and 5'-terminus of this base sequence : 5818636
  Distance between 3'-terminus of neighbour sequence of sequence listing upward to telomere on chrosomal short arm and 5'-terminus of this base sequence : 1255
tcagcagatcccaccaccacctccctctgtgtgtgtgtgtgtgtgtgtgtgtgtgtgtgtgtgtgcgccaagacactgctcctcaagct

SEQ ID NO: 24398 - DNA, 243 bp, Homo sapiens
  AL035461.11_87742
  Located on chromosome 20
  Distance between a terminus base of telomere on chromosomal short arm and 5'-terminus of this base sequence : 5930040
  Distance between 3'-terminus of neighbour sequence of sequence listing upward to telomere on chrosomal short arm and 5'-terminus of this base sequence : 111315
tgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcag

SEQ ID NO: 24399 - DNA, 277 bp, Homo sapiens
  AL035461.11_132525
  Located on chromosome 20
  Distance between a terminus base of telomere on chromosomal short arm and 5'-terminus of this base sequence : 5974764
  Distance between 3'-terminus of neighbour sequence of sequence listing upward to telomere on chrosomal short arm and 5'-terminus of this base sequence : 44481
catgtctgaggaatttatgctaactagattttgggcttttgcagcgaattttagtcggggcctcattcctgagcccaagtgaccctttcacctcagcttcccaagtagctgggattacaggtgcacaccaactgtgctttgcagttttgtttgtgtgtgtgtgtgtgtgtgtgtgtgtgtgtgtgtgtgtgtgtattttgttttttttacaagcccacaacatcatagctttgcagtttttaaccaggagctggtggagatctttgaaatcatttag

SEQ ID NO: 24400 - DNA, 393 bp, Homo sapiens
  20_6272305
  Located on chromosome 20
  Distance between a terminus base of telomere on chromosomal short arm and 5'-terminus of this base sequence : 6059863
  Distance between 3'-terminus of neighbour sequence of sequence listing upward to telomere on chrosomal short arm and 5'-terminus of this base sequence : 84822
cattagaacttagactgtggtcagtgcgcgcgcgcgcgcgcgcacaaacacacacacacacacacacacacacacacacacacatatatttttttgagatggagtcttgttctgtccccaggcaggagtgcagtggcacgatcttggctcactgctgcaccctccgcctcccgggttcaagtgattctcctgcctcagtctcccgagcagctgggactacaatttttgtatttttagtagagaccaggtttcatgatgttggccaggatggtcttgatctcttgaccttgtgatctacctgcctcggcctcccaaagtgttaagattacaggtgtgatccaccgtgcccagcctgtggtcaagattttatgtgtgaccttgaattatggctct

SEQ ID NO: 24401 - DNA, 401 bp, Homo sapiens
  AL109618.1_26725
  Located on chromosome 20
  Distance between a terminus base of telomere on chromosomal short arm and 5'-terminus of this base sequence : 6168448
  Distance between 3'-terminus of neighbour sequence of sequence listing upward to telomere on chrosomal short arm and 5'-terminus of this base sequence : 108192
actcctatgcaaggtctattgtagggtgagatttttctctgttctgttttctatgttagtcttttttgttccttcttccttccttccttccttcctctctctttcttctttcttttcttttcttcttttcttttctttctttctctctctctctccccctccctcccttccttccttcttccttccttcctctctctctttccttccttccttcctctctctttctttccttccttccttcctctctctctttccttccttccttccttccttcctccttccctccctccctccctccctccctccctccctccctcccttccttccttccttccttccttccttccttccttccttccttccttccttcctaccttccttccttccttcgtcttgctctg

SEQ ID NO: 24402 - DNA, 232 bp, Homo sapiens
  chr20.fa.O7frz.6706738
  Located on chromosome 20
  Distance between a terminus base of telomere on chromosomal short arm and 5'-terminus of this base sequence : 6258865
  Distance between 3'-terminus of neighbour sequence of sequence listing upward to telomere on chrosomal short arm and 5'-terminus of this base sequence : 90016
caaacattgaaccattacttctaggagaaatacaaggttagttgcctgtcagactctggtcacaatattttcatccatcgattaatatataaccttgttttatgtgtgtttctgtttaaagacagtttatatatatatatatatatatgtgtgtgtgtatgtgtatatatatgtatatgtatatataaatgtatatgtatatatatagagtattaaccttgaactcatgacc

SEQ ID NO: 24403 - DNA, 480 bp, Homo sapiens
  AL158093.8_94122
  Located on chromosome 20
  Distance between a terminus base of telomere on chromosomal short arm and 5'-terminus of this base sequence : 6339579
  Distance between 3'-terminus of neighbour sequence of sequence listing upward to telomere on chrosomal short arm and 5'-terminus of this base sequence : 80482
tcaatatgtatttcaagacagcacaacctgccccagaataaccatatctttaaaaatacaggtttttatttaccctggagtagtggtatgggtagtggactgtgagccagggtatgcacgttctaggtcctgttctgaggtcatcgcccttgtcactttaggtaaactgcttaacctctccagaccttctttacctgccttgattacgttggggctttttcatgtggaacgtctggatgttgaacagatttttggatgacacatacacacacacacacacacacacacacacacacaccctaaagttccgtgcaaaatcttaaatgtagttgtgaggcaagagaatccacagcttttcttagattttcaaaggctacgtgactgtaaagagattgtgaacttttgacttgaatgatctatctctacgtgtccttcctagaccagaaatttttctaattgtagtttgttagcaagctcagc

SEQ ID NO: 24404 - DNA, 155 bp, Homo sapiens
  chr20.fa.O7frz.6908799
  Located on chromosome 20
  Distance between a terminus base of telomere on chromosomal short arm and 5'-terminus of this base sequence : 6460958
  Distance between 3'-terminus of neighbour sequence of sequence listing upward to telomere on chrosomal short arm and 5'-terminus of this base sequence : 120899
caatatcagtagcagtaatggaacaaggctctgattcccaagcagcctgcactggtgtcggcaatggctgggccacaccccaggctggcaaggtggtgtgtgtgtgtgtgtgtgtgtgtgtgtgtgtgtgtgtgtatgcgtgtggtagttgtagt

SEQ ID NO: 24405 - DNA, 472 bp, Homo sapiens
  AL035668.15_48758
  Located on chromosome 20
  Distance between a terminus base of telomere on chromosomal short arm and 5'-terminus of this base sequence : 6632153
  Distance between 3'-terminus of neighbour sequence of sequence listing upward to telomere on chrosomal short arm and 5'-terminus of this base sequence : 171040
gacatgaataggctgaacttctactgcatatacaagtttttccagccttttccatctccctgaattagttcattgtgaaataggttgcctgatggctgaaaaagacaaaaaacttcaagagttttggcactcctcaagtcttccatgccgcctctgtttgttgtatagtattagtgaatcgcaatgtggcacacaccgatcatcctaaaaatatgtccagaaaagttgcatagattgtgtgtggccctgtgtgtgtgtgtgtgtgtgtgtgtgtgtgtgcatatgtatgtgtatgtttatacatctagcttcttcccccattctcccaccaacactgtttgggtagccagccccccatcctctctaaagcccccatgccctgcagtaaacactgaggccagggctgtgtggcaggactcccagccaagcaatagtaactcctgctgctgccttgagtaaccaggaattctcc

SEQ ID NO: 24406 - DNA, 291 bp, Homo sapiens
  D20S192
  Located on chromosome 20
  Distance between a terminus base of telomere on chromosomal short arm and 5'-terminus of this base sequence : 6652029
  Distance between 3'-terminus of neighbour sequence of sequence listing upward to telomere on chrosomal short arm and 5'-terminus of this base sequence : 19404
tgctgtgtagaaaacttgaactgaatctttctctctctccctctctgtctcacacacacacacacacacacacacacacacacacacacaccttccccaggagtagcccaggataaaaatgaataatacattaatttttaaaacatgaagttcattcaggcttctcctgcctaacaatttctttaaaatatataactaaaaagaggattgtttcacttggtatataccattttttttctcacagaagattctgatcctgagaaatatgcctgggattttggggatgactgt

SEQ ID NO: 24407 - DNA, 185 bp, Homo sapiens
  HUMUT970
  Located on chromosome 20
  Distance between a terminus base of telomere on chromosomal short arm and 5'-terminus of this base sequence : 6656163
  Distance between 3'-terminus of neighbour sequence of sequence listing upward to telomere on chrosomal short arm and 5'-terminus of this base sequence : 3843
cggaaaagtgcatgcactggacaaaaagaccaacagatatatctatacatctatctatctatctatctatctatctatctatctatctatctatctatctatctatctatcatcagacacacaagggaagaatgccatgtgatgacagaggcagagactgaggtgctgcagctgcaagccaagaa

SEQ ID NO: 24408 - DNA, 209 bp, Homo sapiens
  D20S892
  Located on chromosome 20
  Distance between a terminus base of telomere on chromosomal short arm and 5'-terminus of this base sequence : 6705132
  Distance between 3'-terminus of neighbour sequence of sequence listing upward to telomere on chrosomal short arm and 5'-terminus of this base sequence : 48784
tatcttgactgcactgtggggatgcgggatggagctgcctttcgagacacccctgagggtaggggcctgggacacaagtcataagtggcttcagaagttgtggccttgagcttacagggtctggaagctataagggtgtgtgtgtgtgtgtgtgtgtgtgtgtgtgtgtgtcaggaagttctatacagtgcctctaaggaagtcacatg

SEQ ID NO: 24409 - DNA, 269 bp, Homo sapiens
  D20S846
  Located on chromosome 20
  Distance between a terminus base of telomere on chromosomal short arm and 5'-terminus of this base sequence : 6719985
  Distance between 3'-terminus of neighbour sequence of sequence listing upward to telomere on chrosomal short arm and 5'-terminus of this base sequence : 14644
tagcccggtgtgtggaaactataccctcatcctgcattacacattttctcattgctttttactcactcctgacttcctttcctgatatctacaattgagactttttctgttttaattgtctcaaaatgagttgctatctttgcatgttgagaatctaacacacacacacacacacacacacacgtgcacgcatacatactcatgaagttaagtgtctgtattgtttcactttgttttgggtggagtctcttttcggcacttggttgcta

SEQ ID NO: 24410 - DNA, 261 bp, Homo sapiens
  AL035668.15_162787
  Located on chromosome 20
  Distance between a terminus base of telomere on chromosomal short arm and 5'-terminus of this base sequence : 6746356
  Distance between 3'-terminus of neighbour sequence of sequence listing upward to telomere on chrosomal short arm and 5'-terminus of this base sequence : 26102
agctctaggtaaattcaaccaatcaaaaaacaggcaaatcaaatacaaaaaaatttatattgtatcaaaaatttgtgtgtgtgtgtgtgtgtgtgtgtgtgtgtgtgtgtatgccagtcttgccatgaacctcttggtcagtattgaaataatgttccagaaacaaggctacttttgttgagtaaaaaatcaacacaaatgccctgtcctttgaaaatgttagatgcatcttatactgtgtattcctaaacagttgcaagc

SEQ ID NO: 24411 - DNA, 173 bp, Homo sapiens
  AL034554.8_67481
  Located on chromosome 20
  Distance between a terminus base of telomere on chromosomal short arm and 5'-terminus of this base sequence : 6846641
  Distance between 3'-terminus of neighbour sequence of sequence listing upward to telomere on chrosomal short arm and 5'-terminus of this base sequence : 100024
gttgctaggaaataaacactgaattattcagaacataatgcctgcaacttactctcaaaaggttcaagcactacaaaagtgtgtgtgtgtgtgtgtgtgtgtgtgtgtgtttggaaagacaggaaataataaaggaaatcaagtaaaatgtaaactatttgtgcatctggatt

SEQ ID NO: 24412 - DNA, 176 bp, Homo sapiens
  AL096799.6_21746
  Located on chromosome 20
  Distance between a terminus base of telomere on chromosomal short arm and 5'-terminus of this base sequence : 7040900
  Distance between 3'-terminus of neighbour sequence of sequence listing upward to telomere on chrosomal short arm and 5'-terminus of this base sequence : 194086
gcactcatattggttgctaaaccattgaaaaagtttaatattttatccctggcatatcacctttgttacacacacacacacacacacacacacacacacacacacacacacacagtactgatacattgttataaagctaagttaaaagttctgaagcctggaaattctagaataag

SEQ ID NO: 24413 - DNA, 285 bp, Homo sapiens
  AL096799.6_52949
  Located on chromosome 20
  Distance between a terminus base of telomere on chromosomal short arm and 5'-terminus of this base sequence : 7071990
  Distance between 3'-terminus of neighbour sequence of sequence listing upward to telomere on chrosomal short arm and 5'-terminus of this base sequence : 30914
atccatgcactgcaataacagcccataaaaagtggctggctaatttccaaagagtaaaaggaagctcaggttaaaaaggaaatatggttcatgtcccaccagagtcaccaaaaaagagaaaaaataaagaaggaaggaaagaaggaaggaaggagggagggagggagagagagggagacaaagagaagagaagagaagagaagagaagagaagagaaaagaagagaaaagaaaagaagagagatgtggtctttgcaatctggggtctggatagatgtaaatgctg

SEQ ID NO: 24414 - DNA, 344 bp, Homo sapiens
  chr20.fa.O7frz.7599879
  Located on chromosome 20
  Distance between a terminus base of telomere on chromosomal short arm and 5'-terminus of this base sequence : 7151853
  Distance between 3'-terminus of neighbour sequence of sequence listing upward to telomere on chrosomal short arm and 5'-terminus of this base sequence : 79578
cattactgaaacttggtcaagtgaagtggaatgagcactgggctcagagtgaggagttacaatccagttctgccataaacacatgaccctgtttaggtcactaaagattactattaagaagcttagactttggaaaaatatttttgttggttaatgcattaaatgaaacattgtatgataaaacacctgtagtcccagctatgagggaggctgaggcaggagaattgcttgagcccaggagttcaagaccagcctggggcaacatagcgagagcccacctcaaaacaaaacaaaacaaaacaaaacaaattgtatgataaaacataattgcagcttatgttaat

SEQ ID NO: 24415 - DNA, 284 bp, Homo sapiens
  G10052
  Located on chromosome 20
  Distance between a terminus base of telomere on chromosomal short arm and 5'-terminus of this base sequence : 7281129
  Distance between 3'-terminus of neighbour sequence of sequence listing upward to telomere on chrosomal short arm and 5'-terminus of this base sequence : 128932
gagaaccttcatagagttgtggcaaggattaattgagctaatgcttacacagttttaaaactttgcctagcatgtagtaaatgtcagctgttgtttacttgtctcccttctgtcttcccaaatcatcaccattttgactctgtattatctacctatccatctatctatctatctatcatctatctatctatctatctatctatctatctatctatctatctctctatctatctatcatctatctatctatatctagttctatttctctggagaactattggttg

SEQ ID NO: 24416 - DNA, 401 bp, Homo sapiens
  AL078643.5_72285
  Located on chromosome 20
  Distance between a terminus base of telomere on chromosomal short arm and 5'-terminus of this base sequence : 7282398
  Distance between 3'-terminus of neighbour sequence of sequence listing upward to telomere on chrosomal short arm and 5'-terminus of this base sequence : 985
ggaattagaaaccaggtctgttggacagaagccaaggcccatcccagtcagtagaatgggagagatgacacaccattttgtcatcattcaaataacccctttcaggtcagaatctcctaaattctctaaagaaaagtattacaggagagtgctggccaggtggagagactcacagaatcagatacacacacacacacacacacacacacacacacacacacacgtgtgtatatagactgtatgcactgtgtatacatatacttcttcaaaatatattcctattataaactagggaatacaatttgaggaaatgtaaaaatgaacatgtactttttttggtttgtgtatttgattgagccaagcctgggacagatgacctctgaactggagtaatatggtgt

SEQ ID NO: 24417 - DNA, 172 bp, Homo sapiens
  AL078643.5_38108
  Located on chromosome 20
  Distance between a terminus base of telomere on chromosomal short arm and 5'-terminus of this base sequence : 7316654
  Distance between 3'-terminus of neighbour sequence of sequence listing upward to telomere on chrosomal short arm and 5'-terminus of this base sequence : 33855
gtcaaatactagctggttcttgatgggaagctcaggtcacctggtaacttactagcccatgttaagcacccagcctctacaaaggccaagtagcaggccaagaactgctacacacacacacacacacacacacacacacacacaaagagtagctaactacagaggacagcat

SEQ ID NO: 24418 - DNA, 141 bp, Homo sapiens
  D20S900
  Located on chromosome 20
  Distance between a terminus base of telomere on chromosomal short arm and 5'-terminus of this base sequence : 7316705
  Distance between 3'-terminus of neighbour sequence of sequence listing upward to telomere on chrosomal short arm and 5'-terminus of this base sequence : -121
ctagcccatgttaagcacccagcctctacaaaggccaagtagcaggccaagaactgctacacacacacacacacacacacacacacacacacaaagagtagctaactacagaggacagcatggcaggatattgctccaaaa

SEQ ID NO: 24419 - DNA, 167 bp, Homo sapiens
  AL078643.5_5339
  Located on chromosome 20
  Distance between a terminus base of telomere on chromosomal short arm and 5'-terminus of this base sequence : 7349465
  Distance between 3'-terminus of neighbour sequence of sequence listing upward to telomere on chrosomal short arm and 5'-terminus of this base sequence : 32619
gcaagtaccttaaaccactgttagaaaatatttagttaaacagactgacagatcacacaaacacacacacacacacacacacacacacacacacacacacaccataggctctgaagtataaaagaaaaaaataagcaaaccctctaggcctcagatttcttatcttt

SEQ ID NO: 24420 - DNA, 403 bp, Homo sapiens
  chr20.fa.O7frz.7883277
  Located on chromosome 20
  Distance between a terminus base of telomere on chromosomal short arm and 5'-terminus of this base sequence : 7435229
  Distance between 3'-terminus of neighbour sequence of sequence listing upward to telomere on chrosomal short arm and 5'-terminus of this base sequence : 85597
gaaagacagctggagttaagaccttgttgataataaatacacataacatgttttattttagttattatatgtagtcttatggaaaaataagtctctatttattcacaataatggggcatgctagcttttaaaataatgagttctgagtaaattaacttgacaaagataagatgagggcaagtaaaaattctataatgcctgcattctctcttttctcctatctctgtttaatacagcccaattatatttccatgaggatataataagacaagagatttcatttaagaagggggattgggtgggagagagagagagagagagagagagagagagatcctctagcaaaaatccagggattataaagatgaattcaacctttgactcagtttcatggtatctgaaa

SEQ ID NO: 24421 - DNA, 483 bp, Homo sapiens
  AL096769.7_3918
  Located on chromosome 20
  Distance between a terminus base of telomere on chromosomal short arm and 5'-terminus of this base sequence : 7533719
  Distance between 3'-terminus of neighbour sequence of sequence listing upward to telomere on chrosomal short arm and 5'-terminus of this base sequence : 98087
cttgagtgaacataggccatagccagggagtggatataacaggctttggttgagatccagtactgtgctggcttcaggtatgactcactgcagtctcaatggtagtggccacaggtgtgcttgtgtcacaccatcacaccacccagagctccaggtggctcagaacagagagagagagagagagagagagagagagagagaagcagacagacagacagactctgttcatttgggagaaagtaaggcaagggaacaagtgtttttgcctagtaatccagaaaattcgtccagctctccaataccattaaggtggtatatccacaagtctgcaagaagcacagtgttagtgggcttggggtgccccctaaagcaaatagaccttagatcaaacacccaagtccttttgaatatttagaaagcattctcaagaagaatgcttggaagcccagactaagaagactacaatacatgcctaacatttca

SEQ ID NO: 24422 - DNA, 418 bp, Homo sapiens
  AL031653.5_128616
  Located on chromosome 20
  Distance between a terminus base of telomere on chromosomal short arm and 5'-terminus of this base sequence : 7547139
  Distance between 3'-terminus of neighbour sequence of sequence listing upward to telomere on chrosomal short arm and 5'-terminus of this base sequence : 12937
atgaatgcttagccttcattattttgacaataaaaatttaaggccatatatttcttttaaaatactcttctgctgaattccataaagggtgtgtgtgtgtgtgtgtgtgtgtgtgtgtgtgtgttttaaattaatagactatattttcaagcatagtctcaggtttgcaaatatattgaacagatagtatagagggttcccatatattttcttttcccctacagttttctccaattaacatattgcattaatgagaacatttgttatagcaaatgaagcactatgagtacatcattattaactaaagtccatagtactacatattaggtttaaaagcctacgagagtcttctacctaacaaaagcctaatctctaagggtacggaatttgccagatgacgattctaagacattatcct

SEQ ID NO: 24423 - DNA, 232 bp, Homo sapiens
  D20S115
  Located on chromosome 20
  Distance between a terminus base of telomere on chromosomal short arm and 5'-terminus of this base sequence : 7614998
  Distance between 3'-terminus of neighbour sequence of sequence listing upward to telomere on chrosomal short arm and 5'-terminus of this base sequence : 67441
tctgtccagaactgtcatattgagaaatgaaacccatcaacaaattattcacatgtgttatctccctctgtgtgtgtgtgtgtgtgtgtgtgtgtgtataatttcatgaaaataaagatatttagaaaaaacaaagaaaaacttagttgataggagtctaggattaagtgagtctaagagagtttaattcaggaatacaacgttgagggcaagataataaaactaactccgg

SEQ ID NO: 24424 - DNA, 204 bp, Homo sapiens
  Z16995.1_149
  Located on chromosome 20
  Distance between a terminus base of telomere on chromosomal short arm and 5'-terminus of this base sequence : 7614999
  Distance between 3'-terminus of neighbour sequence of sequence listing upward to telomere on chrosomal short arm and 5'-terminus of this base sequence : -231
ctgtccagaactgtcatattgagaaatgaaacccatcaacaaattattcacatgtgttatctccctctgtgtgtgtgtgtgtgtgtgtgtgtgtgtataatttcatgaaaataaagatatttagaaaaaacaaagaaaaacttagttgataggagtctaggattaagtgagtctaagagagtttaattcaggaatacaacgttg

SEQ ID NO: 24425 - DNA, 390 bp, Homo sapiens
  AL031653.5_37633
  Located on chromosome 20
  Distance between a terminus base of telomere on chromosomal short arm and 5'-terminus of this base sequence : 7638036
  Distance between 3'-terminus of neighbour sequence of sequence listing upward to telomere on chrosomal short arm and 5'-terminus of this base sequence : 22833
ggctacagaggtttctattcctacaccatgatgttcctcctctctagttgtcatcggcaatggcttccactccataatgagacaagccggaaattgcagctgctactccatcatgcctgttctctctctctctttctctctctctcctctctctctctctctctctctctctcacacacacacacacacacacacacacacacacacacagagcaggtcacattgctaataatatatatcaccctgttactgggatatcctgagaggcagtgtattcccaaaatcccaaacaggaaaaacagtaactgcacttgttttctttcccttaactgattgacaaagacaccctacaagatttgagagaggaatgtaaaggcactgcatgaatct

SEQ ID NO: 24426 - DNA, 197 bp, Homo sapiens
  AL031653.5_5066
  Located on chromosome 20
  Distance between a terminus base of telomere on chromosomal short arm and 5'-terminus of this base sequence : 7670685
  Distance between 3'-terminus of neighbour sequence of sequence listing upward to telomere on chrosomal short arm and 5'-terminus of this base sequence : 32259
aactaattccatgcaaatcaattgagttatcactatatgtattatatgtatatattatatatatattttatatatattatatatatattatacacacacacacacacacacacacacacacacacacagaggtatattatatttgctgaaagagatagacaatcgtccctgacttctcaaaggtgaaattcttgtga

SEQ ID NO: 24427 - DNA, 194 bp, Homo sapiens
  Z66937
  Located on chromosome 20
  Distance between a terminus base of telomere on chromosomal short arm and 5'-terminus of this base sequence : 7711193
  Distance between 3'-terminus of neighbour sequence of sequence listing upward to telomere on chrosomal short arm and 5'-terminus of this base sequence : 40311
ggaaaattgaatatgtatcctctagtctaatacatacacacacacacacacacacacacatatgtataatgaaagacttactggatctaaataatatatgttatccacgtattatgcccctcacagatacacacagacatacacacatatatttaataaaaaagatctgaatgaaattctgcttccaatttggc

SEQ ID NO: 24428 - DNA, 301 bp, Homo sapiens
  AL021879.3_33657
  Located on chromosome 20
  Distance between a terminus base of telomere on chromosomal short arm and 5'-terminus of this base sequence : 7859757
  Distance between 3'-terminus of neighbour sequence of sequence listing upward to telomere on chrosomal short arm and 5'-terminus of this base sequence : 148370
ttaaagccaaggaattaaactgtgttcgcataatggcccctcagtacacttaaccattatcccatgattttggtttggtttagtttgggttgtgttgttgttgttgttgttgttgttgttgttgtttgtttgtttagcttgcttatctgggatttgtccagcttcctagatctcagatcagaagcagaagtgaataataaataaaaataaaatggtataagatgaagaagagagcgcttactcaaagctgagaaagcacaagttatcaattataaaatagtttccaaatgtttaatgtcaa

SEQ ID NO: 24429 - DNA, 243 bp, Homo sapiens
  D20S907
  Located on chromosome 20
  Distance between a terminus base of telomere on chromosomal short arm and 5'-terminus of this base sequence : 8012348
  Distance between 3'-terminus of neighbour sequence of sequence listing upward to telomere on chrosomal short arm and 5'-terminus of this base sequence : 152290
tcattggacaggcagagaaaaccaagtgacaggctctttgaggttaagtgtataattttcagaggattgaaaggcttcattcaggatgaatacaagttagttccattgtagatgtggtcccacatttccacacataaatctcagtccatacttcattcactacaaatacacacatggcaattaataacacacacacacacacacacacacatataaatacatatgaataatacaaattcagcc

SEQ ID NO: 24430 - DNA, 245 bp, Homo sapiens
  AL021406.1_30472
  Located on chromosome 20
  Distance between a terminus base of telomere on chromosomal short arm and 5'-terminus of this base sequence : 8116458
  Distance between 3'-terminus of neighbour sequence of sequence listing upward to telomere on chrosomal short arm and 5'-terminus of this base sequence : 103867
tggtacctctaaacattgcaacccttaaaactcatgctatgtgtgaataattaatgccacaggaaatacttatgagacattaaatttaaaaaaggaattgcatttgtcattttttcatacattcataatgtaaaagtgtgtgtgtgtgtgtgtgtgtgtgtgtgtgtatgtatgtgtgcgtgtgtgtgtaaagaagaatatgattgggaggccgagagaggcggattacctgaggtcaggagttc

SEQ ID NO: 24431 - DNA, 199 bp, Homo sapiens
  AL021406.1_34303
  Located on chromosome 20
  Distance between a terminus base of telomere on chromosomal short arm and 5'-terminus of this base sequence : 8120377
  Distance between 3'-terminus of neighbour sequence of sequence listing upward to telomere on chrosomal short arm and 5'-terminus of this base sequence : 3674
tttcttacctatcagattgtcaacatttcgaaagtttggcaatacctttattattattattattattattattattattattattatactttaagttctgggatacatgtgcagaatgtgcaggtttgttacataggtatatatgtcccatggtggtttgctgcacccatcaacccgtcatctgcattaggtatttctc

SEQ ID NO: 24432 - DNA, 207 bp, Homo sapiens
  Z67291
  Located on chromosome 20
  Distance between a terminus base of telomere on chromosomal short arm and 5'-terminus of this base sequence : 8183200
  Distance between 3'-terminus of neighbour sequence of sequence listing upward to telomere on chrosomal short arm and 5'-terminus of this base sequence : 62624
ggccaggctaagattcaaattccagtgccaccatttataaataacatgagtgaacttagacaatttaatacagcacacacacacacatacacgcaaacacacacacacacacacacacacacttttgcctaatacctggaacatagtagtaaatgctcaatatttttttactctcaaaagcaagggcagcataggaaatgaccctct

SEQ ID NO: 24433 - DNA, 306 bp, Homo sapiens
  AL121589.17_5464
  Located on chromosome 20
  Distance between a terminus base of telomere on chromosomal short arm and 5'-terminus of this base sequence : 8210860
  Distance between 3'-terminus of neighbour sequence of sequence listing upward to telomere on chrosomal short arm and 5'-terminus of this base sequence : 27453
actttgttaaatgtccagtaccaggtttgctttgcatcagcgtgagtgtgtgtgtgtgtgtgtgtgtgtgtgtgtgtgtgtgaagcggcacatggtcaggcttcattagctttctcaaatcattctgaagcagtggatgaattcttcccttaattcaaagaaattattgtttcctattgtcctcagtgagaagcatctttgctattactcagactagggaaactaccaggacacccattcaacttgtttctttctcaatttgtggttatgaacaagaattctcagtaagtttggactcaaccattg

SEQ ID NO: 24434 - DNA, 252 bp, Homo sapiens
  AL050319.8_2001
  Located on chromosome 20
  Distance between a terminus base of telomere on chromosomal short arm and 5'-terminus of this base sequence : 8393277
  Distance between 3'-terminus of neighbour sequence of sequence listing upward to telomere on chrosomal short arm and 5'-terminus of this base sequence : 182111
agaattccaagtttgtcaagtaatgaactgcatgatattcctggtctctttattcaaagtcatctcctacttatacccctaatgtgtgcgcgcacacacacacacacacacacacacacacacacgtacacaccatcttgccttccaggcaccctcagccacctttactactcctggcatgctgtctcctgcacaagtctcattgcctttaccctctgtggaatttccctctctgtgctcttaccagatcac

SEQ ID NO: 24435 - DNA, 306 bp, Homo sapiens
  AL031655.7_152787
  Located on chromosome 20
  Distance between a terminus base of telomere on chromosomal short arm and 5'-terminus of this base sequence : 8398775
  Distance between 3'-terminus of neighbour sequence of sequence listing upward to telomere on chrosomal short arm and 5'-terminus of this base sequence : 5246
ggatcagtctgacctagtacagagcagtgtgtgtgtgtgtgtgtgtgtgtgtgtgtgtgtgtctgtgtatgtgtgtgtgctcctgcatgcttttaattatatattgaagatatgctaaaatatttataatgcctctcaaagattcaaagaataataataaaataagcagctttccctaccttagagaccttctgtgtacccttcccttatcccttcattttcttccctaccaacataaccactgatctgaattttgcatttacttttctcattcttctcttacagtcatactacataccaggcagc

SEQ ID NO: 24436 - DNA, 353 bp, Homo sapiens
  AL031655.7_114053
  Located on chromosome 20
  Distance between a terminus base of telomere on chromosomal short arm and 5'-terminus of this base sequence : 8437474
  Distance between 3'-terminus of neighbour sequence of sequence listing upward to telomere on chrosomal short arm and 5'-terminus of this base sequence : 38393
atagtatgcggtatgccactattttttttaaaaaagatatatcgcatatatatatatatatatatatatatatatatatatatatatatatatatatgactttttcttgcttgtattatccctatgttttattttattctccaaagttgatattgttttcttctaaggaatgcaattccaaaaaaacaaatattgaaaccaataaagacataaaatttatggttaatagcttcatttcatttgttaaatgtaattaacgtatctttttattactaagattatttaccattttaatgtatataatgactattgcattagattttatttttaaaatgctgttacgcaaacttaaa

SEQ ID NO: 24437 - DNA, 369 bp, Homo sapiens
  AL031655.7_99259
  Located on chromosome 20
  Distance between a terminus base of telomere on chromosomal short arm and 5'-terminus of this base sequence : 8452095
  Distance between 3'-terminus of neighbour sequence of sequence listing upward to telomere on chrosomal short arm and 5'-terminus of this base sequence : 14268
catctcctatggaagtgaacagaaatgagtgatcatttcagaacaacaacctactctatcagagatagtttcccttttatacatgtaagtacaataatgttgaaagtctctgagtttattttcataacatgctaaatagccacagtcttatttagccaaattacaaacattggaattgcatggtttcttttagaatctaaggtttttatagaaaatataacatcatatatatatatatatatatatatatatatatatatatatatatatgtattccattttgatgctatatactactagtcagtcacctgtaagagtttttgactaaagttttcggcaagatagatatagttgagtcatggtcaaggt

SEQ ID NO: 24438 - DNA, 251 bp, Homo sapiens
  D20S879
  Located on chromosome 20
  Distance between a terminus base of telomere on chromosomal short arm and 5'-terminus of this base sequence : 8519930
  Distance between 3'-terminus of neighbour sequence of sequence listing upward to telomere on chrosomal short arm and 5'-terminus of this base sequence : 67466
aattctgtacctatggggtgaactcatcaattacgtcaaactcaaacataggtttcaaaaccaggacttgtgcatacttcatctttagtttcttctttctcaaattttactgcttagtaaggtatagcttacatagagtacagtgagtaaattttaagtgttatgttttgactaatttacacaaacacacacacatacacacacacagacacacacacacacacacacacacgtggagcccccatccatat

SEQ ID NO: 24439 - DNA, 444 bp, Homo sapiens
  chr20.fa.O7frz.9056513
  Located on chromosome 20
  Distance between a terminus base of telomere on chromosomal short arm and 5'-terminus of this base sequence : 8608452
  Distance between 3'-terminus of neighbour sequence of sequence listing upward to telomere on chrosomal short arm and 5'-terminus of this base sequence : 88271
tgtgttaccagaccttatttaaagttacattcagctgggcacggtggctcacatctgtaatcccagcactttgggaggttgaggtgggtggataacttgagatcaggagttcaagatcagcctggccaacatggtgaagccctatctctactaaaaatataaaaattagcctagcatggtgatgcgcgcctgtaatcccagctactcaggaggctgaggcaggagaatcgcttgaacctgggaggcagaggttgcagtgagccgagatcgtgccactgcactccagcctgggcgacagagccagagtccatcccaaaaataaataaataaataaataaataaataaataaataaataaagtcacattcatgaactcagtggaaagtgagagcctattaaattatttcagatactttacttgtgaacctaataggaaattctacc

SEQ ID NO: 24440 - DNA, 445 bp, Homo sapiens
  AL031683.2_12989
  Located on chromosome 20
  Distance between a terminus base of telomere on chromosomal short arm and 5'-terminus of this base sequence : 8679981
  Distance between 3'-terminus of neighbour sequence of sequence listing upward to telomere on chrosomal short arm and 5'-terminus of this base sequence : 71085
gccattgtctctaaggaataagcacttgcttcaagagaacatttcaacactaccatatttcagcctactttttctattgtctgactcacatgttcttgtgagtgagctgaaatttatctaaaattgtttcaaatagctgggtgtgctgacacatgcctgtaatcccagctactcgggagcctgaggcaggggaattgcttgagtccaggagacagaggctgcaattaactatgaatgcactactataccctagcctgggccacagagaccatgtctcttaaaaataaaataaataaaataaaataaaataaaataaaataaaataaaataaaaaaataaaattgtttgtaaatatttcctgattcagtgtatggccccgattcgatatagcaattgagctaaaggtctcataatggaacattttactaatggtgcttcagagatc

SEQ ID NO: 24441 - DNA, 96 bp, Homo sapiens
  D20S177
  Located on chromosome 20
  Distance between a terminus base of telomere on chromosomal short arm and 5'-terminus of this base sequence : 8750202
  Distance between 3'-terminus of neighbour sequence of sequence listing upward to telomere on chrosomal short arm and 5'-terminus of this base sequence : 69776
ccacctatccacctatggtatgtacttgcatgtgtgtgtgtgtgtgtgtgtgtgtgtgtgtgtaaacatatttaaaaggcaggtttactcattgct

SEQ ID NO: 24442 - DNA, 306 bp, Homo sapiens
  AL031683.2_82950
  Located on chromosome 20
  Distance between a terminus base of telomere on chromosomal short arm and 5'-terminus of this base sequence : 8750203
  Distance between 3'-terminus of neighbour sequence of sequence listing upward to telomere on chrosomal short arm and 5'-terminus of this base sequence : -95
cacctatccacctatggtatgtacttgcatgtgtgtgtgtgtgtgtgtgtgtgtgtgtgtgtaaacatatttaaaaggcaggtttactcattgcttttggtacagttctctaaactaaagaagcttatgttggtacttttattgtccatgaaattatattatgaaacaataacaggtaggaaggatgggttcccataaatatcctcttactctctttgcattttgtatcatgtgcactactaatctcttacatttgttaatccattgctatggttttgacataagttggactgacaccttcattta

SEQ ID NO: 24443 - DNA, 132 bp, Homo sapiens
  D20S851
  Located on chromosome 20
  Distance between a terminus base of telomere on chromosomal short arm and 5'-terminus of this base sequence : 8816951
  Distance between 3'-terminus of neighbour sequence of sequence listing upward to telomere on chrosomal short arm and 5'-terminus of this base sequence : 66442
gcccagactctgacacctttttcaaaagacccgtgtgtgtgtgtgtgtgtgtgtgtgtgtgtgcatttgtagataccgctattcatcttattctgagtctttagccttattgtgccacacataacttgaagt

SEQ ID NO: 24444 - DNA, 467 bp, Homo sapiens
  chr20.fa.O7frz.9578922
  Located on chromosome 20
  Distance between a terminus base of telomere on chromosomal short arm and 5'-terminus of this base sequence : 9062907
  Distance between 3'-terminus of neighbour sequence of sequence listing upward to telomere on chrosomal short arm and 5'-terminus of this base sequence : 245824
tgcatttctaacaaactcctagggaaagccatttctcttggttcaaggaacacgcctcacataggaggcatgaggtacttcatactgctcatcctgaaagccacctctgtgataaaataatagatgattaaaaatttcttatttttatttttatgtatcttccaagttttcatcagtgatcatatattagtcttataatgagaaaaaaagtgaataaattgattttttaagtagagtagtccctttccccagatttctatggatggttttccttgggcctctctttgaagatctttgaggtaggtctttgagtgggttgttagacacttcaggtgccctgcccatactactcaacatttaacttttaaaaaaaacggtggtaaaattatctatctatctatctatctatctatctatctatctatctatctatccatccatccatctatctaaacggagtcttgctc

SEQ ID NO: 24445 - DNA, 402 bp, Homo sapiens
  AL121909.10_34659
  Located on chromosome 20
  Distance between a terminus base of telomere on chromosomal short arm and 5'-terminus of this base sequence : 9150097
  Distance between 3'-terminus of neighbour sequence of sequence listing upward to telomere on chrosomal short arm and 5'-terminus of this base sequence : 86723
tgtttgcattaacactgatacaactctgggatttgcaattttgtttacctattatgggaaaatatctttcttctttgaaagatcaaaacacgtgggaagacatacataaacaccccagacacacacacacacacacacacacacacacacagcctctgtctctcacacacacactcatgcacacagtcccttctttaccaaagccccatgtaatcccttcatgacccagaataatagtatttgaaaggaaaagttggtatgctggagtcttcattcacatattactacaactccaagtcagttgcaatagtttggctatgatatgccagtagctaaatagttcatgacaaattgcttatactgcttaacttctttgtagttaagtatttcaacattgccttc

SEQ ID NO: 24446 - DNA, 168 bp, Homo sapiens
  D20S175
  Located on chromosome 20
  Distance between a terminus base of telomere on chromosomal short arm and 5'-terminus of this base sequence : 9150143
  Distance between 3'-terminus of neighbour sequence of sequence listing upward to telomere on chrosomal short arm and 5'-terminus of this base sequence : -356
acctattatgggaaaatatctttcttctttgaaagatcaaaacacgtgggaagacatacataaacaccccagacacacacacacacacacacacacacacacacagcctctgtctctcacacacacactcatgcacacagtcccttctttaccaaagccccatgtaat

SEQ ID NO: 24447 - DNA, 428 bp, Homo sapiens
  AL023805.2_38442
  Located on chromosome 20
  Distance between a terminus base of telomere on chromosomal short arm and 5'-terminus of this base sequence : 9242981
  Distance between 3'-terminus of neighbour sequence of sequence listing upward to telomere on chrosomal short arm and 5'-terminus of this base sequence : 92670
tattcctacgtgattctgcaacttataccctgtgggctcctcctgcccatatgttcaccttcaagcccatagtgcccttagctatttacagcaggcctctcttatgtattgattttggtctacggtttccttattttatctgttgccttcagattttaaaaaaagaatacacacacacacacacacacacacacacacacacacacacacacacacacacatcttgttattttgtaggatttggagagggaatggaaacttcccaaatgatcacctctggtatttcttgattatgatatctccaggtttagagaaaagaaagcaagttgggggtcagacaaagggaagaagaaaaaaacgtattccacatatttaaagtaaatcttctgcaaacacagaaatgcgaagtgattaaccatcctcaattg

SEQ ID NO: 24448 - DNA, 161 bp, Homo sapiens
  D20S917
  Located on chromosome 20
  Distance between a terminus base of telomere on chromosomal short arm and 5'-terminus of this base sequence : 9243091
  Distance between 3'-terminus of neighbour sequence of sequence listing upward to telomere on chrosomal short arm and 5'-terminus of this base sequence : -318
gattttggtctacggtttccttattttatctgttgccttcagattttaaaaaaagaatacacacacacacacacacacacacacacacacacacacacacacacacacacatcttgttattttgtaggatttggagagggaatggaaacttcccaaatgat

SEQ ID NO: 24449 - DNA, 441 bp, Homo sapiens
  chr20.fa.O7frz.9882918
  Located on chromosome 20
  Distance between a terminus base of telomere on chromosomal short arm and 5'-terminus of this base sequence : 9367046
  Distance between 3'-terminus of neighbour sequence of sequence listing upward to telomere on chrosomal short arm and 5'-terminus of this base sequence : 123794
gaagttctaggtagacaggagttttggtggacactattcaacctactccaccctcttaattctgcttttaatttttattttttattctttatgagacagagtcttgctctgtcgcccaggctgcagtgcagtggcatgatctcagcttactgcaacctccacttgccaggttcaagcaattctcctgcctcagcctcccgagtagctgggattacaggtgtgcaccaccacacggggccaatttgtgtgtgtgtgtgtttgtgtgtgtgtgtgtgtgtgtgtgtgtgtgtgtatttttagtaaagataggatttcaccatgttgaccaggctgatcttaaattcttgacctcaaatgatccacccacctcagcctcccaaagtactgggattacaggcatgagccaccgtgaccggcctccgctttattttcttagtactc

SEQ ID NO: 24450 - DNA, 402 bp, Homo sapiens
  chr20.fa.O7frz.10009291
  Located on chromosome 20
  Distance between a terminus base of telomere on chromosomal short arm and 5'-terminus of this base sequence : 9493601
  Distance between 3'-terminus of neighbour sequence of sequence listing upward to telomere on chrosomal short arm and 5'-terminus of this base sequence : 126114
ggaaagagatcactatttgtcagctttttggtcattcatgcaaatgcacttccaggaactcatttatttatttatttatttatttatttatttatttattcattcattcattcattcattcattctttgagatggagtcccgctctgtcacccaggctggagtgcagtcttcctttttttttgagatggtgtcttgctctgtcacttaggctagagtgcagtggcacaatctcggctcactgcaaccaccacctcctgggtccaagtgattctctctgcctcagcctcccacgtagctgggactacaggcgcccatcattatgcccggctaatttttgtatttttaatagagatagggtttcaccatattggccagcctggtcttgaactactcctgacctc

SEQ ID NO: 24451 - DNA, 278 bp, Homo sapiens
  chr20.fa.O7frz.10139171
  Located on chromosome 20
  Distance between a terminus base of telomere on chromosomal short arm and 5'-terminus of this base sequence : 9623351
  Distance between 3'-terminus of neighbour sequence of sequence listing upward to telomere on chrosomal short arm and 5'-terminus of this base sequence : 129348
ttcatttgtccattcaattaacatttattctgtgtccaccatgtgcccagcactgaggacacacatagatgcacagaatagggaatctttgtccccatgagcactcagagaaacaattacctgaaaaagcaatgatctaattgcactggggtataaaaagtgcttagatgaagagaagtcaagagagggaggtgtgtgtgtgtgtgtgtgtgtgtgtgttatgtgtgtgcatctgtgtgtatgtgtgtagggattatccattccagaattgaatgctg

SEQ ID NO: 24452 - DNA, 293 bp, Homo sapiens
  chr20.fa.O7frz.10238904
  Located on chromosome 20
  Distance between a terminus base of telomere on chromosomal short arm and 5'-terminus of this base sequence : 9723105
  Distance between 3'-terminus of neighbour sequence of sequence listing upward to telomere on chrosomal short arm and 5'-terminus of this base sequence : 99476
tacagcttcagtcatccttaagcattccctgggcttcttattttatatttttagagtaggagagctaaagcatgggagtggtctcttgggtaagttaaactctctaagcctcagtttttcatctataaaatagaaaaactgacgcttactctgcatggctatgaaaaggatgtgtgtgtgtgtgtgtgtgtgtgtgtgtgtgtgtgtatgtgtatacatttacagtggtgtgctggtaaatgtttaactactggctttccaaaaaaaaattcttgatactgctaagtgcagat

SEQ ID NO: 24453 - DNA, 283 bp, Homo sapiens
  Z66695
  Located on chromosome 20
  Distance between a terminus base of telomere on chromosomal short arm and 5'-terminus of this base sequence : 9898349
  Distance between 3'-terminus of neighbour sequence of sequence listing upward to telomere on chrosomal short arm and 5'-terminus of this base sequence : 174951
gcatttaaacagaaaattgtttctttacttacaatacttctgacaccaaatgtgtgtgtgtgtgtgtgtgtgtgtgtgtgtgtgttttctcaccaacaaccaattctccaactctctgcagacaccaacagggagtactacaatttaattcaattctgacattaactacccagagttagtgtggaccccacaaatcaagcactcggtcccacaagactgcccccaacttcaggtgccaatcacaaataaagggtccccaggttgtccttgcttctgtctgaca

SEQ ID NO: 24454 - DNA, 401 bp, Homo sapiens
  AL353739.4_98315
  Located on chromosome 20
  Distance between a terminus base of telomere on chromosomal short arm and 5'-terminus of this base sequence : 9910062
  Distance between 3'-terminus of neighbour sequence of sequence listing upward to telomere on chrosomal short arm and 5'-terminus of this base sequence : 11430
cttgtagttctggatgttggacacccaaaatggctttcactgggctaaaatcaaggaggcagcagggcttcttctggaggctccaggggcgaataatttccttgccttttctggcctctaggggctacctgtattgtttgcctcgggccccttcatcttcaaagccagcagtgtagcatcttcaaatttctccttaaccctgctctcatcctcatgtccccttctggtgtttgtttgtttgtttgtttgtttgtttttgtaaggacactgtgattacacatcctagattaatctaagacaatctcactatttcaaaatccttaattgtatctactaagtcgcttttccatgtaaggttacatatgcagaagttttagggattaagatgtggctatctttgg

SEQ ID NO: 24455 - DNA, 224 bp, Homo sapiens
  HUMUT1689
  Located on chromosome 20
  Distance between a terminus base of telomere on chromosomal short arm and 5'-terminus of this base sequence : 9992058
  Distance between 3'-terminus of neighbour sequence of sequence listing upward to telomere on chrosomal short arm and 5'-terminus of this base sequence : 81595
ctccaacctgacagctaggtatctagctagctagaaaggcagatagacagatatatagatgatagatagatagatgatagatagatagatagatgatagatagatagatagatagatagatagatagatagatagagatttattgcaaataattggtttacataattttgggccccagatggttaagtgctaaatttgtagggtaggctatcaggaagtgcagg

SEQ ID NO: 24456 - DNA, 260 bp, Homo sapiens
  D20S901
  Located on chromosome 20
  Distance between a terminus base of telomere on chromosomal short arm and 5'-terminus of this base sequence : 9996539
  Distance between 3'-terminus of neighbour sequence of sequence listing upward to telomere on chrosomal short arm and 5'-terminus of this base sequence : 4257
ctggttggtggtcaacatatggtttgtttttaaccatcttatagtctctatctgaaaagtgaaccaaaagaaggcacaggaaggaataaggacccagacctgaacagtcagaacagaaaaggcttcctggagcagattcactttcagaccatcgaagtcatttaaacatatgtgtgtgtgtgtgtgtgtgtgtgtgcatgtgtgtgtgcgtgtatatatatatatttttttttgagacagggtctcatggagcgcagtag

SEQ ID NO: 24457 - DNA, 303 bp, Homo sapiens
  AL109754.13_137178
  Located on chromosome 20
  Distance between a terminus base of telomere on chromosomal short arm and 5'-terminus of this base sequence : 10050345
  Distance between 3'-terminus of neighbour sequence of sequence listing upward to telomere on chrosomal short arm and 5'-terminus of this base sequence : 53546
agctgatcttatcctagtgatctagtcctttttgttgtgcaaaaggaagtgctaaaatcagaatgagaaccatggtcacctgacatagacacaagtgatgatgatgatgatgatgatgatgatgatgatgatgatgatgatatccatgttcaagtactaattctgggcaagacactgttctaagtgctatgaatatattacctcatttaatcatctccaaaacattatgagatattctgttactatcaccatttacaaatgatgggattgaagtacagagaggataaatagcatcctaagatc

SEQ ID NO: 24458 - DNA, 229 bp, Homo sapiens
  DISO7_00021241
  Located on chromosome 20
  Distance between a terminus base of telomere on chromosomal short arm and 5'-terminus of this base sequence : 10152933
  Distance between 3'-terminus of neighbour sequence of sequence listing upward to telomere on chrosomal short arm and 5'-terminus of this base sequence : 102285
attgcctaagcttggctctcaggccagctagggatgtgtgtgtgtgtgtgtgtgtgtgtgtgtgtgtgtgtgtggtggggcgggggtggggggcgagggtgcaaggggagaggttgtacgccgcttttccgaacccagctctaaatggtttctcctaagcgagacaaggattttccatagcctaaaagaggccatcaagttttaacattgcgaggcacgacttctaatc

SEQ ID NO: 24459 - DNA, 204 bp, Homo sapiens
  chr20.fa.O7frz.10878314
  Located on chromosome 20
  Distance between a terminus base of telomere on chromosomal short arm and 5'-terminus of this base sequence : 10362607
  Distance between 3'-terminus of neighbour sequence of sequence listing upward to telomere on chrosomal short arm and 5'-terminus of this base sequence : 209445
gaacttgctatgcttctacctcattataaatactgtaatcttttagagtagcttaaaggccaagaaaagaaaacactgacacacacacacacacacacacacacacacacacacacacacacacacacaaagtaaggttaagggcaaaaaggcaagcaagcttcctagaacttcccaaacagctggatctagccatcagattat

SEQ ID NO: 24460 - DNA, 363 bp, Homo sapiens
  HUMUT2012
  Located on chromosome 20
  Distance between a terminus base of telomere on chromosomal short arm and 5'-terminus of this base sequence : 10453919
  Distance between 3'-terminus of neighbour sequence of sequence listing upward to telomere on chrosomal short arm and 5'-terminus of this base sequence : 91108
attgttgctttcctgctggaaactgagtcttgacgctctggatgaccattctccacccagcactagagaccagtcttttctttctttctctctttctttctttctctctctctttctttccttcttcctttctttctttctttccttccttccttccttccctccctccctccttcttccttccttccttccttccttcctttcctttcttttcctttcctttccttttccttccttccttccttccttccttccttccttccttccttccttccttccttccttcctttccttctttctttcttttctttctttctttttttctttttttagacagggtctcactctatcacccaggctgct

SEQ ID NO: 24461 - DNA, 455 bp, Homo sapiens
  AC024994.2_157363
  Located on chromosome 20
  Distance between a terminus base of telomere on chromosomal short arm and 5'-terminus of this base sequence : 10475626
  Distance between 3'-terminus of neighbour sequence of sequence listing upward to telomere on chrosomal short arm and 5'-terminus of this base sequence : 21344
ggagtctgttagtaacgcacattctcagcctcaccccaggtttaagtctcaccatggggctgagctttagcaatttgtgtttctttttgttttctttcttttctttcttttctctccttccttcctttccttccttccttccttccttccttccttccttccttccttccttctttccttccttccttctctccttccttccttccttccctccctccctctctttctttctttctctttctttcttctttttgtttttttaatacctagccgagcacaaagctaatcaatgtgtgtttttaacaagccgtcctggtgaatctgatgctcgcccaagtttgagaaacactgtgtcaggcaatgggtagtggtgttttgaagacatcgaatcctgagaatcaagggtgtgtaatagtggatgctggcagtattactctgaagtcaatgctatggtc

SEQ ID NO: 24462 - DNA, 271 bp, Homo sapiens
  D20S894
  Located on chromosome 20
  Distance between a terminus base of telomere on chromosomal short arm and 5'-terminus of this base sequence : 10654969
  Distance between 3'-terminus of neighbour sequence of sequence listing upward to telomere on chrosomal short arm and 5'-terminus of this base sequence : 178888
gaagcaccctgtggagttacataggaaggaaaattcagccctttattacttaatcacatcactcaatgttagaggttttcattatctcataaaatgctttccaggggtagagaaaggtggtttagaagaaattttactgacttgccttgtttccaattttgtgagctttcagaaatacttgttccctcttatacacacacacacacacacacacacacacacacacacacacagacacacattttaaaaacatgacttttttgcaggattg

SEQ ID NO: 24463 - DNA, 291 bp, Homo sapiens
  AL135937.22_42546
  Located on chromosome 20
  Distance between a terminus base of telomere on chromosomal short arm and 5'-terminus of this base sequence : 10712288
  Distance between 3'-terminus of neighbour sequence of sequence listing upward to telomere on chrosomal short arm and 5'-terminus of this base sequence : 57048
aagttgaactcatagaagcagaagtagaatggttgccagaggttaggggatggaagaaatgaggagatgttggtcaaagtggacaaaatttcagttatgcaaaatgaatgggttctggagacctaaggtacaacatggtaactatagttaatattactttattgtatacttgaaatttgctaagacagtagatcttaaaagctcttcacacacacacacacacacacacacacacacacaaaggtaattatgtgaggtgatgaatatgttaattagcttgatcatggtgat

SEQ ID NO: 24464 - DNA, 365 bp, Homo sapiens
  AL135937.22_54315
  Located on chromosome 20
  Distance between a terminus base of telomere on chromosomal short arm and 5'-terminus of this base sequence : 10723979
  Distance between 3'-terminus of neighbour sequence of sequence listing upward to telomere on chrosomal short arm and 5'-terminus of this base sequence : 11400
aaggaactcatagcctcaactagagttttcttaggggaatttgccagagattatttataaaatacctgacatacaaaataaaagcaataggcagttttcgaagcagatttcaaaaaaaattcttcacctaagcaaaaatatggaatccattgaaatatttaatggaaggtaaaactttagacaacattagggtctgttggctatgactgggagacactaaataattgtaactgacaacagagtaaagataggacacatctgtgtcttggaaaagcccaggattatgtgtgtgtgtgtgtgtgtgtgtgtgtgtgtgtgtgtgtgtgtggtggtgggggtaggagtgtctttctgattacacctgc

SEQ ID NO: 24465 - DNA, 341 bp, Homo sapiens
  chr20.fa.O7frz.11334418
  Located on chromosome 20
  Distance between a terminus base of telomere on chromosomal short arm and 5'-terminus of this base sequence : 10818591
  Distance between 3'-terminus of neighbour sequence of sequence listing upward to telomere on chrosomal short arm and 5'-terminus of this base sequence : 94247
ataggatttaaaccaatgaggtacagtggtaacaaaggcttgctgtgttgaacgggagtttttattagccgatacagaggttacttcatacggaaaaatgctggcctatttcccaaatcatagctcattttcaatgaatagtatcatcacaaacctgtgaacaaagacctagtactctataggttgaaagacatgttcatatatatatatatatatatatattatattaataagtaggtctaaaaaacagctttgctattcagaaaggtcgctgtggtgagtggtgggagcaccagtttaggtcaggaaacttccttgttgtatgatataggcaacatttc

SEQ ID NO: 24466 - DNA, 145 bp, Homo sapiens
  D20S188
  Located on chromosome 20
  Distance between a terminus base of telomere on chromosomal short arm and 5'-terminus of this base sequence : 10996686
  Distance between 3'-terminus of neighbour sequence of sequence listing upward to telomere on chrosomal short arm and 5'-terminus of this base sequence : 177754
gaacatattgtggtttcccgtgtgtttgtgtgtgtgtgtgtgtgtgtgtgtgtgtatgtgtgtgtgttcccctcttctttttttacttacgataattgaaatgtcattttatcctggatgttttcttttccaaccagggacatga

SEQ ID NO: 24467 - DNA, 275 bp, Homo sapiens
  AL078588.9_6722
  Located on chromosome 20
  Distance between a terminus base of telomere on chromosomal short arm and 5'-terminus of this base sequence : 11127264
  Distance between 3'-terminus of neighbour sequence of sequence listing upward to telomere on chrosomal short arm and 5'-terminus of this base sequence : 130433
ggtgacaagaacaaaactccttcacacacacacacacacacacacacacacacacacacacacacacacgacagaaaaggggaaattgcaactgggcatttattacaggattagctactctcatctattacttggatggagagaaataaatagatttcaggtttgttttgggaagagaatccatagaattcactggtaaactagatgtggagtataagaaaagagccctcaagcatagttagcagttttctaactacatcgactgtgaaagacgt

SEQ ID NO: 24468 - DNA, 294 bp, Homo sapiens
  D20S189
  Located on chromosome 20
  Distance between a terminus base of telomere on chromosomal short arm and 5'-terminus of this base sequence : 11128814
  Distance between 3'-terminus of neighbour sequence of sequence listing upward to telomere on chrosomal short arm and 5'-terminus of this base sequence : 1275
agctacaccagttgtcagcgttgactatatattttctacatattttataattaataataataattctttttgggaaggtttagccaatagaagggagatggggtggtggttaagtacctcaggattgcaacttgagagtgaatggcaaggaaaccacttaatctttaaaacacacacacacacacacacacactgtatttcaaaatcttcactaggtatttgaggtggttttttactagtgttttgaaatagtgactgtgactcaagaaaggctagaagatgccacatccattc

SEQ ID NO: 24469 - DNA, 473 bp, Homo sapiens
  chr20.fa.O7frz.11869411
  Located on chromosome 20
  Distance between a terminus base of telomere on chromosomal short arm and 5'-terminus of this base sequence : 11353643
  Distance between 3'-terminus of neighbour sequence of sequence listing upward to telomere on chrosomal short arm and 5'-terminus of this base sequence : 224535
tttcatggtttctggtgagaagtctgctgtaattttaacctttttctctatagataaggtgatttttttctccctctgacgtctttcagaattttttgtctttggttgtctgcagtttatgatataatatgcttagagatgtgtgtgtgtgtgtgtgtgtgtgtgtgtgtgtgtgtgtttgatatttgtgctgcttggtgttctctgagcttccttgatgtaccatttagtatcttttattagttatagaaaattttggtcattattacttcacatattttttctgcttcattctatcttaatttccattggggtatccaaattacgtgagtattatatcacttgaaattgtcccacacttcctggatattctgttttgtctttttcattctttttgcattgcagtttggaaagtttctattggactatcttcaagcttacttactctaccctcagccatgttaaatctactg

SEQ ID NO: 24470 - DNA, 202 bp, Homo sapiens
  AL109837.22_19609
  Located on chromosome 20
  Distance between a terminus base of telomere on chromosomal short arm and 5'-terminus of this base sequence : 11443501
  Distance between 3'-terminus of neighbour sequence of sequence listing upward to telomere on chrosomal short arm and 5'-terminus of this base sequence : 89385
attgaccagtaagtgcatgaagaaaatgttatatatatatatatatatatatatatatatatatatatacacacacacacacacacacacacacacacactcaccatggaatactactcagccataaaaaggaacaaaataatgtcatttgcaggagcttgaatggagctagaggccattattctaggcgaagtaactcaag

SEQ ID NO: 24471 - DNA, 133 bp, Homo sapiens
  D20S186
  Located on chromosome 20
  Distance between a terminus base of telomere on chromosomal short arm and 5'-terminus of this base sequence : 11478807
  Distance between 3'-terminus of neighbour sequence of sequence listing upward to telomere on chrosomal short arm and 5'-terminus of this base sequence : 35104
aacttaggcgtacagcagcctttccaagaatttgtggcacaaagcagacaggaatattctacacacacacacacacacacacacacacacacacacacacacacacacacattccgcttcctgtctctgactt

SEQ ID NO: 24472 - DNA, 300 bp, Homo sapiens
  AL109837.22_101761
  Located on chromosome 20
  Distance between a terminus base of telomere on chromosomal short arm and 5'-terminus of this base sequence : 11525535
  Distance between 3'-terminus of neighbour sequence of sequence listing upward to telomere on chrosomal short arm and 5'-terminus of this base sequence : 46595
cctaatgtaacaaatgttaccatcttggggtatatttttccagatcttttttctggtcttacaatctgtattaggcaaaattctaagatttcccccaatgaaaaatacccttgtataatcccagcccttgagtatgggtaacgcctgtgcgcataatatgattatcactcctgtgattatattatgttatattatattatattatattatattatattatattatatggaagttattttgctaatgtaattgaggtctgtaactagttgactttgagttaatcaaaggaaagattatcct

SEQ ID NO: 24473 - DNA, 385 bp, Homo sapiens
  AL161938.6_3069
  Located on chromosome 20
  Distance between a terminus base of telomere on chromosomal short arm and 5'-terminus of this base sequence : 11566048
  Distance between 3'-terminus of neighbour sequence of sequence listing upward to telomere on chrosomal short arm and 5'-terminus of this base sequence : 40213
ataaggcctacagctgaagttcctctgaagtctgctttacagctaggaatcgtttttggattctctctctctctctctctctctctctctctctctgtgtgtgtgtgtgtgtgtgtgtgtgtgtgtgtgtgtgtgtgtgtgtgttttaaaaacttagggaaataaaggtcaaaataattttctttattccaaaaccagaaaatcatcctgaaaaacatgtcctaaaaataataacatctgattaccaaagaaggtcactttatctaagggattttagtagctgatattgtttgggggaatttctcaggtgaatttattgtgggtaggttgtgaaatggggtcatagtcccatagtttattttacaaactttcttacactgaacca

SEQ ID NO: 24474 - DNA, 381 bp, Homo sapiens
  AL161938.6_126289
  Located on chromosome 20
  Distance between a terminus base of telomere on chromosomal short arm and 5'-terminus of this base sequence : 11689283
  Distance between 3'-terminus of neighbour sequence of sequence listing upward to telomere on chrosomal short arm and 5'-terminus of this base sequence : 122850
ctaagcatatctgtgaagccagtaccgaaaacaagaaacagaaaattataggtacctagatgccccccacacgctctgccgtgtgtgtgtgtgtgtgtgtgtgtgtgtgtgtgtgtgtatatagtttgtttgcttttgttttatttttcttggccctgagcaaaggctgagttcaggaggtgccctccacgtctcctgtatgggtttagctcacctgtcctggggctgggctctgttttctcacctgttggggtcccagatattatccacccacggtcccaggttgtatccactcttctgtctgtgattggccaaattacgcttagggaattagaaatatgtaaatatccccagggcaaacattgtttctagcacttgaat

SEQ ID NO: 24475 - DNA, 469 bp, Homo sapiens
  chr20.fa.O7frz.13462493
  Located on chromosome 20
  Distance between a terminus base of telomere on chromosomal short arm and 5'-terminus of this base sequence : 11752441
  Distance between 3'-terminus of neighbour sequence of sequence listing upward to telomere on chrosomal short arm and 5'-terminus of this base sequence : 62777
ccagctctagtccttctgttactcacttttctctggccctgttagtctcttgcggttccttaaatagaccaagaatatgttggtttcatgacctttgcacttgctcttctttcagctaggatactctgttggtttgctttctctctctctctctctctctctctctctctctctctctctctctgcaaagagctttctgttgtgtaggaacgaccaggggtttgtgggttactattcatcttggtagaagggaatacttgctacctaattttgggttctcaaaaaccgaaacttgaaacaattatttaaatttattcaggaggggacctcagaaaatttcagtaggacaatagaaaaatgaaaaagggaaaggaaatcagccaatgaaatgtgtgttatcaagccagttcccaccatgggcaaccaggacttactcccacttggaaactctgagcacagttatcctaca

SEQ ID NO: 24476 - DNA, 228 bp, Homo sapiens
  AL359968.14_66702
  Located on chromosome 20
  Distance between a terminus base of telomere on chromosomal short arm and 5'-terminus of this base sequence : 11807608
  Distance between 3'-terminus of neighbour sequence of sequence listing upward to telomere on chrosomal short arm and 5'-terminus of this base sequence : 54698
gaactgtgctgaatttctcaagattgcatttaccccccagcttctgcacactccctcctcctcctcctcctctttctcctcctcctgcaactgctgctgttccttctcttcttctccttctcattttcctcctccttctccttcctcttcttgtttttcttctcatccttctccttctcctccttcttcaacttctccttcttctccttgaaatgaggatcacgtaag

SEQ ID NO: 24477 - DNA, 366 bp, Homo sapiens
  HUMUT246B
  Located on chromosome 20
  Distance between a terminus base of telomere on chromosomal short arm and 5'-terminus of this base sequence : 11919692
  Distance between 3'-terminus of neighbour sequence of sequence listing upward to telomere on chrosomal short arm and 5'-terminus of this base sequence : 111856
acacccggcgatattactatgttttaaagtttacttatcttttcttctgttaatattactcagtataattattttattgcacacatttttctccattgtgtttttctcttctttcttttcttttctttctttctctccttctttctttcttttcttttctctttctttctttctttctttctttctttctttctttctttctttctttctttctttctttctttctttctttgtttccttccttctttctttctttctttttctttctttttttttttttgagacagggtcttgctctgttgcccgggctagagtgcagtggcacagtcatagctcactgctgtctcgaactccagggcttaagtg

SEQ ID NO: 24478 - DNA, 317 bp, Homo sapiens
  chr20.fa.O7frz.13198007
  Located on chromosome 20
  Distance between a terminus base of telomere on chromosomal short arm and 5'-terminus of this base sequence : 12016941
  Distance between 3'-terminus of neighbour sequence of sequence listing upward to telomere on chrosomal short arm and 5'-terminus of this base sequence : 96883
gtaggtgctcttagtatgatcagttctggctgtttatgctgtaaattcttccctattgtccacaacagaaaactcttgggcaatgcagtgaaatgtcaggagattatctatctaaactatctatctatctatctatctatctatctatctatctatctatctatctatctgtctgtctaagtgccttttaaaaattacccctcaagttaagattacttgtctcagaaagtcttcctaatttaaaccgtgttgtttttcatcatttcatagatctgtgtgaagcgaagaattttctgttacagtatgactggaccaga

SEQ ID NO: 24479 - DNA, 266 bp, Homo sapiens
  chr20.fa.O7frz.13086428
  Located on chromosome 20
  Distance between a terminus base of telomere on chromosomal short arm and 5'-terminus of this base sequence : 12128571
  Distance between 3'-terminus of neighbour sequence of sequence listing upward to telomere on chrosomal short arm and 5'-terminus of this base sequence : 111313
tggatagctcatatttgaacagagatttcctcaaatgtctggaaccaataaatctactctttgcctacgggctctgtgtgtgtgtgtgtgtgtgtgtgtgtgtgtgtgtgtgtgtgtgttggaacatggcttcaactctcacccaggtaactgacaactctgccttaactttcactttctgcttgtgcaaagcctcaaggtcagccaggagtaaaagctaagggccatctcaagtctttcctgagtatgcatataaccgtatgcat

SEQ ID NO: 24480 - DNA, 486 bp, Homo sapiens
  AL136460.28_21847
  Located on chromosome 20
  Distance between a terminus base of telomere on chromosomal short arm and 5'-terminus of this base sequence : 12243302
  Distance between 3'-terminus of neighbour sequence of sequence listing upward to telomere on chrosomal short arm and 5'-terminus of this base sequence : 114465
ctcatacaatcattgtgaggattaaatgttttaatatgcataagtacttagaatggggtcaggaacttagtaagttctcagtaagtcacagctattattaatgtcattattgtttaaccaaaatttagggcacagaagcccatagtactctgctgggtatcctgtaagaaattcagatgaatataaacatggccactgccctcaagaaatgtataatctaaaatctgctaattttgtattctctgaccttactaaatttttaaattagttctgataggggtgtgtgtgtgtgtgtgtatgtgtgtgtgtgtgtgtgtgtgtgtgtgtgtgtgtgtgtgatttgtagggatttctacatataggataatgtcttctatgaacagagataactttattcctttttaaatttagatatctttttttttcttgccaaattgctctggctagtatttttagtattttgttgagtagaagtgataagcatgg

SEQ ID NO: 24481 - DNA, 388 bp, Homo sapiens
  AL096862.18_6470
  Located on chromosome 20
  Distance between a terminus base of telomere on chromosomal short arm and 5'-terminus of this base sequence : 12366832
  Distance between 3'-terminus of neighbour sequence of sequence listing upward to telomere on chrosomal short arm and 5'-terminus of this base sequence : 123044
taaatcttcctgatttatgctaagattattttgtaggtaaattgatggatgatatcaagcttaatatattgacaaaattttatttgagacttcaacgctctaaagcttttttttaataacacagtcattgagttacaattaactaaattaaaaactttttccaagataagcaaatttaaaaatgatgaaaggagaagcaaaacttcattaggtttaagtaaaacttaatttatttttctcctcactactttttattttgtatgtcttttttttcttttcccagataactttattgccttaaactctttaggtcaagttttctgttttgttttgttttgttttgttttgtttgtatatttgcatccagtccagtttccattaagaaagt

SEQ ID NO: 24482 - DNA, 301 bp, Homo sapiens
  AL096862.18_17358
  Located on chromosome 20
  Distance between a terminus base of telomere on chromosomal short arm and 5'-terminus of this base sequence : 12377979
  Distance between 3'-terminus of neighbour sequence of sequence listing upward to telomere on chrosomal short arm and 5'-terminus of this base sequence : 10759
ggcacaatgcaactaattagactatagcacttaattgaatttcactactgtacatatgcacttgtgtgtgtgtgtgtgtgtgtgtgtgtgtgtgtgttgttctatgacattttattaaatgtatagatttgtataaccaccaacacattttgtaacttctttgctttctggtataacatgaaattctacaagtatcttttacatttcctgtcttaggccttaggtcagccatttcttcaagatgtcatggttagttatagtggggcatgctacgcagaaaccatagaatggagtctatttc

SEQ ID NO: 24483 - DNA, 224 bp, Homo sapiens
  G10188
  Located on chromosome 20
  Distance between a terminus base of telomere on chromosomal short arm and 5'-terminus of this base sequence : 12421167
  Distance between 3'-terminus of neighbour sequence of sequence listing upward to telomere on chrosomal short arm and 5'-terminus of this base sequence : 42887
tctctgtcttccactccctgcacctcactaacctcacctccctggccgaagttgccagcctgacttttgccttctatcagtctatctagctatatctgtctgtctgtctgtctgtctgtctgtctatctatctatctatctatctatctatctatctatctattgatccatctactatctaatcatctatctccatatctgtgatttagttatacctcgctcca

SEQ ID NO: 24484 - DNA, 375 bp, Homo sapiens
  AL034561.4_100961
  Located on chromosome 20
  Distance between a terminus base of telomere on chromosomal short arm and 5'-terminus of this base sequence : 12498799
  Distance between 3'-terminus of neighbour sequence of sequence listing upward to telomere on chrosomal short arm and 5'-terminus of this base sequence : 77408
caaatatctaatgagcacaggaagagatacttcaccttactaatgatgaagaaaagaggaagtaaaagagaaattagacattagctagcatttcacactccttagattggaaaataaacaaataaatgtgtgtgtgtgtgtgtgtgtgtgtgtgtgtgtgtgtgacaatcaatgtcagctatgatataaggaaactggaattttaatcctgctgatataatcagtgatatgctggtagatgtttaaaaccttcctttccaagaaaataaaaaaaagtcctgacttgtaacatttactgattttcgggggcaactattctcattgtggctgttttcaagcccccaatgggatatgatgctactgaacgcagaatag

SEQ ID NO: 24485 - DNA, 425 bp, Homo sapiens
  chr20.fa.O7frz.12512393
  Located on chromosome 20
  Distance between a terminus base of telomere on chromosomal short arm and 5'-terminus of this base sequence : 12702459
  Distance between 3'-terminus of neighbour sequence of sequence listing upward to telomere on chrosomal short arm and 5'-terminus of this base sequence : 203285
tggatcacttgagataggagttcgagaccagcctggccaacatggtgaaaccccgtccttactaaaaacacaaaaattagctggatgtggtggggtgtgactgtagtcccagctactcaggaggcagaggtggaggtgagacaatcgcttgaacctcggaggcggaggttgcagtgagtgcagtgagccaaatggcaccactgcactccagcctgggagacagagtgagattccatctaaaacaacaacaacaacaacaacaacaaacttaacaaacttaaaattagttgcctaagatcacaaaacatggtcaatgttggggctgagatttatagcttccagtgtaaccagggtgaccccaggagctggattctgttgaggatgcttttttgtttttgtatcttaaacattccacttatcacaac

SEQ ID NO: 24486 - DNA, 188 bp, Homo sapiens
  AL078623.28_112825
  Located on chromosome 20
  Distance between a terminus base of telomere on chromosomal short arm and 5'-terminus of this base sequence : 12808976
  Distance between 3'-terminus of neighbour sequence of sequence listing upward to telomere on chrosomal short arm and 5'-terminus of this base sequence : 106092
tccaactttggtagaagtcaagagaccattccttgcttcagccaagaaacagagttcaagtaaacctgaagccccactctttatttcctgtcgagacactccctctatcaggggtgtgtgtgtgtgtgtgtgtgtgtgtgtgtgtgtgtgtgtgttacaggtctgagtctgatgttgaaggttgaaat

SEQ ID NO: 24487 - DNA, 273 bp, Homo sapiens
  HUMUT1705
  Located on chromosome 20
  Distance between a terminus base of telomere on chromosomal short arm and 5'-terminus of this base sequence : 12813120
  Distance between 3'-terminus of neighbour sequence of sequence listing upward to telomere on chrosomal short arm and 5'-terminus of this base sequence : 3956
ccatcatttgttttcacggacatgatagatgatagatagatagatagatagatagatagatagatagatagatagatagatagacagacagacagatagatagatagataacacattgaatgaggtgagcagagatttgatatgacttatttggagagagtaattgtgagagtctatggtaggcaaaccacatgtaagaaattggcttaattctgaccctgaaatttagacagggcattgataaacaggtggcctccagaggggcagatgaaa

SEQ ID NO: 24488 - DNA, 273 bp, Homo sapiens
  AL078623.28_155618
  Located on chromosome 20
  Distance between a terminus base of telomere on chromosomal short arm and 5'-terminus of this base sequence : 12851764
  Distance between 3'-terminus of neighbour sequence of sequence listing upward to telomere on chrosomal short arm and 5'-terminus of this base sequence : 38371
ctttggaactacactaaactccagaatatcagtatagatacatcagtatcaggaaaagctgctgcacccaaaaatgctaactaaataatgatttaattttagaaaaagaactagctatacacacacacacacacacacacacacacacacacacacacatctaccaaaataaactaagacctctcttgatcctcaactctcttctgtgtggtccattggctgtaggacataatcgttgtaagaacaagctgctggatttcaggtacaactgtt

SEQ ID NO: 24489 - DNA, 439 bp, Homo sapiens
  chr20.fa.O7frz.12299550
  Located on chromosome 20
  Distance between a terminus base of telomere on chromosomal short arm and 5'-terminus of this base sequence : 12915420
  Distance between 3'-terminus of neighbour sequence of sequence listing upward to telomere on chrosomal short arm and 5'-terminus of this base sequence : 63383
caggaatgcatagactatgaaagaaaaaccaggaaagatgagttagcatggatagatggatgcatggatggatgcatggatggatgcatggatggatggatggatggatggatggatacatggatggatgcatggatggatggatggaaacatgaatggatggatggatggacggacggatacatgaatgaatggatggatgaatgggtggatggatggatggatgggtggatggatggatggatggatggatggatggatggatggatagacgtaaatgaggaaaaaataaagggaagaaggaaaattatttttcttcaacaatccaaagacactgttcctttattttcacagtatcttatgcttttaataataattctattgctgaaataactttttttcctcttcatccttagtgttctcatatttcataatcagg

SEQ ID NO: 24490 - DNA, 425 bp, Homo sapiens
  chr20.fa.O7frz.14226580
  Located on chromosome 20
  Distance between a terminus base of telomere on chromosomal short arm and 5'-terminus of this base sequence : 12975487
  Distance between 3'-terminus of neighbour sequence of sequence listing upward to telomere on chrosomal short arm and 5'-terminus of this base sequence : 59628
accgcaaatttatacaaacttaaatccagtgatatatagaaatgttacttctatatagcctaccttcccttttatgctattactgttataatatgacatctatatatttataaaatcaacagtacaatcttataaatactatgttgtacaattttatgtcttttttaagaagctggaaaggaaaggatgccaaatatataggtgtatgcatgtacgtgtgtgtgtgtgtgtgtgtgtgtgtgtgtgtatgtatacatattgagaaagaaagagtttgttacatcaactttcttatttatcttcttatttaacatttctggttttattcattagttgctgtggactctaattgccatgttgtataatttccttaattcaatatagttttgctcacatccaatttctttgtgctgttattgcataat

SEQ ID NO: 24491 - DNA, 273 bp, Homo sapiens
  chr20.fa.O7frz.14754037
  Located on chromosome 20
  Distance between a terminus base of telomere on chromosomal short arm and 5'-terminus of this base sequence : 13114985
  Distance between 3'-terminus of neighbour sequence of sequence listing upward to telomere on chrosomal short arm and 5'-terminus of this base sequence : 139073
gtattcgtataaatgcataggaaaatatctttaaaaaactatactagattttctttggataagtagaattatgtgcgtgtgtgtgtgtgtgtgtgtgtgtgtgtgtgtgtataatcttccagaattagaaaataaacaatttggagaaaaaataccaacatactggaataactcagaacatcactcttggattaataattcattcttgtttaatgcctttatttgaagtccccactgctgggtactggaccctgaagataatggtcaagactg

SEQ ID NO: 24492 - DNA, 394 bp, Homo sapiens
  chr20.fa.O7frz.14937439
  Located on chromosome 20
  Distance between a terminus base of telomere on chromosomal short arm and 5'-terminus of this base sequence : 13298349
  Distance between 3'-terminus of neighbour sequence of sequence listing upward to telomere on chrosomal short arm and 5'-terminus of this base sequence : 183091
tacatactgcatgattctgtttatatgaaattctagaaaaagcaaaaacatcagtggttgcctagaattagcagtaaagggagattgactgcaaagggtgtgaaatagcaagaaatatatatatatatatatatatatatatatttgtctctccccctgtttcttgcacagagctcctaaaacctttataacttcctgagagatagtggtagggtgctaagagaatcttttgttctaatatttggtctctgtcctggttcctgagacagggaccctaatacccttgtagattggggtgatctaggggaatcttttgttctaatatttggtctttgacaccagatcctaacatactgctctttagatttttgtgaacctgagtgataggagtagc

SEQ ID NO: 24493 - DNA, 185 bp, Homo sapiens
  D20S915
  Located on chromosome 20
  Distance between a terminus base of telomere on chromosomal short arm and 5'-terminus of this base sequence : 13402774
  Distance between 3'-terminus of neighbour sequence of sequence listing upward to telomere on chrosomal short arm and 5'-terminus of this base sequence : 104031
atattaacattttgctacatttgagttctttcatagatatagagatggaaattaacacacatacaatacacacacacacacacacacacacacacacgacacacaaatacttttttttcctaaggcactcgcaagtaactgtcaaatattgcaacccttcatcctaaatgaagacatcacctgaa

SEQ ID NO: 24494 - DNA, 392 bp, Homo sapiens
  AL158089.8_9842
  Located on chromosome 20
  Distance between a terminus base of telomere on chromosomal short arm and 5'-terminus of this base sequence : 13444658
  Distance between 3'-terminus of neighbour sequence of sequence listing upward to telomere on chrosomal short arm and 5'-terminus of this base sequence : 41699
atgaaatcagtacctcaaacagacaattgcactccaatgttccctgcagcattattcacaatagccaagatatggaaactacctaagtgtctatcaatgaatgaatgaatgaatgaagaaagtgtgtgtgtgtgtgtgtgtgtgtgtgtgtgtgtgtgtgatttagcctttaaaaccaagaaaatcctgtcatttgtgacaacatggatgaacttagaggatatcaggctaagtgaaataagccaaacaaaaaaagacaactacagcatgttctcacttatatataaaaatctaaagtcaagcttatagaaacagagaatagaagagtgtttaccagggtgaggaaatgaggagatagtgtcacagggtacgaacttatggttgtaagatga

SEQ ID NO: 24495 - DNA, 448 bp, Homo sapiens
  AL121754.18_30898
  Located on chromosome 20
  Distance between a terminus base of telomere on chromosomal short arm and 5'-terminus of this base sequence : 13485637
  Distance between 3'-terminus of neighbour sequence of sequence listing upward to telomere on chrosomal short arm and 5'-terminus of this base sequence : 40587
tcttgcctcaatttcatcttacttataactttaagacttcatatagatttaaggtatagcttggtgtggatttaaggacgacctgggaagaaactcaatctcctaggtattgaatctttatatgctaagttagaagcttttcctaaatatggaatatatacacatacacacacacacacacacacacacacacacacacacacagagacactgcaattgtccagtcatcaaaggtcgaaagttttagactcagatattgatgattggcataaagtactataagctataaacatttagaagatcctcatatactgaaaacaaatgccaatcatcaggctttataacctaaataaatgtatgggatgggggtgatccaataagacattaattaagttactgacctatctactgatttacatgtaaaatctgtaggctcatccagtaatca

SEQ ID NO: 24496 - DNA, 158 bp, Homo sapiens
  AL121754.18_93242
  Located on chromosome 20
  Distance between a terminus base of telomere on chromosomal short arm and 5'-terminus of this base sequence : 13548082
  Distance between 3'-terminus of neighbour sequence of sequence listing upward to telomere on chrosomal short arm and 5'-terminus of this base sequence : 61997
cagtggtaaactgcctatcaagacaaaacatgataacctttttagaactagtaatttgtagcaaacacacacacacacacacacacacacacacacacacattccccatacacagaagcgcatgggaggtggggctataatgttcaggtaacatgcaa

SEQ ID NO: 24497 - DNA, 168 bp, Homo sapiens
  D20S172
  Located on chromosome 20
  Distance between a terminus base of telomere on chromosomal short arm and 5'-terminus of this base sequence : 13555861
  Distance between 3'-terminus of neighbour sequence of sequence listing upward to telomere on chrosomal short arm and 5'-terminus of this base sequence : 7621
aaatgatatgtctgcataattccctttactctgtgtgtgtgtgtgtctctgtggtatttacacacacacacacacacacacacacacacacacatacatatacacatatttcttttgccttgtctcttcctcttccccatgcatggagttaagaacggtgtacttttc

SEQ ID NO: 24498 - DNA, 424 bp, Homo sapiens
  20_15307033
  Located on chromosome 20
  Distance between a terminus base of telomere on chromosomal short arm and 5'-terminus of this base sequence : 13668507
  Distance between 3'-terminus of neighbour sequence of sequence listing upward to telomere on chrosomal short arm and 5'-terminus of this base sequence : 112478
gagtcaaatcatattgtccacagaaaccacattaacacagaggaaatactcttatttatttatttatttatttatttatttatttatttattgagacagagtcttgccctgtcgcccaggctggagtgcagtggcacgatcttgactcactgtacctctgcctcctgggttcaagcgattctcctaattcagcctcccaagtagctgggattacaggtgcgcgccaccacatccacctaatttttgcatttttagtagaggcagggtttcgccatgttggccaagctggtcttgaattcctgacctcaggtgatccacctgccttggcctcccaaagtgcacggattacaggcataagccaccacacccagccaggaaatactcttgataaaggaatttaatgacaataaggtgacagatgagc

SEQ ID NO: 24499 - DNA, 250 bp, Homo sapiens
  AL117333.26_4398
  Located on chromosome 20
  Distance between a terminus base of telomere on chromosomal short arm and 5'-terminus of this base sequence : 13843246
  Distance between 3'-terminus of neighbour sequence of sequence listing upward to telomere on chrosomal short arm and 5'-terminus of this base sequence : 174315
attgccacaaatagtaccacacttagagatcaccaccattaaattaagctttaagggcaatacaatgcaaatgagtaatttctctttttctctttctttctttctttctctttctttctttctttctttctttctttctttctttctttctttcttttcttttcttttcttttctttttttttctttatttgagggacacggtctggttctgttgcccaggctggagtgtagtgacatgatcacagctca

SEQ ID NO: 24500 - DNA, 294 bp, Homo sapiens
  AL136992.22_43189
  Located on chromosome 20
  Distance between a terminus base of telomere on chromosomal short arm and 5'-terminus of this base sequence : 14074223
  Distance between 3'-terminus of neighbour sequence of sequence listing upward to telomere on chrosomal short arm and 5'-terminus of this base sequence : 230727
gagcatgcaatttagtatgtacagcatggaatagtgattgccggtggctgggtggggggaaaatgggaagctgttggtcaaagcatagaagctttaagttataaataaattttggagacctaatgtattgtatggtgactgtagttaataagaatgtacttgaaatttgctaagagaatagatcttaagttttccacacacacacacacacacacacacacacacacacacacacacggtaactatgtgagattacggatgtgctaattagtttgattgtggaaatcattctac

SEQ ID NO: 24501 - DNA, 452 bp, Homo sapiens
  20_15991151
  Located on chromosome 20
  Distance between a terminus base of telomere on chromosomal short arm and 5'-terminus of this base sequence : 14352555
  Distance between 3'-terminus of neighbour sequence of sequence listing upward to telomere on chrosomal short arm and 5'-terminus of this base sequence : 278038
caaggtgctgtgtttattctctaaaagagtctcacttacctgttagtttggcttcaaaaacttttagcaacctgaactttaattttctgttatgtgaacacacagacaccacacacacacgctatctatctatatatctatctattatctatctatctatctatcatctatctatctatctatctatctatctatctatctatctatctctgcaaggtcttatggcttatttttcttcctaagttctagacttgttttattttatcttcttattcttcctctgagttccctgttttagttaaaagtttgcattatatattgtagcaaattgtttttgaggaaatgtactatatttattcaatacaaaaagataaatgcgtacatgtctagaggactgagaagatagatactttgaaaactgccctaagattgaatgtaataggaagatgaaa

SEQ ID NO: 24502 - DNA, 245 bp, Homo sapiens
  AL121582.19_90512
  Located on chromosome 20
  Distance between a terminus base of telomere on chromosomal short arm and 5'-terminus of this base sequence : 14451039
  Distance between 3'-terminus of neighbour sequence of sequence listing upward to telomere on chrosomal short arm and 5'-terminus of this base sequence : 98032
tcacatagccaagatatggaagcaacccagtatctatccgtagttgaatgaataaagaatatgtgagatacacacacacgcacacacacacacacacacacacacacacacacgatggaatattatacacccttaaaaaagaagaaaattctggcatttgtgacaacatggatggacctggaacattatgacattatgctaaatgaaataagccaggcacagaaagacaaatactgcatgatctc

SEQ ID NO: 24503 - DNA, 331 bp, Homo sapiens
  AL121582.19_111673
  Located on chromosome 20
  Distance between a terminus base of telomere on chromosomal short arm and 5'-terminus of this base sequence : 14472180
  Distance between 3'-terminus of neighbour sequence of sequence listing upward to telomere on chrosomal short arm and 5'-terminus of this base sequence : 20896
aaatgcaaggaatctttaggagcaaaatgataataagaggttatttttatctttgaacaaaatctaacctaactgggctgaaacccaataggtaacattggtgtgtgtgtgtgtgtgtgtgtgtgtgtgtgtgtgtgcatgcatgtgtgcctgcatttatgtgtgcatgtatacattaagtcacattttttatatttgtttcacttttgattgaaggcagatattgttggagaacagatctatttgtgaaaccttattgggaacatccaaattggcaaaatgacttggtgcccatctgcagtaaattaagatgtacatctgactaggttgg

SEQ ID NO: 24504 - DNA, 353 bp, Homo sapiens
  AL121582.19_152841
  Located on chromosome 20
  Distance between a terminus base of telomere on chromosomal short arm and 5'-terminus of this base sequence : 14513361
  Distance between 3'-terminus of neighbour sequence of sequence listing upward to telomere on chrosomal short arm and 5'-terminus of this base sequence : 40850
gaaattcaaggttacagtaagctatgatggcaccactacactccagcctgggcgacagagcaagatcatttcttaaaaagaaaaggaaagagaagagaagagaagagaagagaagagaagagaagagaaaacaactatgtaagaaatatctgcttcaagttagaattcagaaaaaattcatgaaactagaaagaaaagtagaagaaatggatatcaattccctcaatgtaagatgaagacacttaggctaaatgactgaattgattcctccatcaagcttcttatagagctagatccagaacccaggatttctgaagtacaacctgttgttctttctagtctatgacttgcca

SEQ ID NO: 24505 - DNA, 398 bp, Homo sapiens
  AL354773.8_30332
  Located on chromosome 20
  Distance between a terminus base of telomere on chromosomal short arm and 5'-terminus of this base sequence : 14599027
  Distance between 3'-terminus of neighbour sequence of sequence listing upward to telomere on chrosomal short arm and 5'-terminus of this base sequence : 85313
tggatactaggcttaatatctggatgatgaaataatctgtacaacaaacccctctgacataggtttacctatataacaaacctgcacatgtacccctgaacttaaatgttaaatgaaaacataataaaaataaaacagggatgtatacacacacacacacacacacacacacacacacacacatgcacacatatatatatataaaatgatgtgcatatataatggtcatatatatatgaggtaaaatattaacaattgagaaatctggatgaaggagatatggagatataggagttctttatactggctttgcaaattttttaaaagtttgaaagtattttaaaaataaattatgtaaagggatcataccatatgtagttacgcattaattgtcacaa

SEQ ID NO: 24506 - DNA, 455 bp, Homo sapiens
  chr20.fa.O7frz.16599268
  Located on chromosome 20
  Distance between a terminus base of telomere on chromosomal short arm and 5'-terminus of this base sequence : 14809587
  Distance between 3'-terminus of neighbour sequence of sequence listing upward to telomere on chrosomal short arm and 5'-terminus of this base sequence : 210162
tgttggtactttaacagataagaactattttaattttgtgttcaattgagtcaaccctaatttgtttagaaacttctggaattgaatgcaatctgttaaaagtaaagacgtgttaggccagataataatattgctttaagcttgcctatctctaacacttattaggagaatatatttatatctgtctttttaaagtaagtattgaaacagctttgtttaattctcttttggtaagaaagatttctttcataacatttgcataatttttaaaaaaataattgtacaaaaatcacagaaccagtaaagaaatatctgtgacttgagggtctcaggaaggcagtatcaaatggagattcatttatttatttatttatttatttatttatttattgaggtgctgtccttttttaagagtgtatttgttcctctttttgtaaactgcagacaacttgaac

SEQ ID NO: 24507 - DNA, 391 bp, Homo sapiens
  AL031677.5_65728
  Located on chromosome 20
  Distance between a terminus base of telomere on chromosomal short arm and 5'-terminus of this base sequence : 15009025
  Distance between 3'-terminus of neighbour sequence of sequence listing upward to telomere on chrosomal short arm and 5'-terminus of this base sequence : 198983
gccaattgtaaggtaatcttttaacataagaaactgcattaattttctataaacccaaagacttgcacaattatttcagaagtgtaattctcccaacacacacacacacacacacacacacacacacacacacacacacgtaccacatttcttttcagtagcttgactataacttggaaaaaatgctttagagaaatcacttcaggatggtggaaaaaacaaagaatcataattctccttatgtgtaatcaatagtaacactccatctcatgtataagtttcatatactttcaagtccagctctctggctttgttcatttcattcaacaggactgaaacaaaggtcttggcctcagtttttcacatgaagatgtttgcaaaggaaacagta

SEQ ID NO: 24508 - DNA, 275 bp, Homo sapiens
  AC012380.1_29458
  Located on chromosome 20
  Distance between a terminus base of telomere on chromosomal short arm and 5'-terminus of this base sequence : 15103919
  Distance between 3'-terminus of neighbour sequence of sequence listing upward to telomere on chrosomal short arm and 5'-terminus of this base sequence : 94503
tctgtcacctcaggtaagtcacttactttccctgggcctcttgattttaatacatataaatcgagggcattctaggatcctaggatcctatgccaaggatgaatacactttctgtgctgccaaaagtttgccgacatggtcagctaaaagcctcttcctctctccacattgtgggatgtgtgtgtgtgtgtgtgtgtgtgtgtgtgtgtgtgtgtgtgtgtgtgttgacatgaattatttccatcatttaaaaactcagaaagatggaattgaaa

SEQ ID NO: 24509 - DNA, 89 bp, Homo sapiens
  D20S910
  Located on chromosome 20
  Distance between a terminus base of telomere on chromosomal short arm and 5'-terminus of this base sequence : 15104078
  Distance between 3'-terminus of neighbour sequence of sequence listing upward to telomere on chrosomal short arm and 5'-terminus of this base sequence : -116
ctctccacattgtgggatgtgtgtgtgtgtgtgtgtgtgtgtgtgtgtgtgtgtgtgtgtgtgtgttgacatgaattatttccatcatt

SEQ ID NO: 24510 - DNA, 415 bp, Homo sapiens
  AC012380.1_53025
  Located on chromosome 20
  Distance between a terminus base of telomere on chromosomal short arm and 5'-terminus of this base sequence : 15127497
  Distance between 3'-terminus of neighbour sequence of sequence listing upward to telomere on chrosomal short arm and 5'-terminus of this base sequence : 23330
cctgattcatgaagcatttaagttatataacaacaaccaaatcatcaaaaatttagaaaactacacatatgtgtatatatatatatatagagagagagagagttaatacatatatacaactttatatagttaaataaattatataactatatgtgccctctattaactatgtatctatctatctatctatctatctatctatctatctatctatctatctaaaactctctctctctccatatatattagtttatttgggaattgatcccagaaaatattaatcctctcttccctttccttcccacctttctcattcttccccttttccgtctcctctgtcttcactccttcctctccgcctcttcctttctgttcataactctcattgtttgtacatgtaacttggatcaccttc

SEQ ID NO: 24511 - DNA, 250 bp, Homo sapiens
  AL049633.3_75257
  Located on chromosome 20
  Distance between a terminus base of telomere on chromosomal short arm and 5'-terminus of this base sequence : 15150832
  Distance between 3'-terminus of neighbour sequence of sequence listing upward to telomere on chrosomal short arm and 5'-terminus of this base sequence : 22920
gaagcactatgaaacagctagttcaaagtcatgaaaatattgaatattttttttctcctttttctcctgtattttgtgtgtgtgtgtgtgtgtgtgtgtgtgtgtgtgtgtgtgtgtgtattttcaaccaggaagcatatgcttttttatcatgttgggaaaataaaatcctaccttttaaccttaaaaaaactatgaagatcttagcaatttctacaattcagttgtttgttaggtgaggaatacattc

SEQ ID NO: 24512 - DNA, 250 bp, Homo sapiens; identical to SEQ ID NO: 24511
  AC012380.1_76269
  Located on chromosome 20
  Distance between a terminus base of telomere on chromosomal short arm and 5'-terminus of this base sequence : 15150832
  Distance between 3'-terminus of neighbour sequence of sequence listing upward to telomere on chrosomal short arm and 5'-terminus of this base sequence : -250

SEQ ID NO: 24513 - DNA, 245 bp, Homo sapiens
  AC008057.2_7971
  Located on chromosome 20
  Distance between a terminus base of telomere on chromosomal short arm and 5'-terminus of this base sequence : 15224380
  Distance between 3'-terminus of neighbour sequence of sequence listing upward to telomere on chrosomal short arm and 5'-terminus of this base sequence : 73298
tttgtactgagtcatgctactgacttccctggttctctagcttgcagaaagcttatggtgggacttttaagcctccataatcaagtgggacaattcctcttataaatctcctctctgtctctctatatgtctgtctgtctgtctatctatctatctatctatctatctatctatctatctatctcctctccatcctattggttctgtttttctggagaaccctgatacaaagactgtttctgaca

SEQ ID NO: 24514 - DNA, 208 bp, Homo sapiens
  HUMUT759
  Located on chromosome 20
  Distance between a terminus base of telomere on chromosomal short arm and 5'-terminus of this base sequence : 15224450
  Distance between 3'-terminus of neighbour sequence of sequence listing upward to telomere on chrosomal short arm and 5'-terminus of this base sequence : -175
gcctccataatcaagtgggacaattcctcttataaatctcctctctgtctctctatatgtctgtctgtctgtctatctatctatctatctatctatctatctatctatctatctcctctccatcctattggttctgtttttctggagaaccctgatacaaagactgtttctgacactattgaccaatatccacatcaagggtctggtt

SEQ ID NO: 24515 - DNA, 265 bp, Homo sapiens
  AL049867.2_5144
  Located on chromosome 20
  Distance between a terminus base of telomere on chromosomal short arm and 5'-terminus of this base sequence : 15231128
  Distance between 3'-terminus of neighbour sequence of sequence listing upward to telomere on chrosomal short arm and 5'-terminus of this base sequence : 6470
tggtaaccaaagactagatggagggaagtttctgtgtataagtgaaatagcgatgatagaatgccattttgcaaacctaattaattcaaggatctatgcaatacttatcaatgtctgtcatcacacacacacacacacacacacacacacacacatgcacacaccccagaccttaagtgtgtcttatacatcatcacttataaagtactttagccaccactcacaccccccaactcaccaatcctccagacataattgtggagtc

SEQ ID NO: 24516 - DNA, 179 bp, Homo sapiens
  D20S898
  Located on chromosome 20
  Distance between a terminus base of telomere on chromosomal short arm and 5'-terminus of this base sequence : 15231220
  Distance between 3'-terminus of neighbour sequence of sequence listing upward to telomere on chrosomal short arm and 5'-terminus of this base sequence : -173
tctatgcaatacttatcaatgtctgtcatcacacacacacacacacacacacacacacacacatgcacacaccccagaccttaagtgtgtcttatacatcatcacttataaagtactttagccaccactcacaccccccaactcaccaatcctccagacataattgtggagtcctaata

SEQ ID NO: 24517 - DNA, 196 bp, Homo sapiens
  HUMUT1677
  Located on chromosome 20
  Distance between a terminus base of telomere on chromosomal short arm and 5'-terminus of this base sequence : 15253046
  Distance between 3'-terminus of neighbour sequence of sequence listing upward to telomere on chrosomal short arm and 5'-terminus of this base sequence : 21647
agcaaaactgactcaagaagaaacattagtattagtgttctccagtgaaacagagctaagaagatatctatatctctgtccatccatctaatctatctatctatctatctatctatctatctatctatctatctgtctatctatctctatcaagatatttattataaagaattggttcacttgataatggaggctg

SEQ ID NO: 24518 - DNA, 315 bp, Homo sapiens
  AC008057.4_81771
  Located on chromosome 20
  Distance between a terminus base of telomere on chromosomal short arm and 5'-terminus of this base sequence : 15253084
  Distance between 3'-terminus of neighbour sequence of sequence listing upward to telomere on chrosomal short arm and 5'-terminus of this base sequence : -158
tctccagtgaaacagagctaagaagatatctatatctctgtccatccatctaatctatctatctatctatctatctatctatctatctatctatctgtctatctatctctatcaagatatttattataaagaattggttcacttgataatggaggctgaaaagatccaagatctggagaaccaaaaaagttgagaatataagttccagtccaatggctttttgagtctggcaggcttcagactcaaaaacaaccagtgtttcagtttgagtctaaaggcagaaaaatagcaatgtttcagctaaaggtagtcaag

SEQ ID NO: 24519 - DNA, 168 bp, Homo sapiens
  D20S852
  Located on chromosome 20
  Distance between a terminus base of telomere on chromosomal short arm and 5'-terminus of this base sequence : 15382610
  Distance between 3'-terminus of neighbour sequence of sequence listing upward to telomere on chrosomal short arm and 5'-terminus of this base sequence : 129211
ccaggaaatgtaaaaatacttgacttgaaagactttttaaagatacctctgcacatgttaaaggcagtggcagtactgggacctaagagtgtgcgtgtgtgtgtgtgtgtgtgtgtgtgtgtgtgtgtgtctgtgtgttgtataggaagtatcccagtgcagttcttc

SEQ ID NO: 24520 - DNA, 275 bp, Homo sapiens
  AL121584.24_15540
  Located on chromosome 20
  Distance between a terminus base of telomere on chromosomal short arm and 5'-terminus of this base sequence : 15389909
  Distance between 3'-terminus of neighbour sequence of sequence listing upward to telomere on chrosomal short arm and 5'-terminus of this base sequence : 7131
tctttgctgtaggttataagcatcttgctgcggtattcttttcaaattattggaatctctctttccctgccttacatcctgccctaacactgccttcccctctcatgttcccctaacaaatgctatatccctctcatttgacatattcaaacacacacacacacacacacacacacacacacacacacacacacacacccttattatacaacttagtttccggactgcaacagttgtctagatgtttctgagttaggaaacttgttgaatcgata

SEQ ID NO: 24521 - DNA, 320 bp, Homo sapiens
  AL121584.24_94678
  Located on chromosome 20
  Distance between a terminus base of telomere on chromosomal short arm and 5'-terminus of this base sequence : 15469003
  Distance between 3'-terminus of neighbour sequence of sequence listing upward to telomere on chrosomal short arm and 5'-terminus of this base sequence : 78819
ttaggcattaggacagtgctacataagacagatgctttctaccgtaatttataaacatacgctttaggacatgtaatttttcccatttgtattacggggtactttaagtgtagttgtaatactttagagttatttcagacaacaaaaaaacccttagagatcatctatccaactttctgtctctgtctctgtcgctctctctctctctctctctctctctctctctctctctttttaagaagaaactcagtcccagtgcactaggtgactggtacaggggaaagtaacttagggaagaaaaggaagcatcctgtaggtac

SEQ ID NO: 24522 - DNA, 468 bp, Homo sapiens
  AL050324.5_21272
  Located on chromosome 20
  Distance between a terminus base of telomere on chromosomal short arm and 5'-terminus of this base sequence : 15540825
  Distance between 3'-terminus of neighbour sequence of sequence listing upward to telomere on chrosomal short arm and 5'-terminus of this base sequence : 71502
acctacaaggcaacttatgtgtagtccatgacttgatctcttttatttcctttgtatgaggagaaattgtgcctggatggaaaatcatgagtcttcctctctctgagcactcttgactctcctgtcttggggcatcattctttgtaatatagatttttttttcataatttcccacagttgccatagacagatgcaaaatgaaaagagggtattgattctctttcttttgtggggcatagactctttcagataacttcagttagaaaaaacaggatgtaagcgtgtgtgtgtgtgtgtgtgtgtgtgtgtgtgtgtgtatcagtgttggttctcaaccctgatttttcttttggagtaaatcagtgttggacccaaaaagcaaaaccaaatagaataaacaaaatgaataaactaacaattacctaatagctaagaacatgaactctgtaatcacatgaggtcacataa

SEQ ID NO: 24523 - DNA, 333 bp, Homo sapiens
  AL050324.5_83318
  Located on chromosome 20
  Distance between a terminus base of telomere on chromosomal short arm and 5'-terminus of this base sequence : 15603077
  Distance between 3'-terminus of neighbour sequence of sequence listing upward to telomere on chrosomal short arm and 5'-terminus of this base sequence : 61784
ggtatttctttatttcaatgcaagaatgacctaatacactatctatgtatctatgtatctatgtatctatctatgtatctatctatctatctatctatctatgaaagcaaattggagaaattatgacaattcatcccaaatgcttcaacttgcatctccaaagaatatagacattctgctgcacaaccatagtatcattattatacccccaaaatggacaaaaattacatatcatctaatacccagccatatttgaattccctcaattaatcctcccacctgttacggctctttactgttgttactgttgttgaaaccaatcatagattaagc

SEQ ID NO: 24524 - DNA, 173 bp, Homo sapiens
  Z16471.1_120
  Located on chromosome 20
  Distance between a terminus base of telomere on chromosomal short arm and 5'-terminus of this base sequence : 15607915
  Distance between 3'-terminus of neighbour sequence of sequence listing upward to telomere on chrosomal short arm and 5'-terminus of this base sequence : 4505
tcctgtcaagaacttgcataaccctgaatggtgattagtaatgctagttaagcatgctagttcattttcaaaatctgttctattttacacacacacacacacacacacacacacacacacacacgtagagtcattcattcactcattcattcatttgataggaagttaagtgg

SEQ ID NO: 24525 - DNA, 263 bp, Homo sapiens
  D20S98
  Located on chromosome 20
  Distance between a terminus base of telomere on chromosomal short arm and 5'-terminus of this base sequence : 15607924
  Distance between 3'-terminus of neighbour sequence of sequence listing upward to telomere on chrosomal short arm and 5'-terminus of this base sequence : -164
gaacttgcataaccctgaatggtgattagtaatgctagttaagcatgctagttcattttcaaaatctgttctattttacacacacacacacacacacacacacacacacacacacgtagagtcattcattcactcattcattcatttgataggaagttaagtggcatgtagtagacatctgttgtttgtttttgtcaccccaaatctgtttgcttttctcctgacaacaccattctgactttcttttggggaacatacccttg

SEQ ID NO: 24526 - DNA, 113 bp, Homo sapiens
  D20S904
  Located on chromosome 20
  Distance between a terminus base of telomere on chromosomal short arm and 5'-terminus of this base sequence : 15680312
  Distance between 3'-terminus of neighbour sequence of sequence listing upward to telomere on chrosomal short arm and 5'-terminus of this base sequence : 72125
agaatacagttgcaaagagacagaaaccaagtatacacacacacacacacacacacacacacacacacacacacacactacacacaaggtgtttttaggtgccgtttcagaag

SEQ ID NO: 24527 - DNA, 267 bp, Homo sapiens
  AL079338.15_54950
  Located on chromosome 20
  Distance between a terminus base of telomere on chromosomal short arm and 5'-terminus of this base sequence : 15845889
  Distance between 3'-terminus of neighbour sequence of sequence listing upward to telomere on chrosomal short arm and 5'-terminus of this base sequence : 165464
gctccactaaatcaagtgtgagcttcaagtcctcagtggcaccaagcgttatttcaagagttattcttcctttgtgtatgaaaatttgcattttgaatgtgtgtcatcagagaagtaatgggaaattggggattgtgatgtggccaagtcagaggacatgtgtgtgtgtgtgtgtgtgtgtgtgtgtgtgtgtgtaactatcaccattctttttctctaaaagagagttttgatggtagatgaggacgtaggaccactagattcaaa

SEQ ID NO: 24528 - DNA, 368 bp, Homo sapiens
  AL079338.15_14030
  Located on chromosome 20
  Distance between a terminus base of telomere on chromosomal short arm and 5'-terminus of this base sequence : 15886787
  Distance between 3'-terminus of neighbour sequence of sequence listing upward to telomere on chrosomal short arm and 5'-terminus of this base sequence : 40631
gttatggagtggtatcggaaaaacattctctcaagtttcagaaagggatgtagcctatcttagtttttgacaatagattttcacaagcaggaatgttttgctctgactcttttctaatgacatttgttgtcagctattctgccactgttcctaggaggatatatttatctagacacacacacacacacacacacacacacacacacacacacacacaaagagagagagagagagaaagagcacaggggaagatgtctcaactgctgcattctttaataagaagaaaggaataattggctggctagtggcaagactggaacattttttaatcaagtaaaaagacaaggtttaagcattgatggcattta

SEQ ID NO: 24529 - DNA, 178 bp, Homo sapiens
  D20S104
  Located on chromosome 20
  Distance between a terminus base of telomere on chromosomal short arm and 5'-terminus of this base sequence : 16142071
  Distance between 3'-terminus of neighbour sequence of sequence listing upward to telomere on chrosomal short arm and 5'-terminus of this base sequence : 254916
aataaaacctgaatgggcttctgttgcccatcccctagtccagagtaatttcatatgtctgtccccagcccatcatcacacacacacacacacacacacacacacacacacacacacacacatgcaggcaccaatttaaaaagaggaactcctcaaggggccaacttgtatttccata

SEQ ID NO: 24530 - DNA, 214 bp, Homo sapiens
  AL117376.28_14846
  Located on chromosome 20
  Distance between a terminus base of telomere on chromosomal short arm and 5'-terminus of this base sequence : 16191992
  Distance between 3'-terminus of neighbour sequence of sequence listing upward to telomere on chrosomal short arm and 5'-terminus of this base sequence : 49743
aggcatctttctgatgtaattaaaacttacttgagtcatcagttgatgctacgggaaatcgtcctggaaatttaggtgggcctggttaaagccattggaaggccttaaaaggaagactggtgtgtgtgtgtgtgtgtgtgtgtgtgtgtgtgtgtgtgtgtgtgtgtgagagagagagagagagagagaattctacctatggatgacagctttg

SEQ ID NO: 24531 - DNA, 254 bp, Homo sapiens
  AL117376.28_112865
  Located on chromosome 20
  Distance between a terminus base of telomere on chromosomal short arm and 5'-terminus of this base sequence : 16290012
  Distance between 3'-terminus of neighbour sequence of sequence listing upward to telomere on chrosomal short arm and 5'-terminus of this base sequence : 97806
gaactaatggaagccagtcttcactctctaattaaaaaacacagtcatgatgcaaacacaacttccgaaattgtttttatattcatgtataatcacatatatgtacaaatggaattctacacacacacacacacacacacacacacacacacaatttagaatggttgagaacaaatgaaaaagaaattgaccaggagatagatattaggtcaggggcagtgggaagtagtggatcaaggacatagcgtaacatt

SEQ ID NO: 24532 - DNA, 178 bp, Homo sapiens
  AL118509.9_8204
  Located on chromosome 20
  Distance between a terminus base of telomere on chromosomal short arm and 5'-terminus of this base sequence : 16347560
  Distance between 3'-terminus of neighbour sequence of sequence listing upward to telomere on chrosomal short arm and 5'-terminus of this base sequence : 57294
tttctgatgaggaatgttcaacgtgtgtgtgtgtgtgtgtgtgtgtgtgtgtgtgtgtgtgtgtgactcattgctaataaatgaaactataggagtaggaaagaaacctgagacaaaatacagaggtagaagacaagaggacctaacattgggcacctgaaggaatgctgacttctaa

SEQ ID NO: 24533 - DNA, 395 bp, Homo sapiens
  AL118509.9_36808
  Located on chromosome 20
  Distance between a terminus base of telomere on chromosomal short arm and 5'-terminus of this base sequence : 16375964
  Distance between 3'-terminus of neighbour sequence of sequence listing upward to telomere on chrosomal short arm and 5'-terminus of this base sequence : 28226
agaataagccagaagtgaatacaggaattttaatatttagttctaataaactatcatcataaataatttaataactgtccccaaaatctgtatctagcatcacatcagacaggcacctatgatgtcactgaaaatgaactaaaaatataaaagccttgctttttccatgactttaaaacaatccatattacaatacctatggttaaaacacacaagcgcgcgcacacacacacacacacacacacacacacacacacacacacacacacacacaggtacacatttagaaccaatgaggaagagccacaggactcaccagggcagaattaggagaagaagggtctggctaccaccacaccatggcaccaacaaacctaaatgtcctgacattactg

SEQ ID NO: 24534 - DNA, 305 bp, Homo sapiens
  AL118509.9_52371
  Located on chromosome 20
  Distance between a terminus base of telomere on chromosomal short arm and 5'-terminus of this base sequence : 16391676
  Distance between 3'-terminus of neighbour sequence of sequence listing upward to telomere on chrosomal short arm and 5'-terminus of this base sequence : 15317
gtttcttacaatgtccttcaatacggtatttttccaaaaattagttcaataaaaggaattcttctactggagccaatacaatacaatacaatacaatacaatacaatacaatacaatacaatacaatacaatacagacatataattctgatgatctggcctaatctgggaaaagatttctcagtatcctgaatccaaatcaccatattttactcacataaacccttggcagattcccatttcctaaaggagactcagtttggaatacatagttctcaaatacttaaattctgaaattcacatgac

SEQ ID NO: 24535 - DNA, 190 bp, Homo sapiens
  HUMUT1674
  Located on chromosome 20
  Distance between a terminus base of telomere on chromosomal short arm and 5'-terminus of this base sequence : 16577054
  Distance between 3'-terminus of neighbour sequence of sequence listing upward to telomere on chrosomal short arm and 5'-terminus of this base sequence : 185073
ccccttcaacttgtcagctttaatgataaagaaatacgggtgtagaaaagttaagtgatttgtccaccatgacatagatagatagataggtaggtaggtagctagatagatagatagatagatagatagatagatagatagatagatagatggaataaatgattatagggcaagataccagttggaagga

SEQ ID NO: 24536 - DNA, 243 bp, Homo sapiens
  AL135938.8_11589
  Located on chromosome 20
  Distance between a terminus base of telomere on chromosomal short arm and 5'-terminus of this base sequence : 16607215
  Distance between 3'-terminus of neighbour sequence of sequence listing upward to telomere on chrosomal short arm and 5'-terminus of this base sequence : 29971
gctttcataaataccatggataagtagaaatacctgtgtacctatgctatatccgcccagccatacacacatagacacacacacacacacacacacacacacacacacacacacccaacacattataggcaaaggccagtctgaacttaggaattaaaaaaaagttagatgtggtccccacctagaatgaatagacaaatagacagaaagcaatggtcgctactgcaaattgaattagtggtt

SEQ ID NO: 24537 - DNA, 88 bp, Homo sapiens
  D20S875
  Located on chromosome 20
  Distance between a terminus base of telomere on chromosomal short arm and 5'-terminus of this base sequence : 16607270
  Distance between 3'-terminus of neighbour sequence of sequence listing upward to telomere on chrosomal short arm and 5'-terminus of this base sequence : -188
cccagccatacacacatagacacacacacacacacacacacacacacacacacacacacccaacacattataggcaaaggccagtctg

SEQ ID NO: 24538 - DNA, 411 bp, Homo sapiens
  chr20.fa.O7frz.18475355
  Located on chromosome 20
  Distance between a terminus base of telomere on chromosomal short arm and 5'-terminus of this base sequence : 16685822
  Distance between 3'-terminus of neighbour sequence of sequence listing upward to telomere on chrosomal short arm and 5'-terminus of this base sequence : 78464
ctactgtcaaagttgaaagatgagtaaactttctctataccacccccttttgttttatttcagtttactactttttgtctcatcttttttctatattttttcagctttattgggttataattgacaaataaaaattgcatacatttaatgcatacattatgttttgatatacattgtgaaatgatcatcacattcaagctagttaacacatacatcacctcacatagttacctttgtgtgtgtgtgtgtgtgtgtgtgtgaaaacattaagatctgccctcttagtaaatttcaagtatacaatacagtacctcttttgttttagatgcaagttgtcttgcaaagcagtctatgtaacaaataaagaaaccaaagtcagcactgactcttacagatggttttcactaaaga

SEQ ID NO: 24539 - DNA, 212 bp, Homo sapiens
  AL121592.14_540
  Located on chromosome 20
  Distance between a terminus base of telomere on chromosomal short arm and 5'-terminus of this base sequence : 16841324
  Distance between 3'-terminus of neighbour sequence of sequence listing upward to telomere on chrosomal short arm and 5'-terminus of this base sequence : 155091
actgatcctaccactgcactctagcctgggctagagaatgagagagacctctctctctctctctctctctgtctctgtatatgtgtgtgtgtgtgtgtgtgtgtgtgtgtgtgtgtgtgtgtgtgtgtagttactgctgcttttagcatagttactgctgcttttagccacaatagatgacaaagggaatgtttgtagactgtaagccagga

SEQ ID NO: 24540 - DNA, 380 bp, Homo sapiens
  chr20.fa.O7frz.18893221
  Located on chromosome 20
  Distance between a terminus base of telomere on chromosomal short arm and 5'-terminus of this base sequence : 17103616
  Distance between 3'-terminus of neighbour sequence of sequence listing upward to telomere on chrosomal short arm and 5'-terminus of this base sequence : 262080
ctttagtgaggtgtctgttcagatcttctgcccttttttaacggggttgttttcaaaactcttcaagagttcctcatatatttggaaatagtcctttatcaaatacatcctttgcaaataagaagtgtggcaacatagtaagggcagaactgcaaaatagaagaaaacctgagtctgtaatgatcatgagatgtcttaacgggctcagtatcttaactctgcatatcttttatgtgatagagaaaaatgtctgtctgcttttttgcatttttttttgaaagaaaaagaaagttgaaagaaaaaaagaggaaggaaggaaggaaggaaggaaggaaggaaggaaggaaggaaaaagcagcatggtgctattaatttccttc

SEQ ID NO: 24541 - DNA, 259 bp, Homo sapiens
  D20S114
  Located on chromosome 20
  Distance between a terminus base of telomere on chromosomal short arm and 5'-terminus of this base sequence : 17211937
  Distance between 3'-terminus of neighbour sequence of sequence listing upward to telomere on chrosomal short arm and 5'-terminus of this base sequence : 107941
ccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacataccatgtttatattttttctggcttttgaatatagatgtatcacaagatggggctaggttaa

SEQ ID NO: 24542 - DNA, 199 bp, Homo sapiens
  D20S112
  Located on chromosome 20
  Distance between a terminus base of telomere on chromosomal short arm and 5'-terminus of this base sequence : 17271046
  Distance between 3'-terminus of neighbour sequence of sequence listing upward to telomere on chrosomal short arm and 5'-terminus of this base sequence : 58850
ttcttgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccat

SEQ ID NO: 24543 - DNA, 181 bp, Homo sapiens
  Z16842.1_182
  Located on chromosome 20
  Distance between a terminus base of telomere on chromosomal short arm and 5'-terminus of this base sequence : 17271050
  Distance between 3'-terminus of neighbour sequence of sequence listing upward to telomere on chrosomal short arm and 5'-terminus of this base sequence : -195
tgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgaga

SEQ ID NO: 24544 - DNA, 281 bp, Homo sapiens
  D20S470
  Located on chromosome 20
  Distance between a terminus base of telomere on chromosomal short arm and 5'-terminus of this base sequence : 17327497
  Distance between 3'-terminus of neighbour sequence of sequence listing upward to telomere on chrosomal short arm and 5'-terminus of this base sequence : 56266
tgagtgacagagtgataccatgtgaaagaaagaaaaaaagaaagagagagagaaagagagagaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaagg

SEQ ID NO: 24545 - DNA, 436 bp, Homo sapiens
  AL031664.1_86236
  Located on chromosome 20
  Distance between a terminus base of telomere on chromosomal short arm and 5'-terminus of this base sequence : 17420310
  Distance between 3'-terminus of neighbour sequence of sequence listing upward to telomere on chrosomal short arm and 5'-terminus of this base sequence : 92532
agatctaaagagcctgctttactaagtatgcataaaagacttataattaacatataaatcatacacaaattattatctacagcagtatttttcaaactctagttacatccattagtgggttgtaaaatcaatttaggaggtcagtttttaataaaatagagtaatttagaatacagtaggagagaagaaaatcacaggataggataggatagaatagaatagaatagaatagaatagaatagaataatcatgcataataaggataagtattgtttcctgaaatatttgtttcagatgtgtgtgtgcacacgtgtgtgtgtctgagtgtgtgtactggatcacaatgtaaaatacatttttcattgtgagtgatggtcaaaaatcttttagaaacactattctaaaatatattaatcaggctagactaagttatgct

SEQ ID NO: 24546 - DNA, 211 bp, Homo sapiens
  AL031664.1_108643
  Located on chromosome 20
  Distance between a terminus base of telomere on chromosomal short arm and 5'-terminus of this base sequence : 17442901
  Distance between 3'-terminus of neighbour sequence of sequence listing upward to telomere on chrosomal short arm and 5'-terminus of this base sequence : 22155
gagccatacacatcagataggtaggtgtgtgtgtgtgtgtgtgtgtgtgtgtgtgtgtatttcaacatatccatatggatatagagagataaaacaagggcttcacaaaacaaatcctccctttcacttgctgtacactctgtttttcttattatattttagtctagcattttgttgacttccttttacatgccagtcaattctactgagt

SEQ ID NO: 24547 - DNA, 117 bp, Homo sapiens
  G10264
  Located on chromosome 20
  Distance between a terminus base of telomere on chromosomal short arm and 5'-terminus of this base sequence : 17681750
  Distance between 3'-terminus of neighbour sequence of sequence listing upward to telomere on chrosomal short arm and 5'-terminus of this base sequence : 238638
aggataaacaatatagattagccaagtagatagatgatagattagatagatagatagatagatagatagatagatagatagatagatgatagatatagatggattggatgatggata

SEQ ID NO: 24548 - DNA, 199 bp, Homo sapiens
  D20S182
  Located on chromosome 20
  Distance between a terminus base of telomere on chromosomal short arm and 5'-terminus of this base sequence : 17794371
  Distance between 3'-terminus of neighbour sequence of sequence listing upward to telomere on chrosomal short arm and 5'-terminus of this base sequence : 112504
caacaatgtggggtatagtgtctgtgcagaacttagcatggtgaccgacccagggtgggcactcaggggaagtagggtgtgtgtgtgtgcgtgcgtgcgtgcatgtgcgtgtgcgtgtgcgtgtgtgtgtgtgtgtgtgtgtgtgatgaaagagagagagagagagcctctccaggccctggccagagaccccttggcc

SEQ ID NO: 24549 - DNA, 404 bp, Homo sapiens
  AL121585.22_27371
  Located on chromosome 20
  Distance between a terminus base of telomere on chromosomal short arm and 5'-terminus of this base sequence : 17856125
  Distance between 3'-terminus of neighbour sequence of sequence listing upward to telomere on chrosomal short arm and 5'-terminus of this base sequence : 61555
acctgtatcctggcactttgggaggccaaagcaggaggatcgcttgaggctaggagttcaagaccagcctgggcaacatggcaaaatcccatctctacaaaaaattttaaaattagccaggcatgctggcatgtgcctgtagtcccagctacatggaaagctgaggtgggtggatcgcttgagcccaggagtctgaggttgcagtgagctgtgatcacaccactgcactccagtctgggtggtaaagtgagaccctgtctcagaaaactattattattattattattattattattattattattgttattgttattttgctctgtgaaagactgttgagagggtgaaaggcaagctataaactaggagataatatttgtgagtcacttattcaacaaaggaca

SEQ ID NO: 24550 - DNA, 252 bp, Homo sapiens
  AL121585.22_89896
  Located on chromosome 20
  Distance between a terminus base of telomere on chromosomal short arm and 5'-terminus of this base sequence : 17918791
  Distance between 3'-terminus of neighbour sequence of sequence listing upward to telomere on chrosomal short arm and 5'-terminus of this base sequence : 62262
taaatgaaatcatgcagtatttgtctttttgtgcccagcttatttcactcagcaaaatgttcaccatgttcacccatgtcacaaatgacagaatttccttctttttaaaggctatgtagtgttctattgtgtgtgtgtgtgtgtgtgtgtgtgtgtgtgtgtatccacattttctttatccatttatccatagatggacacttaggttgtttccgcatcttggcctttgtaaataatgcttcagtgaacctg

SEQ ID NO: 24551 - DNA, 127 bp, Homo sapiens
  D20S885
  Located on chromosome 20
  Distance between a terminus base of telomere on chromosomal short arm and 5'-terminus of this base sequence : 17918861
  Distance between 3'-terminus of neighbour sequence of sequence listing upward to telomere on chrosomal short arm and 5'-terminus of this base sequence : -182
cacccatgtcacaaatgacagaatttccttctttttaaaggctatgtagtgttctattgtgtgtgtgtgtgtgtgtgtgtgtgtgtgtgtgtatccacattttctttatccatttatccatagatgg

SEQ ID NO: 24552 - DNA, 447 bp, Homo sapiens
  chr20.fa.O7frz.19766668
  Located on chromosome 20
  Distance between a terminus base of telomere on chromosomal short arm and 5'-terminus of this base sequence : 17990088
  Distance between 3'-terminus of neighbour sequence of sequence listing upward to telomere on chrosomal short arm and 5'-terminus of this base sequence : 71100
ccactgcctaagaaactaattcttggctggatgcggtggctcacgcctgtaatcccagcactttgggaggctgaggcaggcggatcacctgaggtcgggagttcaagaccaggctgaccaacatggagaaaccctgtctctactaaaattacaaaattagccggcgatggtggcgtatgcctgtaatcccagctgctcggaaggctgaggcaggagaatcacttgaacccgggaggcagaggttgcagtgagctaagatccagccattgcactcagctaagatccagccattgcactccagcctgggcaacaacagcgaaactccatctcaaaaaaaaaaaaaaaagaaagaaaagaaaagaaaagaaaagaaactaattcttagagaaattgtgagttcagcatgccttggaaagaactttataattatacaacgtgctaagtcac

SEQ ID NO: 24553 - DNA, 411 bp, Homo sapiens
  AL160411.22_83256
  Located on chromosome 20
  Distance between a terminus base of telomere on chromosomal short arm and 5'-terminus of this base sequence : 18043195
  Distance between 3'-terminus of neighbour sequence of sequence listing upward to telomere on chrosomal short arm and 5'-terminus of this base sequence : 52660
agttgatggatctacactgacatctcatcatcacccaaagtccatagtttattcactcttttgttttgttttgttttgttttgttttgtttttgagacgaagtctcactctgttgcccaggctggagtacagtggtgcgatctcggctcactgcaaccttcgcctcctgggttcaagcaattatcctgccttcagcttaccgagtagctgggattacagactcatgccaccaagcccagctaatttttgtacttttagtagagatggggtttcaccatactggtcaggctggtgtcaaactcctgacctcaggtgatccacctgccttggcctcccaaagtgctgggattacaggcgtgagccactgcacccagcctcaattcactcttggtgttgaacattctgtggatg

SEQ ID NO: 24554 - DNA, 414 bp, Homo sapiens
  chr20.fa.O7frz.20017805
  Located on chromosome 20
  Distance between a terminus base of telomere on chromosomal short arm and 5'-terminus of this base sequence : 18203077
  Distance between 3'-terminus of neighbour sequence of sequence listing upward to telomere on chrosomal short arm and 5'-terminus of this base sequence : 159471
agcttccaattaaagatttcactctcatcttagaattttagttggggaagcaaaaagatgcagctacaagggtaacgtttacacagagaatggcatttgaatgaagctcagttccaactgctagcttaccaccctcagccccttccttaaccaacgtatgtaaaggatgctgaggctggtgtggatttcctatgctattgtttattaagatctgttccctggggataggtggaagaaggggacccaatataggaggaaccttgactttctctggaaaatacgccaatttttgttagagaagaatatgatgtagtgatgtattgagagagagagagagagagagagagagagagagatgtataatacacacaaatgtatgtagaatccattgttctacacgatgagaatctattg

SEQ ID NO: 24555 - DNA, 238 bp, Homo sapiens
  D20S860
  Located on chromosome 20
  Distance between a terminus base of telomere on chromosomal short arm and 5'-terminus of this base sequence : 18289181
  Distance between 3'-terminus of neighbour sequence of sequence listing upward to telomere on chrosomal short arm and 5'-terminus of this base sequence : 85690
gtctctgccacacaatgccattacccttgccattatctgtatacctaaatttgatcattttgtgtgtgtgtgtgtgtgtgtgtgtgtgtgtgtgtgttttgaaaaagatttagtaaaacatttcccaacaagtgaaagttcttggctgggcgtggtggctcacgcctgtaatcccagcactttgggaggctgaggcgggcagatcacctgaggtcgggagttcaagaccagcctgacc

SEQ ID NO: 24556 - DNA, 322 bp, Homo sapiens
  AL121893.21_88
  Located on chromosome 20
  Distance between a terminus base of telomere on chromosomal short arm and 5'-terminus of this base sequence : 18345152
  Distance between 3'-terminus of neighbour sequence of sequence listing upward to telomere on chrosomal short arm and 5'-terminus of this base sequence : 55733
ttatgaagttctttaggctgaaagcacatgaccctagagagtaatatgaatacacacacacacacacacacacacacacacaccaccaccaccaccatcaccaccagtaaaggtaattatgtaattataaaagacattataaatgcatatttcttttcccttcttctcaacagattcaaaaagagagtatgtaaaacaatatgaatatgaatataattatacagtttggcctataacatatagaaataagatatattgaccaataacaacacaaagaaggtgggtgaggccaggcgtggtggctcacgcctgtaatcctagc

SEQ ID NO: 24557 - DNA, 193 bp, Homo sapiens
  AL121893.21_18143
  Located on chromosome 20
  Distance between a terminus base of telomere on chromosomal short arm and 5'-terminus of this base sequence : 18363218
  Distance between 3'-terminus of neighbour sequence of sequence listing upward to telomere on chrosomal short arm and 5'-terminus of this base sequence : 17744
ggtaagttggaaattctgcactggttatgtgtaaggttgggtgtgtgtgtgtgtgtgtgtgtgtgtgtgtgtttctccagtgtgaaaaccgtgacactgagtagacgttccatttcatggcttaaacagtaaacagaaagaccctagaccagcaagggattatctgtgtgtttacaagtaatctggttcttgg

SEQ ID NO: 24558 - DNA, 143 bp, Homo sapiens
  DISO7_10004479
  Located on chromosome 20
  Distance between a terminus base of telomere on chromosomal short arm and 5'-terminus of this base sequence : 18532737
  Distance between 3'-terminus of neighbour sequence of sequence listing upward to telomere on chrosomal short arm and 5'-terminus of this base sequence : 169326
tgttctggcttctcaataagcttttttgacctagtctcatagactctctcttttagtagatgagagaaagtgtgtgtgtgtgtgtgtgtgtgtgtgtgtgtgtgtgtgtgtgtgtatagagagaaggagctatagatggtgtt

SEQ ID NO: 24559 - DNA, 108 bp, Homo sapiens
  DISO7_10004482
  Located on chromosome 20
  Distance between a terminus base of telomere on chromosomal short arm and 5'-terminus of this base sequence : 18622252
  Distance between 3'-terminus of neighbour sequence of sequence listing upward to telomere on chrosomal short arm and 5'-terminus of this base sequence : 89372
atttcttatatgtgaggttgaaccttttaaacatatatttattagctgtgtgtgtgtgtgtgtgtgtgtgtgtgtggtgtgtgtgtgcatgtgcatttgtgaattgcc

SEQ ID NO: 24560 - DNA, 247 bp, Homo sapiens
  DISO7_10004484
  Located on chromosome 20
  Distance between a terminus base of telomere on chromosomal short arm and 5'-terminus of this base sequence : 18726238
  Distance between 3'-terminus of neighbour sequence of sequence listing upward to telomere on chrosomal short arm and 5'-terminus of this base sequence : 103878
aagggaagaagttcttgttctatagataagtaaaataccgagagagagagagagagagagagagagagagagagagagagagaataagtcccccataatagaaaaaggaagaattttccgaataatttttaaaaagaattttaaaaaatgcatcaatccatcttattttttgatacagttcaaaataagttgcagacaattattaataacagacggggactttttaggtgcaatacctccttacaag

SEQ ID NO: 24561 - DNA, 231 bp, Homo sapiens
  chr20.fa.O7frz.20734304
  Located on chromosome 20
  Distance between a terminus base of telomere on chromosomal short arm and 5'-terminus of this base sequence : 18918549
  Distance between 3'-terminus of neighbour sequence of sequence listing upward to telomere on chrosomal short arm and 5'-terminus of this base sequence : 192064
aactttgaagttaccatctaggaggtgcctgccctggggactctgtaagttcctctggtacaaggcccatcatttgcagggagtgggagggattacaggaagaggcaaagagcgaaccacccgtgtgcgtgtgtgtgtgtgtgtgtgtgtgtgtgtgtgtgtgtgttggagggaatagagatagagaaactttcccttttcacaaatgtcaaacttgcatagaaaatactg

SEQ ID NO: 24562 - DNA, 357 bp, Homo sapiens
  AL136090.12_35075
  Located on chromosome 20
  Distance between a terminus base of telomere on chromosomal short arm and 5'-terminus of this base sequence : 19013784
  Distance between 3'-terminus of neighbour sequence of sequence listing upward to telomere on chrosomal short arm and 5'-terminus of this base sequence : 95004
atgtcttagtggaatcactctgactgcagaatcaaagatagatttatggtaggatggggagcaggcaagggcagctatgggagagcgttcttggcaacaagtcagcaacccaagtgagagatggagatggcttggaccaggcactaatcaggaaggtgggagaagtggtaagattcagggagagtcagctgggctgctggaatatatgtgtgtgtgtgtgtgtgtgtgtgtgtgtgtgtgtgtgtgtgagagagagagagagagagagagagagagagagagcaagagagcagagagagacagcagagaaagacagggacagagagacagaataaatggttaaggatgaccgccata

SEQ ID NO: 24563 - DNA, 308 bp, Homo sapiens
  chr20.fa.O7frz.20936064
  Located on chromosome 20
  Distance between a terminus base of telomere on chromosomal short arm and 5'-terminus of this base sequence : 19120263
  Distance between 3'-terminus of neighbour sequence of sequence listing upward to telomere on chrosomal short arm and 5'-terminus of this base sequence : 106122
tagagctaccatttgatccagcagtcccactactgggtatgtatccagaggaaaagaagtcatatgaaaaagacacttgcacacacaggtttatagcaacacaattcacaattgcaaaaatatggaaccagcccaaatgcccaccaatcaacgagtgcataaagaaaatgtgacatatatatatatatatatatacacacacacacaccatggaatactacccagtcataaaaaggaacaaaataatggcattcgcaggaatctggatggaattggagaccattcttctaagtgaagtaactcaggaa

SEQ ID NO: 24564 - DNA, 310 bp, Homo sapiens
  AL049647.7_125911
  Located on chromosome 20
  Distance between a terminus base of telomere on chromosomal short arm and 5'-terminus of this base sequence : 19290092
  Distance between 3'-terminus of neighbour sequence of sequence listing upward to telomere on chrosomal short arm and 5'-terminus of this base sequence : 169521
gatggcagaattgtacactttaagtggctgcagtttattttatgtaaattatacctcaataaaattcatttttcaaaaagcacctagaagcatgcccaacacatagcaaatggtcaataaatggtggacttcataaaaaatttgtgtatgtgtgtgtgtgtgtgtgtgtgtgtgtgtgtgtgtatgtgtgtatgacccagtaagctcatagaatgatgttcaacatcattagtcattaggaaatgaagattaaaactacatgagatcatgtagtactagtgcagtagtactgcactagagtggcttaagt

SEQ ID NO: 24565 - DNA, 450 bp, Homo sapiens
  chr20.fa.O7frz.21183551
  Located on chromosome 20
  Distance between a terminus base of telomere on chromosomal short arm and 5'-terminus of this base sequence : 19367650
  Distance between 3'-terminus of neighbour sequence of sequence listing upward to telomere on chrosomal short arm and 5'-terminus of this base sequence : 77248
tttaaggtaagttgagtgactcagggggaagatgctttgaagtcctagctttgcaaactacctgaattctctcagcatctggttgaggtcatcaaaggcaccactgaggtgacagcagggagaggtctttgctttgaggctgacaaaatatgcagcatgtcaatgcaaacatagtgcttagcaaaagccaacccccaatgcgggtatcctagaggagcagatagttggctactatcatttttacagaatcaaacagatttatatatatctgttttatatatatatatatatataagattatatatatataatcttaataatcatcctaataaacaattttcagagtcaaaatttaaaaagttgaatcaatcaaagaagacaagaaaaaatgcctgattaatttgaaagtattagattgctttttctgtgaccatctttcagttcacctat

SEQ ID NO: 24566 - DNA, 470 bp, Homo sapiens
  chr20.fa.O7frz.21431421
  Located on chromosome 20
  Distance between a terminus base of telomere on chromosomal short arm and 5'-terminus of this base sequence : 19615540
  Distance between 3'-terminus of neighbour sequence of sequence listing upward to telomere on chrosomal short arm and 5'-terminus of this base sequence : 247440
tgcactttgttctttaatgaagtttggctgtttgctctgcagagttgcccacggttggaaagcgttgattatatcccatgatgtggcacagtctgttcccttggcctctgtgtctgtgtgttgtctgtgtgtgtatgtgtgtgcatgactgggcatctgtgtgtgtctgtgtgctgtgtgtctgtgtgtgtgtctgtatgtgtctgtgtgtgcgagtgtgtgtctgtgtctgtgtgtgtgtctgtgtgtgtctctgtgtgtgtctgtgtgtgtctgtgtgtctctgtgtgtctgtatgtgcatgtgtgtgtgtgtgcattttccttgcactttgttctttgatgaagtttggctgtttgctctgcagagttgcccatggttggaaactgttgattatatcccatgctgtggtgcaatctgttcccttggcctatgtgtttcctatatgtctgtaattgatctgattcagg

SEQ ID NO: 24567 - DNA, 320 bp, Homo sapiens
  D20S471
  Located on chromosome 20
  Distance between a terminus base of telomere on chromosomal short arm and 5'-terminus of this base sequence : 19786550
  Distance between 3'-terminus of neighbour sequence of sequence listing upward to telomere on chrosomal short arm and 5'-terminus of this base sequence : 170540
gggatgcagaaattgcagtaagccaagatcgtgccactgcactccagcctgggcaacaaaagcaagactctgtcaaaaaaagaaagggagaaaaggaaggaaggaaggaaggaaggaaggaaggaaggaaggaaggaaggaaggaaggaaggagaaagaaaggaaggaaggaaggaaggaaggaaggtaggaaggaaggaaagagaagagaagagaaagaaaaagggcgaatttgcctaacctgcagtctgacactgatctctaggcatgctgggtgctgggaactggggtgatggagggggtcagtggcaaagagaaaa

SEQ ID NO: 24568 - DNA, 171 bp, Homo sapiens
  HUMUT5542
  Located on chromosome 20
  Distance between a terminus base of telomere on chromosomal short arm and 5'-terminus of this base sequence : 19786629
  Distance between 3'-terminus of neighbour sequence of sequence listing upward to telomere on chrosomal short arm and 5'-terminus of this base sequence : -241
aagaaagggagaaaaggaaggaaggaaggaaggaaggaaggaaggaaggaaggaaggaaggaaggaaggaaggagaaagaaaggaaggaaggaaggaaggaaggaaggtaggaaggaaggaaagagaagagaagagaaagaaaaagggcgaatttgcctaacctgcagtct

SEQ ID NO: 24569 - DNA, 306 bp, Homo sapiens
  AL035454.18_65727
  Located on chromosome 20
  Distance between a terminus base of telomere on chromosomal short arm and 5'-terminus of this base sequence : 20019962
  Distance between 3'-terminus of neighbour sequence of sequence listing upward to telomere on chrosomal short arm and 5'-terminus of this base sequence : 233162
ccagctttaaatacaaatcctctctggatatggagaatatcatcagacaggaatgaggaggctgtgccaggattctggatgcggaggtggcctgctgctgctgctgctgctgctgctgctgctgctgctgtcactccagtccttaagtgtgagttttccatctgtgcatttgcagtggtttctgtgctggcagggaagtgatgcacacctctcagactcgagggaagcaggcctgcaggttttcctctggggccgtaatcatgtagtgcagcagccaggctgtggaggtgatgaagcaatgtcagg

SEQ ID NO: 24570 - DNA, 237 bp, Homo sapiens
  chr20.fa.O7frz.22002611
  Located on chromosome 20
  Distance between a terminus base of telomere on chromosomal short arm and 5'-terminus of this base sequence : 20186896
  Distance between 3'-terminus of neighbour sequence of sequence listing upward to telomere on chrosomal short arm and 5'-terminus of this base sequence : 166628
cagctaaagtaaatttacaaccactctgaagtagaagcagaagaaaggtatagtatgagtgatttcacacacacacacatacagataaacacacacacacacacacacccctcccaccctcccagttgtgggctgacctaagccaggtggaacaatttagctttaatgggaagatgtcaatttgtaactaagtgtttcataacgaaaaatctcctagtatcagtcctggtaaactca

SEQ ID NO: 24571 - DNA, 247 bp, Homo sapiens
  AL121896.10_90163
  Located on chromosome 20
  Distance between a terminus base of telomere on chromosomal short arm and 5'-terminus of this base sequence : 20426402
  Distance between 3'-terminus of neighbour sequence of sequence listing upward to telomere on chrosomal short arm and 5'-terminus of this base sequence : 239269
ctcttgtaacttctggcacaacagccttttcccagcatttctgggcacctgctccaggtacaggtcctgggctagatgtcaccctgaagagggatgcatgaacacacatgaacacacacacacacacacacacacacacacacactcacactcactcactcacaatagctgctgaaccttcaagagagccagcgactacttccatgacgctctggggatagtcaggacaacttaaggaaaggtacgg

SEQ ID NO: 24572 - DNA, 245 bp, Homo sapiens
  AL078634.24_13018
  Located on chromosome 20
  Distance between a terminus base of telomere on chromosomal short arm and 5'-terminus of this base sequence : 20517777
  Distance between 3'-terminus of neighbour sequence of sequence listing upward to telomere on chrosomal short arm and 5'-terminus of this base sequence : 91128
actgacctttgaggttgacttacccagtgtcacacagtgtgtgtgtgtgtgtgtgtgtgtgtgtgtgtgtgtctgtgtgtgtgtagctaaaactgcagactacaccacacacaatattttgggcacctgacttagatgttcactcatttattcttccaacagccttcataaagtacgggctattatcccaaatttaaaggcaaagaaacaaaaggacagagattaaataactagctcaaggccac

SEQ ID NO: 24573 - DNA, 221 bp, Homo sapiens
  AL078634.24_33670
  Located on chromosome 20
  Distance between a terminus base of telomere on chromosomal short arm and 5'-terminus of this base sequence : 20538393
  Distance between 3'-terminus of neighbour sequence of sequence listing upward to telomere on chrosomal short arm and 5'-terminus of this base sequence : 20371
tgccttcctaagataagtctgtctctttagatgaatctgtgggtaggaagagaatcttgcagaatggcaggcgtgtgtgtgtgtgtgtgtgtgtgtgtgtgtgtagtgtatgcacacatgtgcactcgtgcatggattacaacaattgaaggtaggtccttatctcctatttcagctctcctcctctggcctgaaaggtatccttagccaggtaagttctc

SEQ ID NO: 24574 - DNA, 347 bp, Homo sapiens
  AL078634.24_60177
  Located on chromosome 20
  Distance between a terminus base of telomere on chromosomal short arm and 5'-terminus of this base sequence : 20564686
  Distance between 3'-terminus of neighbour sequence of sequence listing upward to telomere on chrosomal short arm and 5'-terminus of this base sequence : 26072
attcaggaacggctttcttcccacctaactctgggtttactttgttataaaaacatgaaagtatttgtctcatgattttgctcaaatatagaattttccctccttgtgtaaatattttgcaacaacaaaatttaaaaatcacaacaatcctcacaaattaaaagattagagggatcgttctttattattcagttctgtaacataacccaactcaccaattctatttgttggcgtgttacaagtaaaagaacatgaaacaaaatcatttccatttcaagaacttgtaacacacacacacacacacacacacacacacacacacactaacctggtgaaatacttcattc

SEQ ID NO: 24575 - DNA, 253 bp, Homo sapiens
  AL109953.24_12730
  Located on chromosome 20
  Distance between a terminus base of telomere on chromosomal short arm and 5'-terminus of this base sequence : 20737568
  Distance between 3'-terminus of neighbour sequence of sequence listing upward to telomere on chrosomal short arm and 5'-terminus of this base sequence : 172535
agtggtaagcacctgcaatgccatctactcaaaaggctgaggtgggaggattgcttgagcctgagaggtcaaggctgtagtgagctgtgttcgtgccactgcactccagcctgggtgagcagagtgagatgctgcctagtatgtgtgtgtgtgtgtgtgtgtgtgtgtgtgtgtgtgtgtgtgtgtgagtttccaaagccaaatctttgattttttcactttcttcttccttgtgtcctacagataaccattc

SEQ ID NO: 24576 - DNA, 279 bp, Homo sapiens
  D20S912
  Located on chromosome 20
  Distance between a terminus base of telomere on chromosomal short arm and 5'-terminus of this base sequence : 20815841
  Distance between 3'-terminus of neighbour sequence of sequence listing upward to telomere on chrosomal short arm and 5'-terminus of this base sequence : 78020
ggctacttagactaaatcatggaccagttgtactgtatttgggtctgtgtgtgtgtgtgtgtgtgtgtgtgtgtgtgtgtgtgtgtgtgtgtgttcctagcaggcttaattgcaataacatttatgtcacataatatagtgcactgaggttgtaattttcctatcatctaaattgcaggctgagaactgtgttaaggaaggaccgtagagaatgaattactgctttcaaaatgactacttttaacagacaatgtgaccggcaaatgaatgctagagccg

SEQ ID NO: 24577 - DNA, 262 bp, Homo sapiens
  AL109953.24_120351
  Located on chromosome 20
  Distance between a terminus base of telomere on chromosomal short arm and 5'-terminus of this base sequence : 20845152
  Distance between 3'-terminus of neighbour sequence of sequence listing upward to telomere on chrosomal short arm and 5'-terminus of this base sequence : 29032
gtccaacttaggaccaatcagaaaaagccaaatatgttcccctaaccaatcacatagaatgccttgctgctgttgtaggaaaacccgggttcttgtcacacggccgggaaagattaggcttgaagacactttgaaggatgagggggaatggaatttactgggcgaaaaggaaaaagaaacacacacacacacacacacacacacacacacacacacacacacacacacaaaacaaagagagatgaggttctgctaataggct

SEQ ID NO: 24578 - DNA, 376 bp, Homo sapiens
  AL121759.25_19892
  Located on chromosome 20
  Distance between a terminus base of telomere on chromosomal short arm and 5'-terminus of this base sequence : 20981430
  Distance between 3'-terminus of neighbour sequence of sequence listing upward to telomere on chrosomal short arm and 5'-terminus of this base sequence : 136016
atctacctaatgaggcctgaacactgttgccaagcaattagagtttttattgtgtcactgatttccttcatttccgcagtcgctgataatcattagccaatactgtctccgtctaagaatgcacagcgtgcatatgtgtgtctgtgtgcatatgcgcgcacacacacacacacacacacacacacacacattcagcctgctgagaatgcctgtgggggagacagcctcagacagttacaaaatttgtaaatttctgcacatcttatttgtcactcataaacaacagagtccagcagaagtgacttccaaggccaggtcgtaaaaagtaatgcagtttccatcttaggagctggaatacctgctcttacaaagttca

SEQ ID NO: 24579 - DNA, 421 bp, Homo sapiens
  chr20.fa.O7frz.22908366
  Located on chromosome 20
  Distance between a terminus base of telomere on chromosomal short arm and 5'-terminus of this base sequence : 21094545
  Distance between 3'-terminus of neighbour sequence of sequence listing upward to telomere on chrosomal short arm and 5'-terminus of this base sequence : 112739
agttctcctgcctcagtctctaagtagctgggaccacaggtgtgtgccaccatgcccagctagtaaaatacatatatatacacatatatttatttatttatttattattactattattattatttttttttatggagttttgctcttgtcacccaggctggagtgcagtggcaagatctcggctcactgcaacctctgcctcctgggttcaagcgattctcctgcctcagccccctgagtagctgggattacaggtgcccaaatattttttaattaaaaaaattttttttaatttttaattttgtagagatggagtctcactatgttgccaaggctggtctcaagttcctgggctcaagcaatcctcccatctcagcctcagggccgggaactcttcctaatctcagattagctgcataac

SEQ ID NO: 24580 - DNA, 241 bp, Homo sapiens
  AL117332.16_101922
  Located on chromosome 20
  Distance between a terminus base of telomere on chromosomal short arm and 5'-terminus of this base sequence : 21256906
  Distance between 3'-terminus of neighbour sequence of sequence listing upward to telomere on chrosomal short arm and 5'-terminus of this base sequence : 161940
ccgaattgctctgattatagttatgagccactgtgcctggctgtgtgtgtgtgtgtgtgtgtgtgtgtgtgtgtgtgtgtgtgtgtgtgtagggtctcattttgtcacctaggctatagtgcagtagtggcacaatcagctcactgtagtttccaactcctgggctcatgcagacctctgccttaatctcctaggtagctgggactacaggtacatgccactgtaccttcctgattcttga

SEQ ID NO: 24581 - DNA, 241 bp, Homo sapiens
  D20S190
  Located on chromosome 20
  Distance between a terminus base of telomere on chromosomal short arm and 5'-terminus of this base sequence : 21265474
  Distance between 3'-terminus of neighbour sequence of sequence listing upward to telomere on chrosomal short arm and 5'-terminus of this base sequence : 8327
tgttatcaaaaaatatggcctctaactggtgtgtgtgtgtgtgtgtgtgtgtgtgtgtgtgtgtgtgtgtattctcttacagagtgaagaacttcataatttttatgtaacaatataatatcttttgtgtaccatatattgttttacagtcttattaaaacataatttaaaaggctgagcacgatggctcacccctgtaatcccagcattttgggaggccgaggacggcagatgactggag

SEQ ID NO: 24582 - DNA, 352 bp, Homo sapiens
  AL117332.16_112020
  Located on chromosome 20
  Distance between a terminus base of telomere on chromosomal short arm and 5'-terminus of this base sequence : 21266929
  Distance between 3'-terminus of neighbour sequence of sequence listing upward to telomere on chrosomal short arm and 5'-terminus of this base sequence : 1214
tcattcctttccattacatgtagtaagtcaatcaatgaagtggttttggtgtctctcacacacacacaccccttctttattcagaaaattttcagtgaagtagttttggtgtttttcacacacacacacacacacacacacacacacacacacacccttattcagaaaattttcccgtaacacttatctcagtttttcttgagacatataattcttttgatttttgtgcctatagaaaattggggataatctgaaagtgttaacaatttttttataggttattttatctgatgctagtgctcctggtgaaggagaacataaaatcatggattacattagaaggcaaagaggt

SEQ ID NO: 24583 - DNA, 232 bp, Homo sapiens
  AL133325.20_65405
  Located on chromosome 20
  Distance between a terminus base of telomere on chromosomal short arm and 5'-terminus of this base sequence : 21405466
  Distance between 3'-terminus of neighbour sequence of sequence listing upward to telomere on chrosomal short arm and 5'-terminus of this base sequence : 138185
aaacatggtgttggactatcacaactgtgtgtgtgtgtgtgtgtgtgtgtgtgtgtggtgggctttgtaaagaattggggcttaatgtacctaacaaacgactaatcttttgcctgaaaaataggctgagctgaccagatggtgagtggaatgaaatcactttcctaccattatgggcaagatttctaactctttgtcacccactctgttcttcctaggcagtaagtcaatg

SEQ ID NO: 24584 - DNA, 228 bp, Homo sapiens
  AL121590.11_47793
  Located on chromosome 20
  Distance between a terminus base of telomere on chromosomal short arm and 5'-terminus of this base sequence : 21547712
  Distance between 3'-terminus of neighbour sequence of sequence listing upward to telomere on chrosomal short arm and 5'-terminus of this base sequence : 142014
taacctgcacattgtgcacacataccctaaaacttaaagtataataaaaaaaagaaaaagaaaaaacactgaacaggaaaacacacacacacacacacacacacacacacacacacaaagagtctccactggagagagggtggacagggcatgaggatttgtaacttctggcattctggcagagactggtattagggctcctttaactgaaagcaaattctatttcca

SEQ ID NO: 24585 - DNA, 206 bp, Homo sapiens
  AL121590.11_48061
  Located on chromosome 20
  Distance between a terminus base of telomere on chromosomal short arm and 5'-terminus of this base sequence : 21547919
  Distance between 3'-terminus of neighbour sequence of sequence listing upward to telomere on chrosomal short arm and 5'-terminus of this base sequence : -21
tgaaagcaaattctatttccagtccttcagagacaccaagtaggctccaaagagcctggccaagcacacagtcctcaccccacagtattcttcttggacgtttgaaccttggagttgcaggaattctgaggatgcttcagcgtgtgtgtgtgtgtgtgtgtgtgtgtgtgtgtgtgtgtgtggtgtatgccagctcagtatctagc

SEQ ID NO: 24586 - DNA, 426 bp, Homo sapiens
  AL035562.14_69625
  Located on chromosome 20
  Distance between a terminus base of telomere on chromosomal short arm and 5'-terminus of this base sequence : 21632271
  Distance between 3'-terminus of neighbour sequence of sequence listing upward to telomere on chrosomal short arm and 5'-terminus of this base sequence : 84146
gctggacttgtccatattgtacttttctgtagccaggtggttttctgagttcgaggtgcatatgcattttttgacctataaacactgagccttaaagagcatgtgtagatcctctgtgtgcttactcgacaatgaaatacacacacacacacacacacacacacacacacatgcaggcactagccatgggtagtagctctaacagtgtctggtcacaaattttttcaaccttcctagcagcctaaatactagagctgcaaagagaagctctgaaggcacaatgagaacagagggtcattcattaaatccccactccctctgtaatgaagggcaggtgagtacagcctaaaatggcagaagaacctcaagcctgagtcgtaacaaaacgccatcaaaccctgcctaaagctattcgtccaaattaaa

SEQ ID NO: 24587 - DNA, 163 bp, Homo sapiens
  chr20.fa.O7frz.23536793
  Located on chromosome 20
  Distance between a terminus base of telomere on chromosomal short arm and 5'-terminus of this base sequence : 21722933
  Distance between 3'-terminus of neighbour sequence of sequence listing upward to telomere on chrosomal short arm and 5'-terminus of this base sequence : 90236
ttaaatggtacagttcctgtttagaaaatgaaaatcaaactatttgaagtcactttggactactgagttttctttttatatatatatatatatatatatatatattatttcaatagcttttggggtacaggtggattttgtttacatgaataaatgctgtagc

SEQ ID NO: 24588 - DNA, 275 bp, Homo sapiens
  AL117375.12_111993
  Located on chromosome 20
  Distance between a terminus base of telomere on chromosomal short arm and 5'-terminus of this base sequence : 21872942
  Distance between 3'-terminus of neighbour sequence of sequence listing upward to telomere on chrosomal short arm and 5'-terminus of this base sequence : 149846
tcttaaatctgaactatggtgaagtgttttagtttgagatcccgggaaatagactctgagacaaagaactgtgagtaggaggtttcatggagagtgctctcaggatccacacctgcgaaataactataataataataataataataataataataataataatagtgaaggcctggactgggtagaggaagaaactgatccaaaacaaacgtgcaatgaggcctcagccaattcctggggggcagatctggctgtgtacagcagttcctgaataa

SEQ ID NO: 24589 - DNA, 227 bp, Homo sapiens
  chr20.fa.O7frz.23813219
  Located on chromosome 20
  Distance between a terminus base of telomere on chromosomal short arm and 5'-terminus of this base sequence : 21999334
  Distance between 3'-terminus of neighbour sequence of sequence listing upward to telomere on chrosomal short arm and 5'-terminus of this base sequence : 126117
catttgatgttggttatgaaacgtgtttttctcagtatagatatatatgtatatttttatacatacacatacatatatatattttttatacatacacatacatatatatatatatatatatattttccttttcttgttgaaccatgatagtaaaaatgattagtggagttgaaatctgcagcaatgcacagaatgctttttccagtgtttaggatagctgaaatatg

SEQ ID NO: 24590 - DNA, 178 bp, Homo sapiens
  D20S474
  Located on chromosome 20
  Distance between a terminus base of telomere on chromosomal short arm and 5'-terminus of this base sequence : 22094370
  Distance between 3'-terminus of neighbour sequence of sequence listing upward to telomere on chrosomal short arm and 5'-terminus of this base sequence : 94809
aaacagtcaccgcaggattatctaaacattctattcagcaattgcatgtattgtctggctttctaatttaccgaaaatttgtgatttacaaagtccaaagttatggactgtgatttaaaataataataataataataataataataataaaactgcggtctttgggattctcagaaaa

SEQ ID NO: 24591 - DNA, 138 bp, Homo sapiens
  D20S472
  Located on chromosome 20
  Distance between a terminus base of telomere on chromosomal short arm and 5'-terminus of this base sequence : 22094421
  Distance between 3'-terminus of neighbour sequence of sequence listing upward to telomere on chrosomal short arm and 5'-terminus of this base sequence : -127
tgtctggctttctaatttaccgaaaatttgtgatttacaaagtccaaagttatggactgtgatttaaaataataataataataataataataataataaaactgcggtctttgggattctcagaaaaatgtcccctca

SEQ ID NO: 24592 - DNA, 219 bp, Homo sapiens
  AL049737.4_12508
  Located on chromosome 20
  Distance between a terminus base of telomere on chromosomal short arm and 5'-terminus of this base sequence : 22180412
  Distance between 3'-terminus of neighbour sequence of sequence listing upward to telomere on chrosomal short arm and 5'-terminus of this base sequence : 85853
taaggccttaagatccttcaagcacatggactatgacttcgtgcctctcttgttctttctggtaaccaaaggtactttgccatgaagagaaaacaccttggtaaccaacgtggctcttaatcacatcctgcactttctctctttttcttttctttcttttgtgtgtgtgtgtgtgtgtgtgtgtgtgtgtgtgtgtgtatttagtatttctcagccgct

SEQ ID NO: 24593 - DNA, 163 bp, Homo sapiens
  AL121912.18_50466
  Located on chromosome 20
  Distance between a terminus base of telomere on chromosomal short arm and 5'-terminus of this base sequence : 22278062
  Distance between 3'-terminus of neighbour sequence of sequence listing upward to telomere on chrosomal short arm and 5'-terminus of this base sequence : 97431
ttagagtgaaatagacaggctcacaagcttgttccgtgagatacacacacacacacacacacacacacacacactccccactcaatgagtcgttagaatggagaagcacatgtttaaaatccataaaacaagacatagaacaacagagtagcttgatggtgaa

SEQ ID NO: 24594 - DNA, 364 bp, Homo sapiens
  AL133464.12_21926
  Located on chromosome 20
  Distance between a terminus base of telomere on chromosomal short arm and 5'-terminus of this base sequence : 22367003
  Distance between 3'-terminus of neighbour sequence of sequence listing upward to telomere on chrosomal short arm and 5'-terminus of this base sequence : 88778
accaacagtcattttactgcacagaagtttctcagctcccttctcttatttaagaatgagatactctctgcccattctgaactttacaggaataactcagggtgtcttgttcttataaataaaaaatttttaaaaaatcttctaatatgtttctattttatctatcaatccattgatctatatgtttatttatccatctgattatctatctatctatttatctatctatctatctatctatctatctatctatctatctatctatctaatctatctgctttcctacttatcttggtgaataaaataaagccaggaaagaaaggcaggtgtgttaagggagccgtctattcctctggcatgagta

SEQ ID NO: 24595 - DNA, 259 bp, Homo sapiens
  D20S477
  Located on chromosome 20
  Distance between a terminus base of telomere on chromosomal short arm and 5'-terminus of this base sequence : 22367091
  Distance between 3'-terminus of neighbour sequence of sequence listing upward to telomere on chrosomal short arm and 5'-terminus of this base sequence : -276
ggaataactcagggtgtcttgttcttataaataaaaaatttttaaaaaatcttctaatatgtttctattttatctatcaatccattgatctatatgtttatttatccatctgattatctatctatctatttatctatctatctatctatctatctatctatctatctatctatctatctaatctatctgctttcctacttatcttggtgaataaaataaagccaggaaagaaaggcaggtgtgttaagggagccgtcta

SEQ ID NO: 24596 - DNA, 298 bp, Homo sapiens
  AL121722.9_23404
  Located on chromosome 20
  Distance between a terminus base of telomere on chromosomal short arm and 5'-terminus of this base sequence : 22507099
  Distance between 3'-terminus of neighbour sequence of sequence listing upward to telomere on chrosomal short arm and 5'-terminus of this base sequence : 139749
gatagtgatctgcctgttctttcatgatgaccaagagcccagaggcctgagcctgaggtagggaaggggtgtgtgtgtgtgtgtgtgtgtgtgtgtgtgtgtgtgtcatgtggtgtgtgagagagaggaggcagggaaggaggagagagattgtggaatgcaagggagaaatcatgcagttacttttagttgtttactgagcaagggcaaaatctaaaccgcgcttgccacaatcaatgaaaggatcgcctcagcttccagagttgagctccctaaatgagtctggcattctgataac

SEQ ID NO: 24597 - DNA, 321 bp, Homo sapiens
  AL158175.7_28217
  Located on chromosome 20
  Distance between a terminus base of telomere on chromosomal short arm and 5'-terminus of this base sequence : 22632589
  Distance between 3'-terminus of neighbour sequence of sequence listing upward to telomere on chrosomal short arm and 5'-terminus of this base sequence : 125192
tactttggtgcagctgaacatgcctgcagggaagcacacaccacggccgcatgtctggcttcaacttcatggctgtgaaaacctgaggcccttcatgctgcctggcagtgccgttgcatgtccctcctctctcatgttctctaaatggccatgtcacaccttctcttctcttctcttctcttctcttctcttctcttctcttctcttctcttctcttctcttctcttctcttctcttctcaattccccatatctcttaccccattctctctctcagcttctacctttactggaaaaatttaagtaaccagataagttccaa

SEQ ID NO: 24598 - DNA, 349 bp, Homo sapiens
  AL049738.4_62002
  Located on chromosome 20
  Distance between a terminus base of telomere on chromosomal short arm and 5'-terminus of this base sequence : 22752281
  Distance between 3'-terminus of neighbour sequence of sequence listing upward to telomere on chrosomal short arm and 5'-terminus of this base sequence : 119371
cctcattagtacttggctcaagtttggagtatttaaaactcttttgagacccagataaaaatatttaaaaaacaaataggaaagggagagcacaacattcaattgaggtcacgcttaaagagagataattcacagtgatttaaatgaatgctacacaaaacatgggcctgaatttcatatatatatatatatatatatatatatatatatgtgcatgctttaagttaaagtgaaaaaagaccatagcatttttctttatttttttgaaagagaaccatatttaattttatcttaatgtatggcagtttattatattatttttattttactttaagcgatacatgtgcag

SEQ ID NO: 24599 - DNA, 397 bp, Homo sapiens
  chr20.fa.O7frz.24862270
  Located on chromosome 20
  Distance between a terminus base of telomere on chromosomal short arm and 5'-terminus of this base sequence : 22858087
  Distance between 3'-terminus of neighbour sequence of sequence listing upward to telomere on chrosomal short arm and 5'-terminus of this base sequence : 105457
aggactctttccttatactccttaagttaaagaaagattcaagtatattgctatagtaaagggagccacaaaaagaaatgagaacaatctagacagcaaaaacagggaggataatctgtagaggctgcccacatttcttaaatcaagacatggggggttaagtgtaacatggtaacacctaccagacagactaaaatatactattaatcctccaaattaccaaaaggcacacacacacacacacacacacaccatacacactgaaaaagaatgaaagaaaggcaattcctagagtaaatgagagaataaagaatatattgaaaacaaattaaaatcccaaaagttaagctaataatatgtaaaagataaaaagtaatactcgagtaatgcatttaga

SEQ ID NO: 24600 - DNA, 219 bp, Homo sapiens
  AL049651.2_26711
  Located on chromosome 20
  Distance between a terminus base of telomere on chromosomal short arm and 5'-terminus of this base sequence : 22933224
  Distance between 3'-terminus of neighbour sequence of sequence listing upward to telomere on chrosomal short arm and 5'-terminus of this base sequence : 74740
ttgagatccactggtttagattattttttattatttctcccctcaaagagctgcaatttgataatagtgaaaaatgggtctatattaatggtgtgtgtgtgtgtgtgtgtgtgtgtgtgtgtgtaaggggagggggttaaggtttagagggaaaattgtgaattcccccctgctataaccaacaatatcctcagtgtttataacctagcactgcagttt

SEQ ID NO: 24601 - DNA, 252 bp, Homo sapiens
  D20S184
  Located on chromosome 20
  Distance between a terminus base of telomere on chromosomal short arm and 5'-terminus of this base sequence : 23079436
  Distance between 3'-terminus of neighbour sequence of sequence listing upward to telomere on chrosomal short arm and 5'-terminus of this base sequence : 145993
agaaggcaggaatacaaatgtctagatagatataatatgtgtgtgtatgcatgtgtttatttgtgtgtgtaggtatttatgtgtgcaggtatttgtgtatgtgtatttgtgtgtgtatgcatatattgtgcacctgtgtgtgtgtgtgtgtgtgtgtgtgtgtgtgtgtctgtatgcatgcatgtatatttgtgatgctgttctaagtctggagagtctgctgctgctccagtctgaaccacacacacttgc

SEQ ID NO: 24602 - DNA, 211 bp, Homo sapiens
  Z23810.1_89
  Located on chromosome 20
  Distance between a terminus base of telomere on chromosomal short arm and 5'-terminus of this base sequence : 23079438
  Distance between 3'-terminus of neighbour sequence of sequence listing upward to telomere on chrosomal short arm and 5'-terminus of this base sequence : -250
aaggcaggaatacaaatgtctagatagatataatatgtgtgtgtatgcatgtgtttatttgtgtgtgtaggtatttatgtgtgcaggtatttgtgtatgtgtatttgtgtgtgtatgcatatattgtgcacctgtgtgtgtgtgtgtgtgtgtgtgtgtgtgtgtgtctgtatgcatgcatgtatatttgtgatgctgttctaagtctgga

SEQ ID NO: 24603 - DNA, 184 bp, Homo sapiens
  D20S871
  Located on chromosome 20
  Distance between a terminus base of telomere on chromosomal short arm and 5'-terminus of this base sequence : 23290580
  Distance between 3'-terminus of neighbour sequence of sequence listing upward to telomere on chrosomal short arm and 5'-terminus of this base sequence : 210931
tgcacactagaatcccttgggacactgaaaattacctatgccaaggccatactccagacccaaccatgcttgagtgtgtgtgtgtgtgtgtgtgtgtgtgtgtgtgtgtgtgtgtgtgtgtggtggtgggtaggggggttggttttgttccaggctggagtgcagtggcataatcttggctcac

SEQ ID NO: 24604 - DNA, 399 bp, Homo sapiens
  chr20.fa.O7frz.25399146
  Located on chromosome 20
  Distance between a terminus base of telomere on chromosomal short arm and 5'-terminus of this base sequence : 23395135
  Distance between 3'-terminus of neighbour sequence of sequence listing upward to telomere on chrosomal short arm and 5'-terminus of this base sequence : 104371
tgtatttctgacaagtagtgcagttcctgatgttgaatgaaccactgacaatgttcacacacacacacacacacatgcacgcacttgcccaaatgttaaactttggttctctcctctgactcattctttgtacccagtcatatggtcccattgggtcattcttcagaacacctgtcaaaaaccactggcatggcgcaggatttagttttattcacaactgtatctccagggcctgacacaaagtcattgctcaaaaacatgttggatgagtgaaggcatgaacacatggatgattgaatgaataaaatccttttccctgtagactgcatttccacagctgccttccagcccactcttcactgactccatccagactcctgtaatatcctgaccattcct

SEQ ID NO: 24605 - DNA, 373 bp, Homo sapiens
  chr20.fa.O7frz.25481925
  Located on chromosome 20
  Distance between a terminus base of telomere on chromosomal short arm and 5'-terminus of this base sequence : 23477692
  Distance between 3'-terminus of neighbour sequence of sequence listing upward to telomere on chrosomal short arm and 5'-terminus of this base sequence : 82158
aatctttctagataaccagaggacccagccctcaattgcttcaagcatgctggcactctctgtaaggctctgagagtctggctgccttgagagtttccgtccatggatttctacggaaatctcccttcccaggactttttggaagacacagcctgttagcttagaaagttagttttaaccagatccaaccagagagacagctgggccatttagagattttcattggttttgaattgaagcagaaaagttaatgatgcagggagagaagactacattcgtgtgtgtgtgtgtgtttgtgtgtatgcacacgtgtgcatgtctgtgcataagtgtgtgctcacagttagatgtatcagttaatgctgtatgacaa

SEQ ID NO: 24606 - DNA, 341 bp, Homo sapiens
  HUMUT487
  Located on chromosome 20
  Distance between a terminus base of telomere on chromosomal short arm and 5'-terminus of this base sequence : 23560310
  Distance between 3'-terminus of neighbour sequence of sequence listing upward to telomere on chrosomal short arm and 5'-terminus of this base sequence : 82245
atggactccctaaacagtctgacctaatcactatgcatttatataaatgcaacaaaatttcacatgtgccccataaatttgtacaaataaaaacaaacaaaacaaaattcttatgcctaaaaaaggaagaatgaaagaacgaaagaaagaaagagaaagaaagaaggaaagaaaaagaaagaaagaaagaaagaaagaaagaaagaaagaaagaaagaaagaaagaaagaaagaaagaaacaaagaaagaaacaaagaaacaaagaaagagtgaatggggccaaaggcatctcactgatggagagtagagtggtctcagaggacaggccagaatgacacct

SEQ ID NO: 24607 - DNA, 249 bp, Homo sapiens
  AL359433.7_13668
  Located on chromosome 20
  Distance between a terminus base of telomere on chromosomal short arm and 5'-terminus of this base sequence : 23620588
  Distance between 3'-terminus of neighbour sequence of sequence listing upward to telomere on chrosomal short arm and 5'-terminus of this base sequence : 59937
gcacagcttcctagcgtaggagacaacctcccagcctggggcacaccctcccaggatggatgacagcaggctctgctttctctgggtgatcctgcccatctttggtttgggtggcatttttcccaatcagttacacacacacacacacacacacacacacacacacacacttttggactttgtttccatgttgggtcctaaagtctcctgtggaaagaactacacgtcaatcgctgtctatttagtgtc

SEQ ID NO: 24608 - DNA, 322 bp, Homo sapiens
  AL359433.7_32875
  Located on chromosome 20
  Distance between a terminus base of telomere on chromosomal short arm and 5'-terminus of this base sequence : 23639778
  Distance between 3'-terminus of neighbour sequence of sequence listing upward to telomere on chrosomal short arm and 5'-terminus of this base sequence : 18941
ctcataagtgaaaggcagacaccatagttggagacgttctgtcccacactactgcctgaaacgtgaggagtaggagcaggaggaggtcacagggggtgagaagagggtgtggacagtgagtgggagagagagtgtgtgtgtgtgtgtgtgagagagagagagagagagagagagagagagagagagagagagaggattcattccgaggaccctgtcttttctattcagtacaggcttttcttttctttcctttttctttttcttttttcttttttcttttttttgtaatgacctggctgccttcttagatgttactgcctgg

SEQ ID NO: 24609 - DNA, 459 bp, Homo sapiens
  chr20.fa.O7frz.26033327
  Located on chromosome 20
  Distance between a terminus base of telomere on chromosomal short arm and 5'-terminus of this base sequence : 23991908
  Distance between 3'-terminus of neighbour sequence of sequence listing upward to telomere on chrosomal short arm and 5'-terminus of this base sequence : 351808
acttagaaacagattcctcgaccctatcccagacctgctgaacctggtgtggtgtggtgtggtgtggtgtgtgtgtgtgtgacacgtgcatgtgcactttgacaagccctcatggtaactctggtattctctacgttttgagaaccagcgtctcttgaaatttaacgacctagtctccttgcagatatacagcatgtgctcctgaggaattaacctttgtgcatgctttttgtattgctctaccctttttaatctcctgcccagagacgctaatgccattggacttgattgggaaagaaataagcgatagaaaagaaaggccaacaccacaactgaagaggctttctgtatgtgactgtgtggcttgcttctgatcaggaaaacataagtttctgaataactgacaaccctttcttcctttcttggtgatgaatgccctacattcaaagatgttgccta

SEQ ID NO: 24610 - DNA, 462 bp, Homo sapiens
  chr20.fa.O7frz.26263421
  Located on chromosome 20
  Distance between a terminus base of telomere on chromosomal short arm and 5'-terminus of this base sequence : 24221862
  Distance between 3'-terminus of neighbour sequence of sequence listing upward to telomere on chrosomal short arm and 5'-terminus of this base sequence : 229495
ttctaagctacctcagctgacagagcaaggaaacatgtgtatatgaatgtttataccatgtgtctatgtatagatgcacacacatatataggctgatgtatacatatacataagctagtaaaccacatcccagcaacaataatcacacctcaagctcagatatatatacacacaaacacacgtgtatatatatatatatatatatatatatatttgagcttgtaatgtgatacatatgtgtgtatgtaatgtgatgtgtgtgtatatatatgtatatataaaaaaccacatacatacatatatgtatatatgtgcatatatgtataaccacattccaggagcaatgatatatatacacatatatgtatctatgtgtgtatatgtacatgtatacacatatacatatatgtgtgtacactcgtacatgcatacacatgtgtgtacacttgtacatgcatacac

SEQ ID NO: 24611 - DNA, 237 bp, Homo sapiens
  AL034426.5_29573
  Located on chromosome 20
  Distance between a terminus base of telomere on chromosomal short arm and 5'-terminus of this base sequence : 24393329
  Distance between 3'-terminus of neighbour sequence of sequence listing upward to telomere on chrosomal short arm and 5'-terminus of this base sequence : 171005
actatctgttgagtactatgctcactacctacctgattcattcatacccaaaacttcaacgccacatagtatacccagataataagcctgcacaggtgcctcctgaagctaaaatacaagctgaaattataaaaaaagaaagaaaaaggaagggaaaggaaaggaaaggaaaggaaaggaaaggaaaggaaaggaaaggaaaggaaaggaagaggcttaagcaatcaaacaactttg

SEQ ID NO: 24612 - DNA, 365 bp, Homo sapiens
  AL034426.5_125155
  Located on chromosome 20
  Distance between a terminus base of telomere on chromosomal short arm and 5'-terminus of this base sequence : 24488897
  Distance between 3'-terminus of neighbour sequence of sequence listing upward to telomere on chrosomal short arm and 5'-terminus of this base sequence : 95331
gtttaatgcatcgtgacagttaatgtatattgaatgcaaatgtcacctccataccaagacattctatgcatgatgtcatggaacccccccacagctgatccatgatgaagagatgctgttgatgactccatttcagtttcagactaagtgacctgcccagggatcatctctctctctctctctctctctctctctctctctctcacacacacacacacacacacacagagtcacacccatgcacactcttgttaataagtgtcagagcagccttttggccccaagcactctgacccctcagcaggatgtcctgctgtctcagagcatcttccctttatgtgtcttagctgtagtctcaggaagtt

SEQ ID NO: 24613 - DNA, 236 bp, Homo sapiens
  D20S486
  Located on chromosome 20
  Distance between a terminus base of telomere on chromosomal short arm and 5'-terminus of this base sequence : 24687263
  Distance between 3'-terminus of neighbour sequence of sequence listing upward to telomere on chrosomal short arm and 5'-terminus of this base sequence : 198001
agaaggcttggagaacgattgaggaaatgatccataaagtgcaacaaaaggagagaggtggacaatgacaaaagcaagcaagagaaaggaagacagagagaaagaaaggagagaaggaagagagggagggaggaaggagagagggagggagggaggaaggaaggaaggaaggaaggaaggaaggaaggaaggaaggaaggaagagttagagaattcactgaacatcaaagcccttc

SEQ ID NO: 24614 - DNA, 297 bp, Homo sapiens
  chr20.fa.O7frz.26846396
  Located on chromosome 20
  Distance between a terminus base of telomere on chromosomal short arm and 5'-terminus of this base sequence : 24804904
  Distance between 3'-terminus of neighbour sequence of sequence listing upward to telomere on chrosomal short arm and 5'-terminus of this base sequence : 117405
acctagattactatctccaggtctgatgtgtgtgtgtgtgtgtgtgtgtgtctgttggtgtctctgtgtgtgtctgtgtgtttctctgtgcctatgtgtgtctctgtgtgtgtgtccgtgtgtgtgtgtgtgtgtgtgtctgtgtgtttctctgtgcctatgtgtgtctctgtgtgtgtgtccatgtgtgcctgtgtgtgttcacagtaacacaccttgacctcattagctctccttgaaggtccacatctgtgtctttatctacgtctccgtctatgtatctgatccaactacacc

SEQ ID NO: 24615 - DNA, 440 bp, Homo sapiens
  chr20.fa.O7frz.26934987
  Located on chromosome 20
  Distance between a terminus base of telomere on chromosomal short arm and 5'-terminus of this base sequence : 24893399
  Distance between 3'-terminus of neighbour sequence of sequence listing upward to telomere on chrosomal short arm and 5'-terminus of this base sequence : 88198
gaccatgtcttgtttctgtaaccccagcaacaggctcagagtcttcaaatgcttatacagaaaagttagtttgtttgtttgttaatgcctaaataaatgggtggatagatggagggaggtttgggtggatggaggtttcggtggagagagctaagggagggagttttgggtggaagcaggtttgcagggagggaactgtgggtgggtgggtggatggatggatggatggatggatggatggatggatggatgggtgggtggatgggtggatggatgagtgagtggggtctaccctccattcctttgtatactacattgccccctcctgctgcactagctaagtctccatcaggcatcttctcctggtggcttttacagcagcaggtgctgtccttccaaagccagcccagggcccaccagtgtgcgaacatgtatatggc

SEQ ID NO: 24616 - DNA, 429 bp, Homo sapiens
  chr20.fa.O7frz.27140385
  Located on chromosome 20
  Distance between a terminus base of telomere on chromosomal short arm and 5'-terminus of this base sequence : 25098772
  Distance between 3'-terminus of neighbour sequence of sequence listing upward to telomere on chrosomal short arm and 5'-terminus of this base sequence : 204933
acgcattccttaagatcatatcgccatcaaaggaagcccaggagcatttccctaataatgagccctctcagaataacctttgtctccttagtaaattaatcaacacagattgactatggccaagacagtgtgatagtcctgaactcggggaattctggatgaggatatgagaaatctgttcgccctcgcaaagatacatactccatcaagacggactgggtacaggaagtgtatagatgatagatagatagatgatagatagatagatagatagatagatagatagatagatagatgatagatagacagatagattcctttaaaagtctgataaattgggaaaacacaaatcccttggtggaagagaaattctgaggaggagcccctggcaggtagcaggcaaatgggttagaattcaaggcagaaact

SEQ ID NO: 24617 - DNA, 308 bp, Homo sapiens
  AL353812.13_44939
  Located on chromosome 20
  Distance between a terminus base of telomere on chromosomal short arm and 5'-terminus of this base sequence : 25383578
  Distance between 3'-terminus of neighbour sequence of sequence listing upward to telomere on chrosomal short arm and 5'-terminus of this base sequence : 284377
agagcagaactttatgacagtcagctgccacaaacctcctgctctgggaagatctccagtcaggctgatgattgaccttggataccagagcatttaaaaaaaagctgtagaaaagcctcatcagaggcttccatcctacgaatccttcacacacacacacacacacacacacacacacacacacacacacacacacacccttattaagctggtatataaaccttcacctcttcttcagagagctactctctcttagagtattgccatatgcataataaacatttcttctgttgatctgtctattgtca

SEQ ID NO: 24618 - DNA, 317 bp, Homo sapiens
  chr20.fa.O7frz.27599045
  Located on chromosome 20
  Distance between a terminus base of telomere on chromosomal short arm and 5'-terminus of this base sequence : 25557441
  Distance between 3'-terminus of neighbour sequence of sequence listing upward to telomere on chrosomal short arm and 5'-terminus of this base sequence : 173555
taccaatcatggttattctatcagaattggatgtttctgtcttgtatcattcctgtaaacataaagtgaagaaatccttgggaatgacgtggcttattcaatcagcagagcctgcaatctgaacgtggacccaaagttactcttttggttttgaattttccaaagtttgatttctaaattcttgatttttcaaaaatatcaattcagcaagagacagactcaaattaaaatatatatatatatatatatgtgtgtgtatatatatatatataaataaataaacgggaccatctgtctgtattgcttaaataaccaga

SEQ ID NO: 24619 - DNA, 370 bp, Homo sapiens
  chr20.fa.O7frz.27717044
  Located on chromosome 20
  Distance between a terminus base of telomere on chromosomal short arm and 5'-terminus of this base sequence : 25675411
  Distance between 3'-terminus of neighbour sequence of sequence listing upward to telomere on chrosomal short arm and 5'-terminus of this base sequence : 117653
tggatgttagctttcaactaagctgacttttaaccattgagatcatttggaaaaaaatcttaaaatctcatgtccatatttcagctaggacaaattactgctatttcagaagtacagccattgctgtttcagtttggcctggctagcaaaaaggcagccttgttatgtaaataaagcccctttagtagtcaaagtcaaaaatctttcctcttttttttccttttgccagccatttttctccccccaccacatcacctttgtgtgtgtgtgtgtgtgtgtgtgtgtgtgtgtgtgtgtgtgaatttagccatttcagaggccttgttctccataatttggaacttttctctggatttgatcaagtcagata

SEQ ID NO: 24620 - DNA, 393 bp, Homo sapiens
  AL078587.17_90928
  Located on chromosome 20
  Distance between a terminus base of telomere on chromosomal short arm and 5'-terminus of this base sequence : 25955117
  Distance between 3'-terminus of neighbour sequence of sequence listing upward to telomere on chrosomal short arm and 5'-terminus of this base sequence : 279336
gcttgctgagtagaaagtcaagggaaatcaagattttgtgggtatcagtgacaaaaccaaatcaatcatgcatgttctggcagcccattttatataagttccccagagtagagtagctagtgaacatagaatttctccaaaatatatatatatatatatatatatatatatatatatatatatgaacataaaacttctccatatatatatatataattaattagaaaaattagagacacataggctaaattttgactctatataggctattcagttagcagttatgagtaaatgtattgaacttctctttcttggtgaaaatattgtgttccatcaagcactaaccatatggaacgtttggaagttgaacaaggactgttcattaagcttgaa

SEQ ID NO: 24621 - DNA, 223 bp, Homo sapiens
  HUMUT278
  Located on chromosome 20
  Distance between a terminus base of telomere on chromosomal short arm and 5'-terminus of this base sequence : 26142666
  Distance between 3'-terminus of neighbour sequence of sequence listing upward to telomere on chrosomal short arm and 5'-terminus of this base sequence : 187156
tcacggaattgcccactctagcctgggtgacagagcaagactcaaagaaagaaagaggagaaagaggagagagagagagagagaaagaaaggaagaaagaaaaagaaaaacaaagaaagaaagagaagaaagaaaaaaagaagaaagaaagaaagaaaaagaaagaaagaaagaaagaaagaaagaaaaagcaagaaagaggccaggcgcagtggctcatgct

SEQ ID NO: 24622 - DNA, 197 bp, Homo sapiens
  Z24141.1_133
  Located on chromosome 20
  Distance between a terminus base of telomere on chromosomal short arm and 5'-terminus of this base sequence : 26219086
  Distance between 3'-terminus of neighbour sequence of sequence listing upward to telomere on chrosomal short arm and 5'-terminus of this base sequence : 76197
attcagtgtttcagtgctacttaaaaatagaaatgctccttttatccgccagtcccttgctgtcataatactatatgttaagtgaagatttattatataatttatcagattgaatatttctcatgtacattccatatctgtgtgtgtgtgtgtgtgtgtgtgtgtgtgtgtgtctgtctgcctcattctttaacctt

SEQ ID NO: 24623 - DNA, 305 bp, Homo sapiens
  AL121762.13_6909
  Located on chromosome 20
  Distance between a terminus base of telomere on chromosomal short arm and 5'-terminus of this base sequence : 29529077
  Distance between 3'-terminus of neighbour sequence of sequence listing upward to telomere on chrosomal short arm and 5'-terminus of this base sequence : 3309794
agtgtatcagtgaggaccacactgtcttaattgctgtagctttataaaagtcctgatatttggcaggacaaatctttccttttcttcaatgtctttgatattattggccccttcccttttccatatatgtatatatacatatatatatggaaattatatatattatatatttatatgtgtgtgtatatatatatatatatatagagagagagagagagagagagagagagagagacaggcagaggtctcactttgttgcccaggcttgaggacagtggtgcaatgatagctcacttcagacttga

SEQ ID NO: 24624 - DNA, 380 bp, Homo sapiens
  AL121723.36_614
  Located on chromosome 20
  Distance between a terminus base of telomere on chromosomal short arm and 5'-terminus of this base sequence : 29656399
  Distance between 3'-terminus of neighbour sequence of sequence listing upward to telomere on chrosomal short arm and 5'-terminus of this base sequence : 127017
aatggagtgaaatggactctagtgtaatggaatggaattgaacggactcgaatggattggaatgtattggaatggagtggacacgaatgcaatggaatgtaatggaatcaaatggtatgaaatggaaaggaatgcactcgaatggaatggaatggaatggaatggaatggaatggaatggaaagaatggacttgaatggaatgtaatggaatggagttgaatggaatggaatggactcaaatggattcgaacggaatggaatggaatggaatggaatggaatggaatggaatggaatggaatggaatggattggactcgaacggaaaggaggggaatggtctcgaatggaatggaatggaaatgaatggactcaaatgga

SEQ ID NO: 24625 - DNA, 252 bp, Homo sapiens
  AL121723.36_2208
  Located on chromosome 20
  Distance between a terminus base of telomere on chromosomal short arm and 5'-terminus of this base sequence : 29658117
  Distance between 3'-terminus of neighbour sequence of sequence listing upward to telomere on chrosomal short arm and 5'-terminus of this base sequence : 1338
aatggaatagaattgaatggagatgaatggaatggaattgaatggaatagaatgctctccaatggaatggaaaggaacggaatgaaatttactcaaatgaagtggaatggaatggaatggaatcgaaagaatggaatggaatggaatggaatggaatggaatggattctaatggaatgcaactgaactgaatggacgcgaaaggaatggaaatgaatggaatggaattgaatagactagaatggattggaat

SEQ ID NO: 24626 - DNA, 380 bp, Homo sapiens
  AL121723.36_8808
  Located on chromosome 20
  Distance between a terminus base of telomere on chromosomal short arm and 5'-terminus of this base sequence : 29664722
  Distance between 3'-terminus of neighbour sequence of sequence listing upward to telomere on chrosomal short arm and 5'-terminus of this base sequence : 6353
aatggactcgaattgtaaagacacaaatggaatggaaactattggagtggaatcaaaaagactggaatcgaatggaaagggattgaatggaattgaatggaatggaaaggattggaatagaaaggaatggaatggaatggaatggaatggaatggaatggaatggaatggaatggaatggaatggaatagaatggaatgtgctcgaataaaaagactagaatgcaatggacttgaatggaatggactcgaatggaaaagatttaaaaggaattaacacaaatggaatggattcaaacgaaatgtctcgaaaggaatgctatcgtgtggaatggaatcaaataggatggaattcaatggaatggactgtaactgaatggac

SEQ ID NO: 24627 - DNA, 313 bp, Homo sapiens
  AL121751.12_76333
  Located on chromosome 20
  Distance between a terminus base of telomere on chromosomal short arm and 5'-terminus of this base sequence : 29901050
  Distance between 3'-terminus of neighbour sequence of sequence listing upward to telomere on chrosomal short arm and 5'-terminus of this base sequence : 235948
aagttgctacaaacatggatagagaaatctttgtatagacatatgtctatttaattttgttcgtttgtttgtttgtttgtttgtttgtttgagacggagtctcactctgtcacccaggctggagtgcagtggtgccatcttgactcactgcaacctccacctcctgggttcaagcaaattctccagcctcggcctcccaagtagctggaattagaggcacacaccaccacacccagctaatttttgtattgttttagtagagacggggtttcgccatgttggccagactggtctcaaacacctgacctcaagt

SEQ ID NO: 24628 - DNA, 199 bp, Homo sapiens
  D20S484
  Located on chromosome 20
  Distance between a terminus base of telomere on chromosomal short arm and 5'-terminus of this base sequence : 29920057
  Distance between 3'-terminus of neighbour sequence of sequence listing upward to telomere on chrosomal short arm and 5'-terminus of this base sequence : 18694
tatcaggcctcaccctggccctcaccctcagcctgggcaacagagcaagactccatctcaataaagatagatagatagatagatagatagatagatagatagatagacagatacatacatacacacatacatacatacatacatacatacatacatacatagatactacagccccacttttagagcttcttattctttt

SEQ ID NO: 24629 - DNA, 419 bp, Homo sapiens
  AL160175.5_61241
  Located on chromosome 20
  Distance between a terminus base of telomere on chromosomal short arm and 5'-terminus of this base sequence : 30206261
  Distance between 3'-terminus of neighbour sequence of sequence listing upward to telomere on chrosomal short arm and 5'-terminus of this base sequence : 286005
agtaccttaggctggcaaataggcaagccctggatacatcatttctgtttcaaccaaagtagcttttataaactggtcttctgtataagatttaactggaactaaggtttctgtggcttagacagggtgtgtgtgtgtgtgtgtgtgtgtgtgtgtgtgtgtgtgtgtctcatctccaattattttccttggcctttgagtgctgactagcttttggtcttccgcagttgacaacacttactacaaagaggcagaaaaagaaaatcttgtggaacaatccattccgtcaaatgcttgttcttccctggaagttgaggcagccatatcaagaaaaactccagcccagcctcagaggtaagactttggaatctcaaagtggtggttatgataataatgttcaaaggatagttactggacag

SEQ ID NO: 24630 - DNA, 231 bp, Homo sapiens
  D20S111
  Located on chromosome 20
  Distance between a terminus base of telomere on chromosomal short arm and 5'-terminus of this base sequence : 30328814
  Distance between 3'-terminus of neighbour sequence of sequence listing upward to telomere on chrosomal short arm and 5'-terminus of this base sequence : 122134
ggatgttgccaaaccattcatgagggatccattttcaggatccaaccacctcccaccaggccccactttcaacattgagaatcacattttaacttgagatttggaggggacaaacatccaaaccatatcaaggccccatctacttattttataaaggcacacacacacacacacacacacacacatatatttaccataaaatattttttatttatgtgccttattgagggc

SEQ ID NO: 24631 - DNA, 209 bp, Homo sapiens
  AL031658.11_24178
  Located on chromosome 20
  Distance between a terminus base of telomere on chromosomal short arm and 5'-terminus of this base sequence : 30351712
  Distance between 3'-terminus of neighbour sequence of sequence listing upward to telomere on chrosomal short arm and 5'-terminus of this base sequence : 22667
ggcagctacagctgtaatttagaggaggcatcttggctcggtgtgtctgtgcgtgtgtgtgtgtgtgtgtgtgtgtgtgtgtgtgtgtgtgtgtgtcctctttcccaaattgcgaggcaccctgtctcgggtggagagtgggcgcttctgtgcttctagtcatttctggcatgggttctaattctgtgtccactgcttacaagctgtat

SEQ ID NO: 24632 - DNA, 289 bp, Homo sapiens
  AL031658.11_24950
  Located on chromosome 20
  Distance between a terminus base of telomere on chromosomal short arm and 5'-terminus of this base sequence : 30352320
  Distance between 3'-terminus of neighbour sequence of sequence listing upward to telomere on chrosomal short arm and 5'-terminus of this base sequence : 399
tttgagtatcgagattgtggagcagcggttctcaaacttgagggtgcagcagaatctcctgaagagcttgttcaagcatcccacccaccccagagtatgattcagtcagcctggtgggggcctgagaatttgcatttctagcaagttcccaggtatagcagtcagggttctccagagaaaggaaagcattagtgtgtgtgtgtgcgtgtatgtgtatgtgtgtgtgtgtgtgtgtgtgtgtgtgtgtgtgtgtgtgtatgtctgtgtgtttaaggaattggctcataca

SEQ ID NO: 24633 - DNA, 229 bp, Homo sapiens
  D20S863
  Located on chromosome 20
  Distance between a terminus base of telomere on chromosomal short arm and 5'-terminus of this base sequence : 30429945
  Distance between 3'-terminus of neighbour sequence of sequence listing upward to telomere on chrosomal short arm and 5'-terminus of this base sequence : 77336
caacttcatttcaaatagagtgggatgtgggatagggtggacttcctagaggaggtttcaagagaggttgcctggtggtgaggaggagccagcggcccctgcccagtgtatgctactccctctatggacaccctttatagtttataaactatttttaaattcattgcgtgtgtgtgtgtgtgtgtgtgtgtgtgtgtgtgtggaaacagggactcactgtgttgcccag

SEQ ID NO: 24634 - DNA, 210 bp, Homo sapiens
  D20S872
  Located on chromosome 20
  Distance between a terminus base of telomere on chromosomal short arm and 5'-terminus of this base sequence : 30432899
  Distance between 3'-terminus of neighbour sequence of sequence listing upward to telomere on chrosomal short arm and 5'-terminus of this base sequence : 2725
ggttcccaaacaacatcctggaaatgccagcgcttcaccctgggaatagaccccaaatctctggctccccagtttcagatccaggcagcggggtcagagaatctgtgtaagggttccccctccacacacacacacacacacacacacacatacacatacacacacacaccacccccagtttcctgggaaagccacttttggaagagtcct

SEQ ID NO: 24635 - DNA, 162 bp, Homo sapiens
  AL049539.21_18051
  Located on chromosome 20
  Distance between a terminus base of telomere on chromosomal short arm and 5'-terminus of this base sequence : 30533388
  Distance between 3'-terminus of neighbour sequence of sequence listing upward to telomere on chrosomal short arm and 5'-terminus of this base sequence : 100279
tgaaggtgaaagctcttcatagtatcctagggttcgtgtgtgtgtgtgtgtgtgtgtgtgtgtgtgtgcatgtgcacgtgtgtgtgtatgtgtgttcctggaagaataggtcctggagaaatagtcccattgctttttccctgagaacatttcaaagtgctc

SEQ ID NO: 24636 - DNA, 299 bp, Homo sapiens
  AL049539.21_20418
  Located on chromosome 20
  Distance between a terminus base of telomere on chromosomal short arm and 5'-terminus of this base sequence : 30535761
  Distance between 3'-terminus of neighbour sequence of sequence listing upward to telomere on chrosomal short arm and 5'-terminus of this base sequence : 2211
gcagtcacctttagtttctgttagcctaatatttatttatttatttatttatttatttatttatttatttatttattttgagacggagtctcgctctgctgcccaggctggagtgcattggcgccatctcagctcactgcaaactccacctcctgggtttaagtgattgtcctgcctcagcctcccaagcagctgggattacaagcatgtgccatcatgcccagctagtttttgtatttttagtagagacagggtttcaccatgttggccaggctggtctcgaactgatgacctcaagt

SEQ ID NO: 24637 - DNA, 274 bp, Homo sapiens
  AL049539.21_50629
  Located on chromosome 20
  Distance between a terminus base of telomere on chromosomal short arm and 5'-terminus of this base sequence : 30565924
  Distance between 3'-terminus of neighbour sequence of sequence listing upward to telomere on chrosomal short arm and 5'-terminus of this base sequence : 29864
tagatgtcaaatctaggactggatattactgcgtctccagagcagaaatgtgctgcacacagccctctttcccgtaaacacacacacacacacacacacacacacacacacacacagtagccagagtaacctttaaaactgcagatatgatttattccttttctacttaaaattcctgagtctcctcactgcactgagaacaaagcccaacacttgctactcataggatggtccatgaaccaaaagtgtcgtcattacctaggagcttgttaga

SEQ ID NO: 24638 - DNA, 225 bp, Homo sapiens
  D20S874
  Located on chromosome 20
  Distance between a terminus base of telomere on chromosomal short arm and 5'-terminus of this base sequence : 30565939
  Distance between 3'-terminus of neighbour sequence of sequence listing upward to telomere on chrosomal short arm and 5'-terminus of this base sequence : -259
ggactggatattactgcgtctccagagcagaaatgtgctgcacacagccctctttcccgtaaacacacacacacacacacacacacacacacacacacacagtagccagagtaacctttaaaactgcagatatgatttattccttttctacttaaaattcctgagtctcctcactgcactgagaacaaagcccaacacttgctactcataggatggtccatgaac

SEQ ID NO: 24639 - DNA, 263 bp, Homo sapiens
  AL049539.21_53351
  Located on chromosome 20
  Distance between a terminus base of telomere on chromosomal short arm and 5'-terminus of this base sequence : 30568623
  Distance between 3'-terminus of neighbour sequence of sequence listing upward to telomere on chrosomal short arm and 5'-terminus of this base sequence : 2459
ttctgagttgtttcacgtaagataatagtctccagtttcatccatgttgctgcaaaagacatgattttattcttttttatggctgaagagtattccattctgtgtgtgtgtgtgtgtgtgtgtgtgtgtgtgtgtgtatacatttatacagtgtcccaagtcctaggtctccctgaaggcttagaaagaaaaggtgggaggtgctgctggaaaggcactggggccggtgggtggaagttcctccataccaagctaggattact

SEQ ID NO: 24640 - DNA, 163 bp, Homo sapiens
  HUMUT5798
  Located on chromosome 20
  Distance between a terminus base of telomere on chromosomal short arm and 5'-terminus of this base sequence : 30680658
  Distance between 3'-terminus of neighbour sequence of sequence listing upward to telomere on chrosomal short arm and 5'-terminus of this base sequence : 111772
ctcctctctactgcttgctaataatctgtccttgtaacagagtagacctcagagtcagacaatcttagttttctggaatttagtaacactattactaagtaaataaatgaattatttatttatttatttatttatttattgagacaggttctcactcttgccc

SEQ ID NO: 24641 - DNA, 257 bp, Homo sapiens
  D20S200
  Located on chromosome 20
  Distance between a terminus base of telomere on chromosomal short arm and 5'-terminus of this base sequence : 30818007
  Distance between 3'-terminus of neighbour sequence of sequence listing upward to telomere on chrosomal short arm and 5'-terminus of this base sequence : 137186
agcttcctgggctcaaatgatcctcccactttagcctcccaggtagttgggactacaggtgcgtgccactgtggctgagtaatttgtgtgtgtgtgtgtgtgtgtgtgtgtgtgtgtgtgttttaatagagatggggctttgccatgttgcccagcctggctcttgacctcttgggctcaagccatctgcccaccttgacctcccaaagtgctaggattataggcgtgaaccaccatgcccagcctttgactgtgtt

SEQ ID NO: 24642 - DNA, 206 bp, Homo sapiens
  D20S903
  Located on chromosome 20
  Distance between a terminus base of telomere on chromosomal short arm and 5'-terminus of this base sequence : 30915988
  Distance between 3'-terminus of neighbour sequence of sequence listing upward to telomere on chrosomal short arm and 5'-terminus of this base sequence : 97724
cccacgtgtcctctagtgtcctctccccacacacaggcacacgcactcactctgcctccctcccacaggctgcctgctccataaacacaagcacctccacccacagccctccttcgtgaaaactcgctcacacacccggagggacacacacacacacacacacacacacacacacacacacgttcaaaaggctctgcacaaagggt

SEQ ID NO: 24643 - DNA, 159 bp, Homo sapiens
  D20S187
  Located on chromosome 20
  Distance between a terminus base of telomere on chromosomal short arm and 5'-terminus of this base sequence : 30918127
  Distance between 3'-terminus of neighbour sequence of sequence listing upward to telomere on chrosomal short arm and 5'-terminus of this base sequence : 1933
tctcaagatgaggcccagagggaactcatgggtgatgaggctatatttacacacacacacacacacacacacacacacactctctctctctctctctcatgcatgctcactttcttcaatgagttgttgcacatttattgagcatctactatgtgctgg

SEQ ID NO: 24644 - DNA, 368 bp, Homo sapiens
  AC017072.5_29503
  Located on chromosome 20
  Distance between a terminus base of telomere on chromosomal short arm and 5'-terminus of this base sequence : 30928499
  Distance between 3'-terminus of neighbour sequence of sequence listing upward to telomere on chrosomal short arm and 5'-terminus of this base sequence : 10213
gcacacttgtcactgcttactattagcaatctcttttatctctgtcaatctgagggaggaagaacagtgtctcttattttcctttgctcctcttcacttgggaatgtaagtagatgtttctgtgcactgtgtttacggggcacttgtatttctttttctttctttcttttctttctttcttttccttccttccttccttccttccttccttccttccttccttcctttctttctttctttttctttctttctttctttctttttctttctttctttctttctttctttctttctttctttctttctttctttctttctttctttctttcctctctctttctttctttctgactaacctgttcatatcc

SEQ ID NO: 24645 - DNA, 260 bp, Homo sapiens
  D20S843
  Located on chromosome 20
  Distance between a terminus base of telomere on chromosomal short arm and 5'-terminus of this base sequence : 31031352
  Distance between 3'-terminus of neighbour sequence of sequence listing upward to telomere on chrosomal short arm and 5'-terminus of this base sequence : 102485
gcagtatctccaacatccagaacaatacctgacacgtagtaggtgtcccatatgtgtttactgaataaatgaatgaatgaaaatccctgagagagagagagagagagagagagtgtgtgtgtgtgtgtgtgtgtgtgtgtgtgtgtgtgtgtgtgtgtgtattttgactatacactgcaatgagatccaggaagatttctgctgaattggagaggcaggggccttttttgcttatattcattttgtctttggcaagtcac

SEQ ID NO: 24646 - DNA, 309 bp, Homo sapiens
  AL035071.17_21057
  Located on chromosome 20
  Distance between a terminus base of telomere on chromosomal short arm and 5'-terminus of this base sequence : 31171576
  Distance between 3'-terminus of neighbour sequence of sequence listing upward to telomere on chrosomal short arm and 5'-terminus of this base sequence : 139964
actcatttactcacctggtaagagatacagggagaaagctgtggagtaactcagggagctggagcccataaggcaggaaacccatgcccattcattcaacaaacttgtattgagctcctttttgatgcatcccccatccactataagcacttggagacccacacagatgtggtttctgctcccatagtgtgtgtgtgtgtgtgtgtgtgtgtgtgtgtgtgtgtgtgtgtgtgtgtaggggaatgtaaacaggaaaacagatatgcaaaacaatttcagatcgcggtaagtgctaggaacagaatgaaa

SEQ ID NO: 24647 - DNA, 392 bp, Homo sapiens
  AL035071.17_104896
  Located on chromosome 20
  Distance between a terminus base of telomere on chromosomal short arm and 5'-terminus of this base sequence : 31255337
  Distance between 3'-terminus of neighbour sequence of sequence listing upward to telomere on chrosomal short arm and 5'-terminus of this base sequence : 83452
taagctctttcgacttcctttcttccttggtcattaatgccaccaggcatgtgattagaaggccccttccctgccttttggattgtggagctgtagctctgagtctgcttcccgctggggctggtcggctcttggcctgtgtatcccctgctctttggggctgttggtttcaggaaaggcagcaaactgcagcaaaagcagaggtggggacagtgagggaaaatggatgatttagctttgccggccaccaggcagtagctgtactgtatgtatgtatgtatgtatgtatgtatgtatgtatgtatgtatgaatgaatgaatgaatgattgaatgagacagggtcttgctgtgtctcccagactagagtgtaatggtccattgatagcttact

SEQ ID NO: 24648 - DNA, 162 bp, Homo sapiens
  DISO7_00021430
  Located on chromosome 20
  Distance between a terminus base of telomere on chromosomal short arm and 5'-terminus of this base sequence : 31648468
  Distance between 3'-terminus of neighbour sequence of sequence listing upward to telomere on chrosomal short arm and 5'-terminus of this base sequence : 392739
gaagcttgacaaatggtgagttttcaggggtgtatgtgtgcatgtgtgtgtgtgtgtgtgtgtgtgtgtgtgtgtgtgtgtgtgtgtgtgtgtgtccaaccctgcaaagtggggagggacagggctggatgggggagggggcctgaggatctggaattgtca

SEQ ID NO: 24649 - DNA, 285 bp, Homo sapiens
  HUMUT5028
  Located on chromosome 20
  Distance between a terminus base of telomere on chromosomal short arm and 5'-terminus of this base sequence : 31651051
  Distance between 3'-terminus of neighbour sequence of sequence listing upward to telomere on chrosomal short arm and 5'-terminus of this base sequence : 2421
atggatgattggaaagctgagacaatgagagaatagatgagtgagaggctgaaagggtgggaaaatggatgggaaggagggagcgtggaaagatggatggatggatggatggatggatggatggatggatggatggatggacagatggttagatggttgggttgatggagagaaggatgaatagatagatggatggatagatagatgatagatagatagatagatagatagatagatagatagatagataaagtagtacttattccttcttagaccaagctaacc

SEQ ID NO: 24650 - DNA, 137 bp, Homo sapiens
  DID22N_0018578
  Located on chromosome 20
  Distance between a terminus base of telomere on chromosomal short arm and 5'-terminus of this base sequence : 31685964
  Distance between 3'-terminus of neighbour sequence of sequence listing upward to telomere on chrosomal short arm and 5'-terminus of this base sequence : 34628
cgtggaagatgaatagagggagggtcacgtgtgtgtatgtgtgcgtgtgtgtgtgtgtgtgtgtgtgtgtgtggcaggggtgttgagtgttggttgggggagggcatccagggcgttcccaggaggctgaaacctct

SEQ ID NO: 24651 - DNA, 369 bp, Homo sapiens
  AC023015.2_16770
  Located on chromosome 20
  Distance between a terminus base of telomere on chromosomal short arm and 5'-terminus of this base sequence : 31875318
  Distance between 3'-terminus of neighbour sequence of sequence listing upward to telomere on chrosomal short arm and 5'-terminus of this base sequence : 189217
acggtgaaacctgtttctactaaaaatacaaaaaattagccaggtgtggtggcaagtacctgtagtcccagctacatgggaggctgaggtaggagaatcacttgaacccgggaggcggaggttacagtgacctgagatcgtgccactgcactccagcctcggcgacagagagagagagagagagaaacagagagaaagaaaggaaggaaagaaagcgagagagagagagggggagagagagagagagagagagagagaggaaggaaggaaggaaggaaggaaggaaggaaggaaggaaggaaagaaggaaggagaaaatcaaggatgatgaggtttaggacgcacgtactgagtccttactatctgcca

SEQ ID NO: 24652 - DNA, 195 bp, Homo sapiens
  DID22N_0018586
  Located on chromosome 20
  Distance between a terminus base of telomere on chromosomal short arm and 5'-terminus of this base sequence : 31939283
  Distance between 3'-terminus of neighbour sequence of sequence listing upward to telomere on chrosomal short arm and 5'-terminus of this base sequence : 63596
cctgccttaaatgtccactcgtgtgtgtgtgtgtgtgtgcgtgtgtggtgtagtgacgggatctcaccatgttgtccaggctggtcttgaactcctgggctcaagcaatctgcccactttggcctccaaagtgttgggattacaggcgtaagccactgcacccggcctaaaatgtcaactcttggttgagaatga

SEQ ID NO: 24653 - DNA, 450 bp, Homo sapiens
  AL050349.27_9139
  Located on chromosome 20
  Distance between a terminus base of telomere on chromosomal short arm and 5'-terminus of this base sequence : 32124912
  Distance between 3'-terminus of neighbour sequence of sequence listing upward to telomere on chrosomal short arm and 5'-terminus of this base sequence : 185434
ctgaagtcaggagttcaagaccagcctggccaatatggtaaaactccatctctactaaaaatacaaaaattagccaggtgtggtggtgggtgcctatagtcccagctactcaggagactgaagcaggagaatcgcttgaaccccagaggcggaggttgcagtgaaccgagatcatcaccgcactctgacctgggtgacagagagagactccatctcaacaacaacaacaacaacaacaacaaaacacaacaaaaaaagagttgaactttagaaggcgtgatggggggacagggtagacccagctaagaagctattacgactgtcctggcactgagggctgaccacattctctcccagtttgagggatgtgtacctgccattccggaagagaaaggtcatgaccagcgcgtgaggggcccggattttggctccatagctgtagaaacagaa

SEQ ID NO: 24654 - DNA, 206 bp, Homo sapiens
  D20S878
  Located on chromosome 20
  Distance between a terminus base of telomere on chromosomal short arm and 5'-terminus of this base sequence : 32288933
  Distance between 3'-terminus of neighbour sequence of sequence listing upward to telomere on chrosomal short arm and 5'-terminus of this base sequence : 163571
caagtgttcaaggtggcgctagggaacagagaaggggttgtgagggtgtcgtgggcacaggccccggagggacagtgagcttaataggagtgtgtgtgtgtgtgtgtgtgtgtgtgtgtgtgtgtgtgtgatggtggtggtggtggtgctggtggtggtgtggggattacaaacaggaaggaaatctcattagatgggctgggtct

SEQ ID NO: 24655 - DNA, 106 bp, Homo sapiens
  DISO7_10008498
  Located on chromosome 20
  Distance between a terminus base of telomere on chromosomal short arm and 5'-terminus of this base sequence : 32483498
  Distance between 3'-terminus of neighbour sequence of sequence listing upward to telomere on chrosomal short arm and 5'-terminus of this base sequence : 194359
catgtggagatatgtggacacaacccttgtatgtatagatgtagtgtgtgtgtgtgtgtgtgtgtgtgtgtgtgagagagagaacatatttgaatgtgtcagcaga

SEQ ID NO: 24656 - DNA, 239 bp, Homo sapiens
  AL109923.29_48816
  Located on chromosome 20
  Distance between a terminus base of telomere on chromosomal short arm and 5'-terminus of this base sequence : 32882116
  Distance between 3'-terminus of neighbour sequence of sequence listing upward to telomere on chrosomal short arm and 5'-terminus of this base sequence : 398512
ctttcaacaggtactgtttcattctctcaataatttcccccctggctgctagcttaggacccgcttttggtgctgtcagtttaatctgaatggtttggaacttcttgagttgaagtccttgaatttttcaagtgcgatctcattgccagccaccttagggcttaaggggtgtgtgtgtgtgtgtgtgtgtgtgtgtgtgtgtgtgtgtgtttcaggtttccatttctaaactggtatga

SEQ ID NO: 24657 - DNA, 122 bp, Homo sapiens
  DISO7_00021465
  Located on chromosome 20
  Distance between a terminus base of telomere on chromosomal short arm and 5'-terminus of this base sequence : 32978351
  Distance between 3'-terminus of neighbour sequence of sequence listing upward to telomere on chrosomal short arm and 5'-terminus of this base sequence : 95996
tacagccagtcccactgagctcccagcagcacggtgttcctcctttgctccctccttcctcctctctctctctctctctctctctctccctccttcacccccacccaggtcttgctacctaa

SEQ ID NO: 24658 - DNA, 246 bp, Homo sapiens
  AL109824.24_27735
  Located on chromosome 20
  Distance between a terminus base of telomere on chromosomal short arm and 5'-terminus of this base sequence : 33140112
  Distance between 3'-terminus of neighbour sequence of sequence listing upward to telomere on chrosomal short arm and 5'-terminus of this base sequence : 161639
cttgcaagacatgtaacaaataaaaataatgcaacaaaacaaaacaaaacaaaacaaaacaaaacaaaacaatactggtcaaaaggctgcctcttctgggaagtcttccatgatctcatttcccaagtagagctgtctcttttgtctcttgggttcacagtctttatctggcattctagagcacccatcagattgtacatcgtgttctattttaatgttttgtgtcttcaactagactgtgaacct

SEQ ID NO: 24659 - DNA, 413 bp, Homo sapiens
  HUMUT7950B
  Located on chromosome 20
  Distance between a terminus base of telomere on chromosomal short arm and 5'-terminus of this base sequence : 33309969
  Distance between 3'-terminus of neighbour sequence of sequence listing upward to telomere on chrosomal short arm and 5'-terminus of this base sequence : 169611
cctctcaacgttatcacatttttttctttctttctttctttccttctttctttctttctttctttccttccttccttccttccttccttccttccttccttccttcctttctttttctttcttttctttcttttttgtttttttttgagatggagtcttgctcttgtcgcccaggctggagtgcaatggcatgatctcggctcactgcaacctccgcctcccgggttcaagcgattctcccacctcagcctcccgagcagctgaggtacaggcactggccaccacgcccggctaatttttgtatttttagtagagacggggtttcaccatgttggccaggctggtcttgaacacctgaccttgtgatccacccgccccagcctcccaaagtgctgggattacaggcatgagtc

SEQ ID NO: 24660 - DNA, 326 bp, Homo sapiens
  D20S106
  Located on chromosome 20
  Distance between a terminus base of telomere on chromosomal short arm and 5'-terminus of this base sequence : 33330078
  Distance between 3'-terminus of neighbour sequence of sequence listing upward to telomere on chrosomal short arm and 5'-terminus of this base sequence : 19696
tgagctcatgcaagaggcaggggatgagtgtgagcccgagtggtgtgatgccgaggacccactcttcatcctgtacaccagtggctccacaggcaaacccaaggcaagtgtgtgtgtgtgtgtgtgtgtgtgtgtgtgtgtgtgtgtgtgtattatgtaggggtaagaagtaagtttctgaggaaacaagtaatgaaattatttttttcctacaaccctgagttttggaaatgtagcattgtcttttctaaatcaaattaagacataaatcctcaatctataggtggtgaggcccagggtgagacagttcaggtggagggttttca

SEQ ID NO: 24661 - DNA, 366 bp, Homo sapiens
  DISO7_00021484
  Located on chromosome 20
  Distance between a terminus base of telomere on chromosomal short arm and 5'-terminus of this base sequence : 33597653
  Distance between 3'-terminus of neighbour sequence of sequence listing upward to telomere on chrosomal short arm and 5'-terminus of this base sequence : 267249
cctcaatccatagtttgatctatcttcctccaaatctgctctgtcactcaggctggagtgcagtggtgtgatcccagttcactgcagtctccatctcgcaggctcaaacgatcctcccacctcagcttcctgagtagctgggactacaggcatgcacctccaagcctgcctaaatttgttttgtttgtttgtttgtttgttttgtagagtcagggtttcaccatgttgcccaggctcgaattcctgaactgaagtgatccacctacctgggcctgccaaagtgctgggattacaggcatgagccaccacacctggcctgaacacgcttatactaatggtgaaataatgttgggtagctgtaagtgg

SEQ ID NO: 24662 - DNA, 283 bp, Homo sapiens
  DISO7_00021487
  Located on chromosome 20
  Distance between a terminus base of telomere on chromosomal short arm and 5'-terminus of this base sequence : 33651641
  Distance between 3'-terminus of neighbour sequence of sequence listing upward to telomere on chrosomal short arm and 5'-terminus of this base sequence : 53622
gatccatcttccttagcctctaatacacacacacagacacacagacacacacacacataatgctagtccaacttcttgtcctgtcccctggcttagatgctgtcattcgactgcccccaccccatttgcccttctaggagtgtgcccctaggctctgaggattgtccccagagaacctgggagagaaacagagcctagagaatattagagaatacactaatactggcccacccccaccatgtgtctgatccatcccagtgtttagttctggcctagacatttg

SEQ ID NO: 24663 - DNA, 269 bp, Homo sapiens
  Z67143
  Located on chromosome 20
  Distance between a terminus base of telomere on chromosomal short arm and 5'-terminus of this base sequence : 33731428
  Distance between 3'-terminus of neighbour sequence of sequence listing upward to telomere on chrosomal short arm and 5'-terminus of this base sequence : 79504
ggttagaaattagcccactgtggaatattttgtgagatacttagaaacagagtaagagtagacagacaagagagacgggggacatggagagaccaaataaaaaagtctacctgttaactcacatgcattacgactgaaagatctattgagggtcttttagcaatgatgacaaaatacaaacaaaactgtgtgtgtgtgtgtgtgtgtgtgtgtgtgtgcgcgcgcgcgcgcgcacgctcaggcacgcatgcatattgagcagttccaga

SEQ ID NO: 24664 - DNA, 316 bp, Homo sapiens
  DISO7_00021502
  Located on chromosome 20
  Distance between a terminus base of telomere on chromosomal short arm and 5'-terminus of this base sequence : 33849140
  Distance between 3'-terminus of neighbour sequence of sequence listing upward to telomere on chrosomal short arm and 5'-terminus of this base sequence : 117443
ctcctgcatctagtctgggacctgatttgttatgcgtgtgtgtgtgtgtgtgtgtgtgtgtgtgtgtgtgtgtgtgtgtgtgtttatgtgtgcctgtgtgtgtgtgtgcctgtgtgtgtgtgtgcctgtgtgtgtgtattgggagtagggacagcacagatggcagcatttacccacattttcttttattttaataaacttgtggtgacccagagactgaaaaatatcagtgcccactacaccccctccctacccccaaatgccattgactgagtgcatattcttcaggcttgggggcactgtcgcccttaagttc

SEQ ID NO: 24665 - DNA, 396 bp, Homo sapiens
  20_35086042
  Located on chromosome 20
  Distance between a terminus base of telomere on chromosomal short arm and 5'-terminus of this base sequence : 33853841
  Distance between 3'-terminus of neighbour sequence of sequence listing upward to telomere on chrosomal short arm and 5'-terminus of this base sequence : 4385
accatccttataaagtcagttggccagattattattattattattattatttttggagacagagtctagttctgttgcccaggctggagtgcaatggcatgatatcggctcactgcaacctctgcctcccaggttcgagcgattctcctgtctcagcctcccaagtagctgggactacaggcatgcgccaccacccctggctaatttttgtatttttagtagagacagggtttcaccatgctggccaggctggtctcgaactcctgacctcaaatgatccacccacctcagcctcccaaagtgctgggattacaggcgtgagccactgcgccggccggccagattattattatcccttttttattgtgtctccagatgagtaaacagtgaactgag

SEQ ID NO: 24666 - DNA, 347 bp, Homo sapiens
  DISO7_00021512
  Located on chromosome 20
  Distance between a terminus base of telomere on chromosomal short arm and 5'-terminus of this base sequence : 34006424
  Distance between 3'-terminus of neighbour sequence of sequence listing upward to telomere on chrosomal short arm and 5'-terminus of this base sequence : 152187
aatcattaaggccagccttgctcttgagctccagagctcgctaatacttaaccacctactaccctggctaccccaggtgtggcccatggaccaacagcactggtatcacctgcaggctatttaaaactgtaggacctcagccccaccccaggccctgctgaatcagaagctgcgtttatgccctcggggattcctaagcacattgaagcctcagacgtctccaccagcttggctaacgtatagcttgaacattacatgcccaagccaaatgcatactttccaatgatcccccccgcaaaacaaaacaaaacaaaacaaaaaccctatttcacctcagaactttcgag

SEQ ID NO: 24667 - DNA, 276 bp, Homo sapiens
  Z66855
  Located on chromosome 20
  Distance between a terminus base of telomere on chromosomal short arm and 5'-terminus of this base sequence : 34254979
  Distance between 3'-terminus of neighbour sequence of sequence listing upward to telomere on chrosomal short arm and 5'-terminus of this base sequence : 248208
ataaaattcccaccctgagaatctcccatttttcttcaccatcaccacacacacacacacacacacacacacacacacacacacacacacacaggctgaaacaataaaatataaagttcatcctaagaagaagatatcgagtccaaagagggttatcaactttagaaaagaagcaaagaaatcataaaataatgatattttaagattacagattaagccctaatttagaatatttttagaaattttatcatattaaaacaagggtgaaggcactat

SEQ ID NO: 24668 - DNA, 248 bp, Homo sapiens
  AL078461.38_74314
  Located on chromosome 20
  Distance between a terminus base of telomere on chromosomal short arm and 5'-terminus of this base sequence : 34274724
  Distance between 3'-terminus of neighbour sequence of sequence listing upward to telomere on chrosomal short arm and 5'-terminus of this base sequence : 19469
agtttaaatagctgcagtggatacatttaaaatacaaaacatgaaggctgagtgcgttggtgcatgtttgttgtcccagctactcaggaggctgaggtgggaggattgcttgagcccaagaattccaaaccagcctggacaatgtagtgacaccccatctcaaaacacacacacacacacacacacacacacacacacacacacacacaaatattttcatcaaaactgtggaactacagagcaaacct

SEQ ID NO: 24669 - DNA, 196 bp, Homo sapiens
  D20S914
  Located on chromosome 20
  Distance between a terminus base of telomere on chromosomal short arm and 5'-terminus of this base sequence : 34476885
  Distance between 3'-terminus of neighbour sequence of sequence listing upward to telomere on chrosomal short arm and 5'-terminus of this base sequence : 201913
ctgcacccagcctcttcctgaatttaaatctctcccagcctgtgtgtgtgtgtgtgtgtgtgtgtgtgtgtgtgtgccagccacaccaaccacatgcaatggcttcccccctggaaggagttgttctgtaccagaataagggggaaggaaatactggtcagagggatttatttttttaaagcaagcatgggtatgc

SEQ ID NO: 24670 - DNA, 151 bp, Homo sapiens
  D20S896
  Located on chromosome 20
  Distance between a terminus base of telomere on chromosomal short arm and 5'-terminus of this base sequence : 34521028
  Distance between 3'-terminus of neighbour sequence of sequence listing upward to telomere on chrosomal short arm and 5'-terminus of this base sequence : 43947
actcacacccattggccccagtttgcatttgttacacacacacactctcacatcccattggcctcagtttgctttacacacacacacacacacacacacacacacacacacacaccattggcctcaatttgcatttgtccctattccaggt

SEQ ID NO: 24671 - DNA, 139 bp, Homo sapiens
  D20S847
  Located on chromosome 20
  Distance between a terminus base of telomere on chromosomal short arm and 5'-terminus of this base sequence : 34676006
  Distance between 3'-terminus of neighbour sequence of sequence listing upward to telomere on chrosomal short arm and 5'-terminus of this base sequence : 154827
aagccggaaatctggacttttatgtgaaatgtctcatttttaaatgttggcaaagaaattcagattaaaacacacacacacacacacacacacacacacacacacacacacacacagtgcaagggaacccaaaccacat

SEQ ID NO: 24672 - DNA, 234 bp, Homo sapiens
  DISO7_10008526
  Located on chromosome 20
  Distance between a terminus base of telomere on chromosomal short arm and 5'-terminus of this base sequence : 34897846
  Distance between 3'-terminus of neighbour sequence of sequence listing upward to telomere on chrosomal short arm and 5'-terminus of this base sequence : 221701
aagtggtcccaagtggtcaaagcgagtctctcgctcttgctctctctctctctctctctgtctctctctctctctctctgtctctctcctctctctctctctctgtctctgtctctctctctctctctctcctctctctctctctctctctctctctctctctctctctctctctctcccccccccttctctcggccctgccttcctagccctgggccaggctctgagaggatg

SEQ ID NO: 24673 - DNA, 244 bp, Homo sapiens
  AL132768.15_14117
  Located on chromosome 20
  Distance between a terminus base of telomere on chromosomal short arm and 5'-terminus of this base sequence : 35145894
  Distance between 3'-terminus of neighbour sequence of sequence listing upward to telomere on chrosomal short arm and 5'-terminus of this base sequence : 247814
aatctgttcaaactgataatccagggataagaatgaaaatcctatatctgtgtgtgtgtgtgtgtgtgtgtgtatatatatatatatatatatatatatatatatatatatatatatatattatatttaagtatctatagcaatcattaccttcaaaatatactaagaaacagacttcataaagaaatttataaagaggttggatacttggataaaactatctacaatcagataatcctctgca

SEQ ID NO: 24674 - DNA, 157 bp, Homo sapiens
  AL132768.15_109828
  Located on chromosome 20
  Distance between a terminus base of telomere on chromosomal short arm and 5'-terminus of this base sequence : 35241571
  Distance between 3'-terminus of neighbour sequence of sequence listing upward to telomere on chrosomal short arm and 5'-terminus of this base sequence : 95433
aacatacaaaggacatggacacacacaataaatgtaaccagtgggaactatgtgaagaccttctgacctccaaccttcacccaccctcccctccttctctctctccctctctctctctctctctctctctctctctctctctttcaacggagtttcg

SEQ ID NO: 24675 - DNA, 101 bp, Homo sapiens
  DISO7_10008528
  Located on chromosome 20
  Distance between a terminus base of telomere on chromosomal short arm and 5'-terminus of this base sequence : 35284634
  Distance between 3'-terminus of neighbour sequence of sequence listing upward to telomere on chrosomal short arm and 5'-terminus of this base sequence : 42906
gacactacagatgctctatcagggaggggtgtgtgtgtgtgtgtgtgtgtgtgtgtgtgtgtgtgtgtggtggttgttgttggtaagagaccactgcccac

SEQ ID NO: 24676 - DNA, 197 bp, Homo sapiens
  Z13960.1_86
  Located on chromosome 20
  Distance between a terminus base of telomere on chromosomal short arm and 5'-terminus of this base sequence : 35620203
  Distance between 3'-terminus of neighbour sequence of sequence listing upward to telomere on chrosomal short arm and 5'-terminus of this base sequence : 335468
tttcaatccatttcaattgttatcctttttggtgctcaaaatgttccatttttgccaatgggccaaactgtgtgtgtgtatgtgtgtgtgtgtgtgtgtgtgtgtgtgtgtgtgtgtgaacatccattcatttacacattgggtacaactggttttcagtttaactgtagagttaaatagttactagactggccaga

SEQ ID NO: 24677 - DNA, 152 bp, Homo sapiens
  D20S834
  Located on chromosome 20
  Distance between a terminus base of telomere on chromosomal short arm and 5'-terminus of this base sequence : 35796227
  Distance between 3'-terminus of neighbour sequence of sequence listing upward to telomere on chrosomal short arm and 5'-terminus of this base sequence : 175827
ttgaaaccaggtaagcctgtgttttttcttaaaaaggaaagaaaagacatcaacacacacacacacacacacacacacacacacacacacacacacacacacacgacagggaaaagtaagcctctctcacacccaggtctccttgccagagg

SEQ ID NO: 24678 - DNA, 174 bp, Homo sapiens
  AL133293.28_53116
  Located on chromosome 20
  Distance between a terminus base of telomere on chromosomal short arm and 5'-terminus of this base sequence : 35861618
  Distance between 3'-terminus of neighbour sequence of sequence listing upward to telomere on chrosomal short arm and 5'-terminus of this base sequence : 65239
ctgagtctgcaagccattcatgctgtgtgtgtgtgtgtgtgtgtgtgtgtgtgtgtgtacatctgtcagtctctcacttctttccccctgggacttgggatgggcggttcctggtctctgggtcactgtcatttacaccttttccatctatttgttgattcatccacaagaggt

SEQ ID NO: 24679 - DNA, 206 bp, Homo sapiens
  AL109614.28_98166
  Located on chromosome 20
  Distance between a terminus base of telomere on chromosomal short arm and 5'-terminus of this base sequence : 35988431
  Distance between 3'-terminus of neighbour sequence of sequence listing upward to telomere on chrosomal short arm and 5'-terminus of this base sequence : 126639
ggtacgtaaggacattggaagaaaatctcaggcagaggtaagagcatagagaagagtttggaatagataagagccactgcctctggctgtgtgagtgcatgtgtgtgcatatgtgcgtgagtatgaatgtgtgtgtgtgtgtgtgtgtgtgtgtgtgtgtagggtggtagggtggtagggtgtgaatctggagatgcaggtagaac

SEQ ID NO: 24680 - DNA, 375 bp, Homo sapiens
  AL109614.28_173635
  Located on chromosome 20
  Distance between a terminus base of telomere on chromosomal short arm and 5'-terminus of this base sequence : 36063824
  Distance between 3'-terminus of neighbour sequence of sequence listing upward to telomere on chrosomal short arm and 5'-terminus of this base sequence : 75187
gcaagtaagcaagtgctctaatggagaaagaaaccacgtgccgagggtccgcaggaaaggagcaagtgatcctgctgtggaaggtcaaggacacagtctcagaagcagcagcacaggagctgggcatcctggagctccagcgttcttggtggaggaaatggcagaagcaaaggcacaaggtgtgggaggagctgcaggatccttgtgtgtgtgtgtgtgtgtgtgtgtgtgtgtgtgtgtgggtctagggtaggagatgaggaaggagaggagatggggagggaggggggtgagatcaggggatacttaaatgctggagggaggaatttgaaccctgtcccagaggtgtgggagccactgaaggatttcgagcag

SEQ ID NO: 24681 - DNA, 265 bp, Homo sapiens
  AL109614.28_182853
  Located on chromosome 20
  Distance between a terminus base of telomere on chromosomal short arm and 5'-terminus of this base sequence : 36073105
  Distance between 3'-terminus of neighbour sequence of sequence listing upward to telomere on chrosomal short arm and 5'-terminus of this base sequence : 8906
atcttatgtaaagtgttctgcaaatatggtggcaagcccaccttctaggcagattgtgggccccacatagaaattctagagtgtctactgcacaacacctcacagtctctataaatacgtttatctaactatctacccagtccatccatccatccatccatccatccatccatccatccatgcatcccttcatttatccatccatgcatcctttcatctatccatcttcccatccatccatctatccactcattctatccatcac

SEQ ID NO: 24682 - DNA, 321 bp, Homo sapiens
  AL118499.39_45783
  Located on chromosome 20
  Distance between a terminus base of telomere on chromosomal short arm and 5'-terminus of this base sequence : 36169983
  Distance between 3'-terminus of neighbour sequence of sequence listing upward to telomere on chrosomal short arm and 5'-terminus of this base sequence : 96613
tccagcattagagtcctatcaggttttgtactgatctccaccatacaggagcactgtgtgtgtgtgtgtgtgtgtgtgtgtgtgtgtgtgtgtaattacacaagtaatgcatgaatagattgtcattctgaaaataccagtggtacatgagtagagtgaaaaatgaaagttttccttcactactctgatccctttccattcctctgcctagaggaaccttgtgaacagttaattatgcaaatgtatttgtttctacttaaatcatactgtgcatattctgcaccttgattttttgggtcatctaacagatctgtccaggtg

SEQ ID NO: 24683 - DNA, 176 bp, Homo sapiens
  D20S859
  Located on chromosome 20
  Distance between a terminus base of telomere on chromosomal short arm and 5'-terminus of this base sequence : 36245979
  Distance between 3'-terminus of neighbour sequence of sequence listing upward to telomere on chrosomal short arm and 5'-terminus of this base sequence : 75675
ttactgaaaacatcatggacaccatccattcaaacactatgttagggactctgtgagtgtgtgtgtgtgtgtgtgtgtgtgtgtgtaattttgtataaagggaatcatgatggatatactgtttttactcactgcatcttgggcattttttagcaagggtgggcattttaatacag

SEQ ID NO: 24684 - DNA, 468 bp, Homo sapiens
  AL109823.23_65531
  Located on chromosome 20
  Distance between a terminus base of telomere on chromosomal short arm and 5'-terminus of this base sequence : 36461252
  Distance between 3'-terminus of neighbour sequence of sequence listing upward to telomere on chrosomal short arm and 5'-terminus of this base sequence : 215097
agatggtttcattggagaattccgccaaacatttaatgaagaattaacaccaattctgcacatactcttctagaaaaagaagaaacactttccaatccattttataaagccagtattatcctgataccaaaccaaaggcaatacaaaaattaaaaaaatctatagaccaatttctctcatgagtatagatgcaaaaatcctaaagaaaatattaggaaattcagcagtatgtaaaacacacacacacacacacacacacacacacacaccatgataaagtggggtatatttcagagatgcaagactggctcaatatttgaaaatcaattagagttgttaatactaacaagctattaacaagcttaagaagaaaaatcacataatcatatcatcctcacctttcagacctctatatgttgaagaatcctaggactcagtctctttttacaccttattccgttatgactc

SEQ ID NO: 24685 - DNA, 291 bp, Homo sapiens
  HUMUT5960
  Located on chromosome 20
  Distance between a terminus base of telomere on chromosomal short arm and 5'-terminus of this base sequence : 36542877
  Distance between 3'-terminus of neighbour sequence of sequence listing upward to telomere on chrosomal short arm and 5'-terminus of this base sequence : 81157
ccggagttctgtgattccaacgaatttatgtttcaaagttgtagttttatcagctgcacaaggacttaaatctttttttcaattcaacagatgtttccccttccttcctccctccctccctccttccttccttctttccttctttccttccttccctcccttctttccttccttccttccttccatccttccttccttcctctgcctttctttctctcttctcttctttcttcttactctgtcatccaggctgcagtggcacggtcatagctcactgtaaccttgaactca

SEQ ID NO: 24686 - DNA, 381 bp, Homo sapiens
  AL031651.33_145113
  Located on chromosome 20
  Distance between a terminus base of telomere on chromosomal short arm and 5'-terminus of this base sequence : 36679490
  Distance between 3'-terminus of neighbour sequence of sequence listing upward to telomere on chrosomal short arm and 5'-terminus of this base sequence : 136322
gtacagtaagcactggcttcttttcctctttggggcctcggtgtctgcacaggaccaggcacaaacaggtgcttcataaattttatggcagaagaaacaaaatgtccctctctgaatcacaatttttcttttccttttcttgtcttctctttattattattattattattattattattatttttgagacagagtcttgctctgttgcccaggctggagtgcagtgttccgatctctgcttgctgcagcctccgccttctgggttgaagcgattctcctgcctcagcccgagtagctggaattacagggatgagccaccgtgcttggcctttttgtttgtttgtttgtttgtttgtttttaaagacaagatcttgctctgt

SEQ ID NO: 24687 - DNA, 204 bp, Homo sapiens
  AL031651.33_156252
  Located on chromosome 20
  Distance between a terminus base of telomere on chromosomal short arm and 5'-terminus of this base sequence : 36690743
  Distance between 3'-terminus of neighbour sequence of sequence listing upward to telomere on chrosomal short arm and 5'-terminus of this base sequence : 10872
atactggcacaaacgcatccctgccaccaccaccaccacacacacacacacacacacacacacacacacattctcccagaatgtctcaacttttttcaaggttccagctccaaaagtcccttcctcttccctctccccagccaattcccatggaagcaccctgggtttcaatgtgtatatctgactttccatagctgagtctaa

SEQ ID NO: 24688 - DNA, 311 bp, Homo sapiens
  DISO7_00049029
  Located on chromosome 20
  Distance between a terminus base of telomere on chromosomal short arm and 5'-terminus of this base sequence : 36823647
  Distance between 3'-terminus of neighbour sequence of sequence listing upward to telomere on chrosomal short arm and 5'-terminus of this base sequence : 132700
gtccaccgaaccatttctctttccacctggacacatggttgaactacatttcccagcaccccttgcaattaattgtggcccatgtgactgagttctgacaaatccataaacaccacctgtatgatcccccactacatctttctctctctctgtctctgtctctgtctctctctctctctctctctctctcaatctctctctctctcgtcccccctcagccagctggatgtcgatatattgacacccaaggtgacttgggataaatgtgttgaagatggcagagcctccagcagcagtctaggtccctgaat

SEQ ID NO: 24689 - DNA, 314 bp, Homo sapiens
  AL049868.20_66445
  Located on chromosome 20
  Distance between a terminus base of telomere on chromosomal short arm and 5'-terminus of this base sequence : 36941216
  Distance between 3'-terminus of neighbour sequence of sequence listing upward to telomere on chrosomal short arm and 5'-terminus of this base sequence : 117258
ctttgatcagatagtcacctatgatttcttccaatgttgtttcctttgtaatagtaagttcttttatatacctcaggatctgtctttatatgtatataaacacacacacgcacatacacacacacacacacacacacacacacacacacagacacacgcatgcatgtaatttgcagagatggggtcttcctacgttgcccaggcggtctcaaactcctggacttaagcaatccacccacttcagcctcccaaagtgctagggttacaagcatcgagccaccgcacccagcctggaatttgtctttagttcacat

SEQ ID NO: 24690 - DNA, 256 bp, Homo sapiens
  D20S478
  Located on chromosome 20
  Distance between a terminus base of telomere on chromosomal short arm and 5'-terminus of this base sequence : 37034584
  Distance between 3'-terminus of neighbour sequence of sequence listing upward to telomere on chrosomal short arm and 5'-terminus of this base sequence : 93054
ccaaagacaagtttgtttatctgtctatctatctatctatctatctatctatctatctatctatctatctatctatctattctatatctaatctatccatctatctatctattctgtatctaatctatctatccatctatctattcatctatctatgtttcctattgctgctataacaaatcacataagcttatctatcatctctctctctgtctctctctctcatttatattagttttctattgctgctataaca

SEQ ID NO: 24691 - DNA, 261 bp, Homo sapiens
  AL121889.8_8382
  Located on chromosome 20
  Distance between a terminus base of telomere on chromosomal short arm and 5'-terminus of this base sequence : 37338343
  Distance between 3'-terminus of neighbour sequence of sequence listing upward to telomere on chrosomal short arm and 5'-terminus of this base sequence : 303503
atagattgatggattggtgtctagatagatagatggattaattaatggatggtagatgaatggacggatggacagattaatggatagatggataaatggatgaatggatggttgaggtggtagatgggtagatattatgaggtctggttgaatggatgggtgggtgggtggatggatggatggatggatggatggatggatggatagacagaaaaataagtggatgagtgggtaaaggatgaatctatgaatacatggctc

SEQ ID NO: 24692 - DNA, 347 bp, Homo sapiens
  AL136990.15_19805
  Located on chromosome 20
  Distance between a terminus base of telomere on chromosomal short arm and 5'-terminus of this base sequence : 37527596
  Distance between 3'-terminus of neighbour sequence of sequence listing upward to telomere on chrosomal short arm and 5'-terminus of this base sequence : 188992
attaaatgccgaatcatgtattagaaatgagatgtatttactattgtttttgaaaattaatggtgcatttttagcttttataatgtaatttaatgatgcaattcatctaataaaaaagaacacatttcaactcagtcatacagacctactggggcacagggcggaacaccttttccatggaaagggtttggaatgaaatgcttggggcctttctctttttctgtaaggcaaaaaaggaaaagtggtctgtctgtgtctgtctctctgtctctctgtctctctctctctctgtgtgtgtgtgtgtgtgtgtgtgtgtgtgtgtgtgtgttgccatttggagtatcagt

SEQ ID NO: 24693 - DNA, 167 bp, Homo sapiens
  D20S908
  Located on chromosome 20
  Distance between a terminus base of telomere on chromosomal short arm and 5'-terminus of this base sequence : 37616510
  Distance between 3'-terminus of neighbour sequence of sequence listing upward to telomere on chrosomal short arm and 5'-terminus of this base sequence : 88567
agctacctggaaaacatgagagaatcaataggaaaattttggaagtgataaaatttaaagcatttggttgtaaatgcacacacacacacacacacacacacacacaaattctcaatatgtcaacagtaagtgattttaaaaatttctttacagcaataggttcattt

SEQ ID NO: 24694 - DNA, 243 bp, Homo sapiens
  AL031661.28_6859
  Located on chromosome 20
  Distance between a terminus base of telomere on chromosomal short arm and 5'-terminus of this base sequence : 37786086
  Distance between 3'-terminus of neighbour sequence of sequence listing upward to telomere on chrosomal short arm and 5'-terminus of this base sequence : 169409
ggaatcaacctaagtgtccatcaatggatgataaaaaatgaaaatgtgcagggtatgcgcacacacacacacacacacacacacacacacacactcatatacacgatgaaatattcagctttaaaaagaaaatatttgtgacaatatggatctggaaggcattatgctaagtgaaagaagctagccacagaaagaaatattgcatgatctcacttacatgtggactttacaaatgtcaaactc

SEQ ID NO: 24695 - DNA, 384 bp, Homo sapiens
  AL031661.28_49736
  Located on chromosome 20
  Distance between a terminus base of telomere on chromosomal short arm and 5'-terminus of this base sequence : 37828789
  Distance between 3'-terminus of neighbour sequence of sequence listing upward to telomere on chrosomal short arm and 5'-terminus of this base sequence : 42460
gatatgagtgcaagaacttgagacagactgcctgggttcatattcctggtctgtcaattactggggtgtgtgattttaggaaaatttcttaccattttgtgccttagtttcctcatctaaaaaattaggataatactggtgcctatcttataaggttgtagggggactaaataggtcaatactgttcaagtaaaaaatctaaaacaatacctggcgctattgtatattattttatcatcatcatcatcatcatcatcatcatcatcaattatcttcctcctcctcatcatcattttattggactaaatactctgcttttggcttcctactttatgattaattttgtatgtcaatttgactgggtaaagtgatggctagatagcc

SEQ ID NO: 24696 - DNA, 318 bp, Homo sapiens
  AL031661.28_77379
  Located on chromosome 20
  Distance between a terminus base of telomere on chromosomal short arm and 5'-terminus of this base sequence : 37856406
  Distance between 3'-terminus of neighbour sequence of sequence listing upward to telomere on chrosomal short arm and 5'-terminus of this base sequence : 27233
tttgcatatgactcatatgctaagagcttcgtaccaaaatgttaagtgtaacatatttgaactacactgtgatatttcatcaagagttgccaaactatagcatggaatatacaaaaatgttcacttcaagttattaaaaaatttgtcctttattacttaacgtaaagttggagtccattataggaatcatctctatcatcaccattgtacccatcatcatcctggtgatccccacggatcatcagcagcagcatctctgtcatcatcatcatcatcatcatcatcatcatcacaacagataacattgctagaccagtg

SEQ ID NO: 24697 - DNA, 164 bp, Homo sapiens
  G08045
  Located on chromosome 20
  Distance between a terminus base of telomere on chromosomal short arm and 5'-terminus of this base sequence : 38093529
  Distance between 3'-terminus of neighbour sequence of sequence listing upward to telomere on chrosomal short arm and 5'-terminus of this base sequence : 236805
tccattattcccctcaaacaagtgtctatctatttgtctatcatctatctatctatctatctatctatctatctatctatctatctatcttctatcatctatctatctacctattgatctatcatcttatctatcatctatctatctcaactgaatggcaaacc

SEQ ID NO: 24698 - DNA, 364 bp, Homo sapiens
  AL133419.15_25315
  Located on chromosome 20
  Distance between a terminus base of telomere on chromosomal short arm and 5'-terminus of this base sequence : 38375693
  Distance between 3'-terminus of neighbour sequence of sequence listing upward to telomere on chrosomal short arm and 5'-terminus of this base sequence : 282000
tgtttatactcgccattcctagccaagactttctccaatccctggtgataaacttgggggtaaacaccttaacggcattataattacgtgtgtgtgtgtgtgtgtgtgtgtgtgtgtgtgtgtaattacttcaagtttgttggtataagcagtgcatttgtgtgtatatgtgtatttaactatcaaagcatttatcacattctgttttgatgtttaagttacccacctgtctcccctgctagactgcaacctctgtaagggtagggctgatgaacactatgtgtgttaaataattaaatcccttttaaattcgtgtatgtatcaaaaacatatttaatacatacttactaggcaccaaatacca

SEQ ID NO: 24699 - DNA, 402 bp, Homo sapiens
  AL133419.15_76559
  Located on chromosome 20
  Distance between a terminus base of telomere on chromosomal short arm and 5'-terminus of this base sequence : 38426756
  Distance between 3'-terminus of neighbour sequence of sequence listing upward to telomere on chrosomal short arm and 5'-terminus of this base sequence : 50699
tttatgacctcatggagcttacattacagaagcagacataaacaaaacataagaaaaacaactagatatacatgaaattgacaaattctggtatttggagagatttctatttttagaactataaatctcaagaagttctgagagaccctcctgctataaaatgaacagtctatgaaggcaaatattttagagaaaatgctgattccacaattattaggaaagatgccagaggcaccccccagtttccctcccctacacacagacacagacacacacacacacacacacacacacacacacacacacacacacagcaaacaaacaagaaataaaggaaccaacaacaaatatgagttggtcctagaacagctttgaaatgaggaatctaaaggtaccagaatc

SEQ ID NO: 24700 - DNA, 186 bp, Homo sapiens
  AL009050.9_90617
  Located on chromosome 20
  Distance between a terminus base of telomere on chromosomal short arm and 5'-terminus of this base sequence : 38565979
  Distance between 3'-terminus of neighbour sequence of sequence listing upward to telomere on chrosomal short arm and 5'-terminus of this base sequence : 138821
atccatgaattaacacctatcctgaattttgtgtttaacatacccatgctggctggcatatgtgtgtgtgtgtgtgtgtgtgtgtgtgtgtgtgtgtatatatatatatatatatatatataaaataggtatacaccacaggcaggcacataggtataccagaggtatccataggtatacaagcat

SEQ ID NO: 24701 - DNA, 347 bp, Homo sapiens
  AL009050.9_101898
  Located on chromosome 20
  Distance between a terminus base of telomere on chromosomal short arm and 5'-terminus of this base sequence : 38577140
  Distance between 3'-terminus of neighbour sequence of sequence listing upward to telomere on chrosomal short arm and 5'-terminus of this base sequence : 10975
aaatttctgaatcatatggtaattctatttttaattgtttgaggaaccactgtatggtttttccatagcagctgcacaattttacattcctaccaacagtgcaaatgggttccagtttctccacattttctccaacatttgttattctcctcctcctcctccctcctcctcctcctcctgctcctcctcctcctcctcctcctcctctgctgactgatcagggtgatggttgctgaaggttggagtgagtgtggcaattcctgaaaacaatgaaatttgctacatgaattgactcttcctttcatggaagatttcttggtaacatgtgacactgtttggtaacattt

SEQ ID NO: 24702 - DNA, 227 bp, Homo sapiens
  AL009050.9_103650
  Located on chromosome 20
  Distance between a terminus base of telomere on chromosomal short arm and 5'-terminus of this base sequence : 38578915
  Distance between 3'-terminus of neighbour sequence of sequence listing upward to telomere on chrosomal short arm and 5'-terminus of this base sequence : 1428
acaggacttctgcacttaacagttaaatcatttctagcttttgatttaaaatgagagatccttcctttcacttgaacacttagaggccatttagggctatcaattgacctaatttcaatattattatgcctcaaggaataggaaggcctaaagaaaggagagagagagagagagagagagagagagagatggggcaatggtcagttagtggagcagtcagaatacac

SEQ ID NO: 24703 - DNA, 274 bp, Homo sapiens
  AL009050.9_120238
  Located on chromosome 20
  Distance between a terminus base of telomere on chromosomal short arm and 5'-terminus of this base sequence : 38595505
  Distance between 3'-terminus of neighbour sequence of sequence listing upward to telomere on chrosomal short arm and 5'-terminus of this base sequence : 16363
aatgtttcaagaccaagtgataagatgtctaaacaagcttgtctttggatgcttgctctggttagttctgaggaaatacctacaacaaaatagcaaaggatttttctctcctctagtcccaggtgggtaattttctctccccaccccttctctcagtgtgtgtgtgtgtgtgtgtgtgtgtgtgtgtgtgtgtgtgtctccctgcccctcaatgggaacacagtcagattttgctatacttcagaatcatgaaacctcttgaaatagccatagt

SEQ ID NO: 24704 - DNA, 202 bp, Homo sapiens
  G08059
  Located on chromosome 20
  Distance between a terminus base of telomere on chromosomal short arm and 5'-terminus of this base sequence : 38599405
  Distance between 3'-terminus of neighbour sequence of sequence listing upward to telomere on chrosomal short arm and 5'-terminus of this base sequence : 3626
attgacaaatttctgggctggcggggggaacaattcgatccatgatagatagatagatagatagatagatagatagatagatagatagatagatagatagatacatagatacatagataactaatccttatttggctagctaggatggatgtcctcctacaaaatttgctccatgacattaactctgttgcctggacatttt

SEQ ID NO: 24705 - DNA, 395 bp, Homo sapiens
  AL031256.1_22529
  Located on chromosome 20
  Distance between a terminus base of telomere on chromosomal short arm and 5'-terminus of this base sequence : 38684934
  Distance between 3'-terminus of neighbour sequence of sequence listing upward to telomere on chrosomal short arm and 5'-terminus of this base sequence : 85327
tgaatggaggactattcactaaatatgaactagaaccattaagtaaaggtgagaaaataagctaaacctcattaataatccaagaaaactctccctgtggtgaaagccaaaactgagcatctgcttgtcaacaagctagattttgttagaaccatctgagttactactcaaataactttcagacaatggcaaattcctcaactccaaatcctgtttttcttctaataagaatagttgtaagtcataactcctcaagtgtgtgtgtgtgtgtgtgtgtgtgtgtgtgtgtgtgtgtgtgtgtgacgaggcgaggccctaaataggcacccagacacatgggaacctttatttcttgacctttgtctctcccagggtagcctctaacaagatggctt

SEQ ID NO: 24706 - DNA, 352 bp, Homo sapiens
  AL031256.1_113851
  Located on chromosome 20
  Distance between a terminus base of telomere on chromosomal short arm and 5'-terminus of this base sequence : 38776285
  Distance between 3'-terminus of neighbour sequence of sequence listing upward to telomere on chrosomal short arm and 5'-terminus of this base sequence : 90956
ctatggccttgagtgaacataggcagtaaccaggtcgtggttacagtggactttgggtgagacctggtgctgtgttggcttcaagtctgacctaacacagcccccgttgtggtggctacaggggcatgggtattactggctattattgggtattattcatagcagccaagacatggaatcaatgttaagtgtccattgatggatgaatgggtaaagaagatgtaatacacacacacacacacacacacacacacacacacacaatgagataccattcagcctttaaaaagaaagaaattttgtcatttcagacaacagaggaaacatggataagcctgaaggacattagatt

SEQ ID NO: 24707 - DNA, 343 bp, Homo sapiens
  AL049691.17_153575
  Located on chromosome 20
  Distance between a terminus base of telomere on chromosomal short arm and 5'-terminus of this base sequence : 38817989
  Distance between 3'-terminus of neighbour sequence of sequence listing upward to telomere on chrosomal short arm and 5'-terminus of this base sequence : 41352
ggttgtctgagtcattaaccagagagagaggaagagagagagagagagagagagagagagagagagagattagggtttaaacagactatgtaattttaatatctttagatgacaagattgagcgcttttcaccaaaagaggtcctgcgaattagaagcaagagatagaaaataaagatagttgcattcacttaatgaaatgagttacttaaaaaccaccttaagatattagagaagttggtaaaatagggagctctttgatggcattatggagagggaaccttaaagtatttggatacttaacctgacaaaacgtatcttcctttaggttcactgatgagcag

SEQ ID NO: 24708 - DNA, 380 bp, Homo sapiens
  AL049691.17_115534
  Located on chromosome 20
  Distance between a terminus base of telomere on chromosomal short arm and 5'-terminus of this base sequence : 38856013
  Distance between 3'-terminus of neighbour sequence of sequence listing upward to telomere on chrosomal short arm and 5'-terminus of this base sequence : 37681
cctaacatatgaccttgaacatagcgaacagcaagtaagtgtttgttgtgatgatgatgatgatgatgatgatgatgatgatgatgttgaagaggaggagaaggaggaggggaaggacaaggaggaggagaaggatggagatggaagaggagaacaaggagaagaaggaaaaaaggaggaagaggaggcaaggaagatgatgctattcccagaagcaattcacaggtccctccacctggaagtgagtccatataaactttgaaaattcctatgaagtattctgtccatctcctgtggtccaagcaatgccaaaggcccatatggatcagaatccatgaggatagacatggagaccaaagtcacatgaagttgaacaagtc

SEQ ID NO: 24709 - DNA, 352 bp, Homo sapiens
  AL049691.17_54948
  Located on chromosome 20
  Distance between a terminus base of telomere on chromosomal short arm and 5'-terminus of this base sequence : 38916506
  Distance between 3'-terminus of neighbour sequence of sequence listing upward to telomere on chrosomal short arm and 5'-terminus of this base sequence : 60113
tggttaagctaccagatcagagatataagaaccacacactttgggaggccaaggtgggaggatcgcttgaggctcggagttcgagaccagcctgggcaacgtagtgagaccctgtctctacaaaaataatttaaacacacacacacacacacacacacacacacacacacacacacacacacacaaaagagagaatggaataatggaattctaaagataagaagtcactatcagaggtgatgatgagaatgcaagtcctcaaggatccacacaactcattaggaagatgtggactttccacaggacatgggatggcagttaaaatccgcactgtctaactcaaaagtggcag

SEQ ID NO: 24710 - DNA, 333 bp, Homo sapiens
  AL034552.23_11543
  Located on chromosome 20
  Distance between a terminus base of telomere on chromosomal short arm and 5'-terminus of this base sequence : 38982917
  Distance between 3'-terminus of neighbour sequence of sequence listing upward to telomere on chrosomal short arm and 5'-terminus of this base sequence : 66059
cagcacctcagaaggtagatactcccaggaggcaatgcgcctctccccaaaagtggcatagaaacctctttctccttctatatcccaactcaaaagctcactaacaagggctaagggcctctagcttaaaggcaaagaggacatttgaaaagactttgctcctcgtgtgtgtgtgtgtgtgtgtgtgtgtgtgtgtgtgtgtgtacatgtcaaggtgtacctgtgtgtttgtgcatattcaaaaaaatgggaggaggaagaagtagagggtggatgacagaaaaaaagtgtgtaacccagttaatgtaggtctagaatccaacagtggtcagt

SEQ ID NO: 24711 - DNA, 482 bp, Homo sapiens
  AL034552.23_42777
  Located on chromosome 20
  Distance between a terminus base of telomere on chromosomal short arm and 5'-terminus of this base sequence : 39014081
  Distance between 3'-terminus of neighbour sequence of sequence listing upward to telomere on chrosomal short arm and 5'-terminus of this base sequence : 30831
acgaacatagcgtgtaactgactcccaatcccttctagatggatgacacatttactgtctctctttgggaattttatgttgcatcctggattccttagaaattggcggagagaggtgggaagcaaggataggtaaaacaaacggggtttgccattgtcaatatgccaaagagaagagacctggtaagatctaagggatgttcccagacactcactttaatcatcattcctatgaacacacacacacacacacacacacacacacacacacacactattgctatgagaaagaagcaaatcattcagaccactaaagcaaatggtcctgaattacctatcagccagctgatatagtggcagttttcaccacataccaggcaccctgctaggtgctgagaatgcaacagagaacgggcctctaggcccagagcctgtgcccatggactacagagtggtgggggctgtaactttgaacaggctcac

SEQ ID NO: 24712 - DNA, 447 bp, Homo sapiens
  chr20.fa.O7frz.40618075
  Located on chromosome 20
  Distance between a terminus base of telomere on chromosomal short arm and 5'-terminus of this base sequence : 39129353
  Distance between 3'-terminus of neighbour sequence of sequence listing upward to telomere on chrosomal short arm and 5'-terminus of this base sequence : 114790
gatctaacattatgcaattcaaagcacgaggaaatgaaaacaaaattggtccaaagcaaaacttaaggttggtacaggtcccagtagtgctcagtttttcagggtttggggttgtttgtttgtttgtttgtttgtttttgactgagcatctactatgcccaaggacttcctcagggctgagtgctcatcctcttctgatggaaacagatctttttcactacattatggccaatgcaacaagagagcatgctcggggactgtgcacactcaggaacacacacccacatttgagggcaggacacaaaaagagactgggcacttcttcaccagagtccttgaaggcctgcacccccccacctatagacacctctgtgacctgctgctggggctccattctacctcttctaccacccacctgttggactcttctccaagaccttctatgtc

SEQ ID NO: 24713 - DNA, 389 bp, Homo sapiens
  chr20.fa.O7frz.40826810
  Located on chromosome 20
  Distance between a terminus base of telomere on chromosomal short arm and 5'-terminus of this base sequence : 39338011
  Distance between 3'-terminus of neighbour sequence of sequence listing upward to telomere on chrosomal short arm and 5'-terminus of this base sequence : 208211
gactgagtgaaagagcaagaccctgtttcaaaaaaaatcaagaaaaaaatgataaggttggttggctcatttagaattgggtacacacaagtaagtggaaggaacaaatgatcctggatccctggggtatgcaacattcatgtgtcctgtttctctctctccctctctttctttgtccccctccccatacacacacacacacacacacacacacacacaccagcctgccctgctgaagtatggatttggaggagcagtgttgaggtttgagcaagggagcatccaacagataaagatgcccggggccaatcacacacaactctactggactggagagacctagaaaaatacacagtcttggccactgctgtagtttgatcactagcctg

SEQ ID NO: 24714 - DNA, 113 bp, Homo sapiens
  D20S855
  Located on chromosome 20
  Distance between a terminus base of telomere on chromosomal short arm and 5'-terminus of this base sequence : 39451148
  Distance between 3'-terminus of neighbour sequence of sequence listing upward to telomere on chrosomal short arm and 5'-terminus of this base sequence : 112748
agcttagtacctggcttatagttgattgtgtgtgtgtgtgtgtgtgtgtgtgtgtgtgtgtgtgtgtgtgtgatgcagggaagccaaagaagggtcaggatgcaatgataacc

SEQ ID NO: 24715 - DNA, 240 bp, Homo sapiens
  chr20.fa.O7frz.41246093
  Located on chromosome 20
  Distance between a terminus base of telomere on chromosomal short arm and 5'-terminus of this base sequence : 39757391
  Distance between 3'-terminus of neighbour sequence of sequence listing upward to telomere on chrosomal short arm and 5'-terminus of this base sequence : 306130
gatttgccatgcacataacaaaagttttatatccaaaatatacaaaaactactatatagaccaatagaaaaatgggcaaaaataggctcttcacacacacacacacacacacacacacacagacacaaatccaaacagccaataaacatgtagcaagtgcttagcctcattaatgatgaaaatgaaatacagcgaacaactactacagatccaggtggctaaacattccaagtctgacag

SEQ ID NO: 24716 - DNA, 266 bp, Homo sapiens
  Z67317
  Located on chromosome 20
  Distance between a terminus base of telomere on chromosomal short arm and 5'-terminus of this base sequence : 40080515
  Distance between 3'-terminus of neighbour sequence of sequence listing upward to telomere on chrosomal short arm and 5'-terminus of this base sequence : 322884
tcttgggcaattctagttcaaagaggagacttccattcagatttgtgttcagtaggcacatgtctgaatcttaaggtggtggtggaggagggagacagagaggggagacacacacacacacacacacacagagagagacagagagagagagagagagagaaaggggagggatataataaattctgaaatttgaaaaatgaaaacatgctataagtgggaaaattggaagagttgccacactagatacttggtcaagccctgccttc

SEQ ID NO: 24717 - DNA, 405 bp, Homo sapiens
  AL133229.40_1741
  Located on chromosome 20
  Distance between a terminus base of telomere on chromosomal short arm and 5'-terminus of this base sequence : 40081914
  Distance between 3'-terminus of neighbour sequence of sequence listing upward to telomere on chrosomal short arm and 5'-terminus of this base sequence : 1133
cacctgcttgataatttacttaaggtacatattgtatttacatgatatagaccagagtagggaaactggtcatacctgtttggggctggaaagagcagcagctcatctgaaattttcatcttggcagacccactgcctttgctataggtgctggcacatagtaaatactgtataataataataataataataataataataataataataataatagttaactctcatggaatgctttaaggtatggagagtttctataacttacccacagttaaacagctattcatgtactaaagccagcatctgaacccaggctggatctggatgttttagtactggttgttcttcagcataaagacccctgcttcaagatggcagattgaacaagtgcaattgattactaac

SEQ ID NO: 24718 - DNA, 391 bp, Homo sapiens
  AL133229.40_64178
  Located on chromosome 20
  Distance between a terminus base of telomere on chromosomal short arm and 5'-terminus of this base sequence : 40144414
  Distance between 3'-terminus of neighbour sequence of sequence listing upward to telomere on chrosomal short arm and 5'-terminus of this base sequence : 62095
ccatagcattcaagtataccattcttcctcttgctgtctgcactgctgctacactgtctttctgtttcttaaaccccaaacaattcctctcccttccttcttcccaagacacacacacacacacacacacacacacacacacacacacacacactgattcccttcacgtgtgttcttccttcatgtctttgctcatcagtcccttcactcatggaagccccctcttatacactcttagaatactctattttttactctgagctcttattacagataatatttctacagttgttcaacatttcattcagatctgcctttcctacttccaagctccaaaggacaatgatcacatctgtcttcttcctctgggtagccttatcacgtagcacag

SEQ ID NO: 24719 - DNA, 257 bp, Homo sapiens
  AL031654.6_8922
  Located on chromosome 20
  Distance between a terminus base of telomere on chromosomal short arm and 5'-terminus of this base sequence : 40312862
  Distance between 3'-terminus of neighbour sequence of sequence listing upward to telomere on chrosomal short arm and 5'-terminus of this base sequence : 168057
gttggctcagtctataggcattaagtgtaactctgtggccttgggacagtcaagtgctcatgtccaaagatgtaccctttgattttttgtccatccatccatccatccatccatccatccctccatccctgaatccctacatccctccatccattcctctatgcatccatccatccatccatccatcttctcaaccattcatcctctcattaatctgtttaaccattatccatccctgaacatttattgagctcctg

SEQ ID NO: 24720 - DNA, 169 bp, Homo sapiens
  AL024473.1_84791
  Located on chromosome 20
  Distance between a terminus base of telomere on chromosomal short arm and 5'-terminus of this base sequence : 40600896
  Distance between 3'-terminus of neighbour sequence of sequence listing upward to telomere on chrosomal short arm and 5'-terminus of this base sequence : 287777
aggaaagtgatagcctggataccgtgaaaagtacaattttcaaacacacacacacacacacacacacacacacacacacacacacacacacaacagtcagtattgactgttgacccaagagccatcccctgtcttgttattttctggctaagttcaccgtatgacttgg

SEQ ID NO: 24721 - DNA, 268 bp, Homo sapiens
  AL024473.1_97955
  Located on chromosome 20
  Distance between a terminus base of telomere on chromosomal short arm and 5'-terminus of this base sequence : 40614077
  Distance between 3'-terminus of neighbour sequence of sequence listing upward to telomere on chrosomal short arm and 5'-terminus of this base sequence : 13012
agtgactgttaatcctacaagcaggggtgtgtgtgtgtgtgtgtgtgtgtgtgtgtgtgtgtgtaatcagatttccatgtgcaccagcattttgtgctgtcactttccttgaagtctgatataggcagaaacaatacttacttaaagctttatccactcccactctccaaaacttttacctcactatcaccaagatgatctttctaaaaccgactcaatccttcctttctacttcttaaaatctatgttagctccttgcagaaacata

SEQ ID NO: 24722 - DNA, 184 bp, Homo sapiens
  D20S108
  Located on chromosome 20
  Distance between a terminus base of telomere on chromosomal short arm and 5'-terminus of this base sequence : 40633012
  Distance between 3'-terminus of neighbour sequence of sequence listing upward to telomere on chrosomal short arm and 5'-terminus of this base sequence : 18667
caacaagtcagaagtggcaagtgatctttttgacagacttcatacagaatgcactctggaagcagagagcacagtagagaaaggtggaaaggggaactggatccaggaatcccaaccaagaagagaaaagttgcgtgtgtgtgtgtgtgtgtgtgtgtgtgtatgtatgtgtggacagtgtctt

SEQ ID NO: 24723 - DNA, 284 bp, Homo sapiens
  Z93942.1_84593
  Located on chromosome 20
  Distance between a terminus base of telomere on chromosomal short arm and 5'-terminus of this base sequence : 40758086
  Distance between 3'-terminus of neighbour sequence of sequence listing upward to telomere on chrosomal short arm and 5'-terminus of this base sequence : 124890
ccataatttgacaattccagtaagatttgttttgttcaaatgggaaatatggttaagaacttaaaaaaaaaaaaacaacaaaggaatgaggctgaaaaaccactactggatattaagttatattatgaagttacaatgattaaaccatgggtactagagtatgagttaaataaaaatggactaggtaggggtgtgtgtgtgtgtgtgtgtgtgtgtgtgtgtatgacagagagagagaaacatataattttatgtataaaattacacgcaacataaattaatga

SEQ ID NO: 24724 - DNA, 372 bp, Homo sapiens
  AL022239.1_59992
  Located on chromosome 20
  Distance between a terminus base of telomere on chromosomal short arm and 5'-terminus of this base sequence : 40877485
  Distance between 3'-terminus of neighbour sequence of sequence listing upward to telomere on chrosomal short arm and 5'-terminus of this base sequence : 119115
ttattcaatttgaaggatggacttttattctgaaattatatcctttctatatttttggaattatgtcttttataaaacgatgtaaataaaagatgttgaagtaccctaggttagtcccccaagcctttttaaatgctactggcctgtgaattccaaaagtcttgaacatctggcacacagcgtcttttacataacagtatcaagtaacttaacttcctaaatcatgggtcctttccttctgctttacaaagaaaagtttgccaggcacaacacatctttatttcatgtaaatgtgtgtgtgtgtgtgtgtgtgtgtgtgtgtgtgtgtgtgtgagagagagagagagattgtggtttctgctttacaaagaa

SEQ ID NO: 24725 - DNA, 450 bp, Homo sapiens
  AL109826.25_216
  Located on chromosome 20
  Distance between a terminus base of telomere on chromosomal short arm and 5'-terminus of this base sequence : 40951903
  Distance between 3'-terminus of neighbour sequence of sequence listing upward to telomere on chrosomal short arm and 5'-terminus of this base sequence : 74046
gtatttagaaaccaagatctgcatgctagttgtgttcattgttactaggatatcattctttccagggcttgtcagcagacagagcttggaaagacatatatatatatatatatatgtatgtatgggtgtgtgtgtagatagatagatagatagatagatagatagatagatagatagatagtaactcatgcctaaacacaaacccatatctatttatctatctacctatcatctatctatccgtccacccaccaacctacatacatatgtgactatctgtctgtctgtctatctatctatcatctacctatctaatccatccatccatccatccacccacccacctacctatatacatacatacatatctctctctatgtgtatctacctatctaacctacctagtgacctacctacctacctacctactcacctgtctatccattctga

SEQ ID NO: 24726 - DNA, 278 bp, Homo sapiens
  HUMUT1688
  Located on chromosome 20
  Distance between a terminus base of telomere on chromosomal short arm and 5'-terminus of this base sequence : 40951951
  Distance between 3'-terminus of neighbour sequence of sequence listing upward to telomere on chrosomal short arm and 5'-terminus of this base sequence : -402
gatatcattctttccagggcttgtcagcagacagagcttggaaagacatatatatatatatatatatgtatgtatgggtgtgtgtgtagatagatagatagatagatagatagatagatagatagatagatagtaactcatgcctaaacacaaacccatatctatttatctatctacctatcatctatctatccgtccacccaccaacctacatacatatgtgactatctgtctgtctgtctatctatctatcatctacctatctaatccatccatcc

SEQ ID NO: 24727 - DNA, 382 bp, Homo sapiens
  AL035666.7_6444
  Located on chromosome 20
  Distance between a terminus base of telomere on chromosomal short arm and 5'-terminus of this base sequence : 41008985
  Distance between 3'-terminus of neighbour sequence of sequence listing upward to telomere on chrosomal short arm and 5'-terminus of this base sequence : 56756
gaagcagtctaaccaaacaagagaaaaaccttcagacctgagcaaggctgtgtgtgtgtgtgtgtgtgtgtgtgtgtgtacaggcatacccagtctaaccaaacaagagaaaaaccttcagacctgagcgaggctgtgtgtgtgtgtgtgtgtgtgtgtgtgtgtgtgtgtgtgtgtgtgtaggcatacccacatgtgtgtgaattcccattaggaggtgggacgctagcaaactggaaggcagagcccatctgaccctgagatcctcacactcatgcaaccttaatgccaagacaaactgaatggttgattgtgtcaactctcttgttttagggatgggaaaacaggcccagagtgggaaaaggagttacctcgagtcaac

SEQ ID NO: 24728 - DNA, 344 bp, Homo sapiens
  AL031656.10_87466
  Located on chromosome 20
  Distance between a terminus base of telomere on chromosomal short arm and 5'-terminus of this base sequence : 41137259
  Distance between 3'-terminus of neighbour sequence of sequence listing upward to telomere on chrosomal short arm and 5'-terminus of this base sequence : 127892
cagctagatgcactcttaggagattaggaggagggagactccaggtcatgtatgtctgtctgtctgtgtctgtctgtctctctttgtctctctttatctctctctctctctctgtttgtgtgtgtgtgtgtgtgtgtgtgtgtgtgtgtgtgtgtatgtgtgtgtgtgtctatctgtctctctccccactaaccctctcttctttaggcagatgttcttgtagcatctcaggccaatgctggacttcccaccatagcttctgtttgttgttaatctctgaattggctcatctttgcaaccaattccctacattaaattccttctgtttgaaacatctggagttt

SEQ ID NO: 24729 - DNA, 289 bp, Homo sapiens
  AL031656.10_98468
  Located on chromosome 20
  Distance between a terminus base of telomere on chromosomal short arm and 5'-terminus of this base sequence : 41148308
  Distance between 3'-terminus of neighbour sequence of sequence listing upward to telomere on chrosomal short arm and 5'-terminus of this base sequence : 10705
ccaacatggcacatgtatacatatgtaactaacctgcacgttgtgcacatgtaccctaaaacttaaagtataataataataataataataataataataataaaagcagaggtgtaggtcttacatggatttcaagacttgtcataaagctataacaattaagacaacaagacatcaaaataatgataaaaaatagatctacagaaaaaaaagaacaacagcagaagatccaaaataaacccttacatatgcagacacctgatatattataaaggttcaactgaaatca

SEQ ID NO: 24730 - DNA, 291 bp, Homo sapiens
  AL031656.10_106296
  Located on chromosome 20
  Distance between a terminus base of telomere on chromosomal short arm and 5'-terminus of this base sequence : 41156171
  Distance between 3'-terminus of neighbour sequence of sequence listing upward to telomere on chrosomal short arm and 5'-terminus of this base sequence : 7574
catagattcttgacagcaggatgtggacatcttttgtgtgtgtgtgtgtgtgtgtgtgtgtgtgtgtttgagactgagttttgctcttttcgcccaggctggagttcaatggaatgatctcggctcactgtagcctccacctccctggttcaagcaattctcctgcctcagcctcctgagtagcagggatcacaggcacacaccaccacgcccggctaattttgtatttttagtagagacggggtttcaccatgttggccaggctggtcttgaactcctaggtgacagagt

SEQ ID NO: 24731 - DNA, 262 bp, Homo sapiens
  AL121763.24_62597
  Located on chromosome 20
  Distance between a terminus base of telomere on chromosomal short arm and 5'-terminus of this base sequence : 41272741
  Distance between 3'-terminus of neighbour sequence of sequence listing upward to telomere on chrosomal short arm and 5'-terminus of this base sequence : 116279
aggctacagatagcttcataacagtttgcgtcaggtttgacagccaaatgaatttagtgttaaatacacacacacacacacacacacacacacacacacacacacacacacacataatctctctctccattttcataacttcttgaatttctggactatatgtacgagaatgtcaacctaagtctagttcacaagtttgtggtaactattacaagagatatatcacacatgtgggtatcttgcagaatagctagtttgaagt

SEQ ID NO: 24732 - DNA, 151 bp, Homo sapiens
  D20S110
  Located on chromosome 20
  Distance between a terminus base of telomere on chromosomal short arm and 5'-terminus of this base sequence : 41272777
  Distance between 3'-terminus of neighbour sequence of sequence listing upward to telomere on chrosomal short arm and 5'-terminus of this base sequence : -226
ttgacagccaaatgaatttagtgttaaatacacacacacacacacacacacacacacacacacacacacacacacacataatctctctctccattttcataacttcttgaatttctggactatatgtacgagaatgtcaacctaagtctag

SEQ ID NO: 24733 - DNA, 439 bp, Homo sapiens
  AL117374.39_58894
  Located on chromosome 20
  Distance between a terminus base of telomere on chromosomal short arm and 5'-terminus of this base sequence : 41519281
  Distance between 3'-terminus of neighbour sequence of sequence listing upward to telomere on chrosomal short arm and 5'-terminus of this base sequence : 246353
attacctggatccaaccactacacattatactgaaacatcactatgtgctccataaatatgtacagttattatgtgccaattaaaaaaatttaaacctgttggttcaacttgactgaactgcaatctgatcagtagtcaacatgaataataccatcttagttcaagagtaaaacaatctcactgagaaaatttctcagaaaaagactcccaaaatgttatattgtgttaggttttgttttgctttggggtgtgtgtgtgtgtgtgtgtgtgtgtgtgtgtgtgtgtgtgtgtgttgaaaactggctctgaaagcatttctaaaagtggagtttccaacatcatcgtgaatccactcctgcacctcctcattgtacaaatatttactgagtgccctgtgtggctacaccaagttcactgctaggaatgattcaacttcta

SEQ ID NO: 24734 - DNA, 266 bp, Homo sapiens
  AL117374.39_74311
  Located on chromosome 20
  Distance between a terminus base of telomere on chromosomal short arm and 5'-terminus of this base sequence : 41534824
  Distance between 3'-terminus of neighbour sequence of sequence listing upward to telomere on chrosomal short arm and 5'-terminus of this base sequence : 15104
aaattgttcttaggatggagagccaaataatctcagatattatcgtggtttgtgaccctccaaagctcaaccctgcacaacaaaatcttatttcatttcatttcatggagaggggagatcagtaataataataataataataataataactaaaaagattccttagggtagtaataatgaaaaaaatctcaaaaaaacactgatataatgtgaaaatcctgttctggattcattttcaactcctcttaggaaataacatctaccgc

SEQ ID NO: 24735 - DNA, 284 bp, Homo sapiens
  chr20.fa.O7frz.43151774
  Located on chromosome 20
  Distance between a terminus base of telomere on chromosomal short arm and 5'-terminus of this base sequence : 41664256
  Distance between 3'-terminus of neighbour sequence of sequence listing upward to telomere on chrosomal short arm and 5'-terminus of this base sequence : 129166
aagtgaggtcatactggattaaggtaggccctaaattcactatgatgactggtgcttttatgagaagagatgaaaacacacacacacacacacacacacacacacggagaacattatgtgatgatggagagggactgaagtgacaccatctatgagccaaggaaggccaagaattgagggccacccccagaagtcaggaagaagcaaggaagcatcctcccctcgagacttcagagacgggatgtggccctgcagacacagtgatttcagacttctagactctg

SEQ ID NO: 24736 - DNA, 339 bp, Homo sapiens
  chr20.fa.O7frz.43241312
  Located on chromosome 20
  Distance between a terminus base of telomere on chromosomal short arm and 5'-terminus of this base sequence : 41753810
  Distance between 3'-terminus of neighbour sequence of sequence listing upward to telomere on chrosomal short arm and 5'-terminus of this base sequence : 89270
acagaattcacgacattcatctcaaatgtccaagctactactataaattaacagatcttcacacacacacacacatacacacacacacacacacacacatagctcatctcaaaagtgtgagagaacttccgaaccatgtgagaaaaccaaggcttttggaagaatatggctctgcgtctgtcaagtcaggaatccatccttctagaagggcacggtagtcagaggaaagtcccctctcctctaacacacacacgttgatgtccacctcctaatccccagcacctgtgaatatggtaccttacaaggcaaaagggactttgtaggaatgattaagttgaa

SEQ ID NO: 24737 - DNA, 395 bp, Homo sapiens
  chr20.fa.O7frz.43245350
  Located on chromosome 20
  Distance between a terminus base of telomere on chromosomal short arm and 5'-terminus of this base sequence : 41757588
  Distance between 3'-terminus of neighbour sequence of sequence listing upward to telomere on chrosomal short arm and 5'-terminus of this base sequence : 3439
cttcatctacagaacaatacgatccctctgaaacatatctggaccaccactgccctgcctgaacctcccaggagactttcactacccccagaagagggcaagtctcaagctgggcattcaaggaccatgttgacctggccgccctcacttcttggctgtcagacaccctgcagccactcctcccccacttttggccttcaacctctctgagtctctgtttccccatctatgaggtcagtggtttggaccagctaatccctgaggctcctccacggttctaaaaaggaaacacagcacacacgcatgtgcgcacgcacatacacacacacacacacacacacacacacacgtgggcacacaccacttaggctttgttctgagtacctaactgcctc

SEQ ID NO: 24738 - DNA, 122 bp, Homo sapiens
  Z67440
  Located on chromosome 20
  Distance between a terminus base of telomere on chromosomal short arm and 5'-terminus of this base sequence : 41980880
  Distance between 3'-terminus of neighbour sequence of sequence listing upward to telomere on chrosomal short arm and 5'-terminus of this base sequence : 222897
gccttcacccagaccccttcaatcatgtgatgtgtgtgtgtgtgcatgtgtgtgtgtgtgtgtgtgtgtggcactctcagaagtgtttgacagggtgcagatgtgaggcttagtgttgggaa

SEQ ID NO: 24739 - DNA, 433 bp, Homo sapiens
  chr20.fa.O7frz.43489703
  Located on chromosome 20
  Distance between a terminus base of telomere on chromosomal short arm and 5'-terminus of this base sequence : 42001908
  Distance between 3'-terminus of neighbour sequence of sequence listing upward to telomere on chrosomal short arm and 5'-terminus of this base sequence : 20906
ctcaacatcatttacaggtgaggcctgcctgtggctcagagccaggaccaagcccttcttgctccaacagctaggggttgtgtggacactaaatcctgatgaaatcctggtggacttggtcctttgttttgggtggggttggagtctcctcctccgaggtccaagtgcccagcctttctgggctctccttctgcatctctggcaacctccatgaatagttctcctgccaggaccaccccccgcccaggtctccaactctcctcactaaatggctgagacacctcaaggctgttttctcttattttctgcagggatctgaaaccagagaacattctcttggactgccaggttggtgtgtgtgtgtgtgtgtgtgtgtgtgtgtgtgtgtgtatgtggttgcacaggtacactatctgaccatgagtctgtgtac

SEQ ID NO: 24740 - DNA, 222 bp, Homo sapiens
  chr20.fa.O7frz.43596950
  Located on chromosome 20
  Distance between a terminus base of telomere on chromosomal short arm and 5'-terminus of this base sequence : 42109389
  Distance between 3'-terminus of neighbour sequence of sequence listing upward to telomere on chrosomal short arm and 5'-terminus of this base sequence : 107048
aaaccagagacctttgtttacttgtttatctgctgaccttccctccactattgtcctgtgaccctgccaaatccccctctgcgagaaacacccaagaatgatcaataaaaaaataaataaagaaagaaagaaagaaagaaaaaaaaaaaaaaagaaaggatacactggggctgattcctcgagggccttgaatgttgggcttagaagctgtaggattgttca

SEQ ID NO: 24741 - DNA, 196 bp, Homo sapiens
  D20S169
  Located on chromosome 20
  Distance between a terminus base of telomere on chromosomal short arm and 5'-terminus of this base sequence : 42407943
  Distance between 3'-terminus of neighbour sequence of sequence listing upward to telomere on chrosomal short arm and 5'-terminus of this base sequence : 298332
gagtgcttcttgaactcacaacgcgagcgcgcgcgcacacacacacacacacacacatacacacatacacgtgaacaccctctcacaatgtgttgtctcatcaactgcaagaattgtattgtccaaattactggattaaggattgacatcaacatttgggtaaaatgaagccctcacagccactagaggattcaga

SEQ ID NO: 24742 - DNA, 92 bp, Homo sapiens
  D20S861
  Located on chromosome 20
  Distance between a terminus base of telomere on chromosomal short arm and 5'-terminus of this base sequence : 42409927
  Distance between 3'-terminus of neighbour sequence of sequence listing upward to telomere on chrosomal short arm and 5'-terminus of this base sequence : 1788
tcacattttttacaggaattattgaaagaacttgtgtgtgtgtgtgtgtgtgtgtgtgtgtgtgtgtattagagtcagactgaatgacatga

SEQ ID NO: 24743 - DNA, 334 bp, Homo sapiens
  chr20.fa.O7frz.44161165
  Located on chromosome 20
  Distance between a terminus base of telomere on chromosomal short arm and 5'-terminus of this base sequence : 42634623
  Distance between 3'-terminus of neighbour sequence of sequence listing upward to telomere on chrosomal short arm and 5'-terminus of this base sequence : 224604
cttagtttaggagactccatctaacttaacactgaatacattttcaaatattatgcaacttttagaaaaatattctaacttttgcaacaaatgaacttgaaatattactcagagttaaatccttgcggtttaaaattatacagataatatgggttcccagtaaagaacgtgaaaaaatctaaaagcaagaaaaacagaatcatccatacctcacaacccagagactaccaacatcaaacattggtggaaatccttccagacttttttcacacacacacacacacacacacacacacacacacacccctcctactatacatgctatggtgttgac

SEQ ID NO: 24744 - DNA, 377 bp, Homo sapiens
  chr20.fa.O7frz.44239140
  Located on chromosome 20
  Distance between a terminus base of telomere on chromosomal short arm and 5'-terminus of this base sequence : 42712723
  Distance between 3'-terminus of neighbour sequence of sequence listing upward to telomere on chrosomal short arm and 5'-terminus of this base sequence : 77766
gtcagtaacatcactctggataacggtggattctcttctcattcctcctctagctctagagatcacacccacacctcaatctactataatattcagatgaaaacataaatttgaccatcactagcattccttatattcaattacacacacacacacacacacacacacacacacaccccaagcaaagaaaatactcagaactgctataggtctcatttctgtaattgattccaaggccactgttgatatttacagtttctcttttttcactagctattctaggttctctttgccctcagccagcacctcagttagttagcgtatttaacctggtgacatgactcagactctggtggtccttagattgctatggtctt

SEQ ID NO: 24745 - DNA, 200 bp, Homo sapiens
  DISO7_00004434
  Located on chromosome 20
  Distance between a terminus base of telomere on chromosomal short arm and 5'-terminus of this base sequence : 42838820
  Distance between 3'-terminus of neighbour sequence of sequence listing upward to telomere on chrosomal short arm and 5'-terminus of this base sequence : 125720
atctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagca

SEQ ID NO: 24746 - DNA, 364 bp, Homo sapiens
  Z97053.2_65761
  Located on chromosome 20
  Distance between a terminus base of telomere on chromosomal short arm and 5'-terminus of this base sequence : 42979916
  Distance between 3'-terminus of neighbour sequence of sequence listing upward to telomere on chrosomal short arm and 5'-terminus of this base sequence : 140896
acttagctactttcctaaagccagaatttctttagaaaatcagttttcttttaagacttcaaaacactttgccttctccttagtactataaagaattctaattatgtaggacattcatccagccactcctcccaccacacacacacacacacacacacacacacacacacacacacacacacacatatatctgtctgagataataattagatactgtgggaagagaaatgaaatatccctgatggttttaataattttctgcagtgtttgtttggacaagaaaatcagctgtcacatcccctgggtatgagagttatataaacccagatcagaaagtcaatgctgcagacttaaattctcagga

SEQ ID NO: 24747 - DNA, 339 bp, Homo sapiens
  Z97053.2_93065
  Located on chromosome 20
  Distance between a terminus base of telomere on chromosomal short arm and 5'-terminus of this base sequence : 43007171
  Distance between 3'-terminus of neighbour sequence of sequence listing upward to telomere on chrosomal short arm and 5'-terminus of this base sequence : 26891
aaacttcagcttctgttgtcatacctctctgaactttttctatcttccggaaattatttgaaatgaaatcccttgttctctaatgatccttccttcagcaaaaaggcccaatttgtagttcagaagacgtggtgctttttacaaaaagtatgttaatgttttaccatagactggactaagtagagtgtgtgtgtgtgtgtgtgtgtgtgtgtgtgtgtgtgtgtgtttagaaaatatttattgagtttcctattttatgccaggcactcttctaggcacttgggatagatgtattcagtgaaccaaggagacatactgttgactttgtggagcttacag

SEQ ID NO: 24748 - DNA, 181 bp, Homo sapiens
  D20S911
  Located on chromosome 20
  Distance between a terminus base of telomere on chromosomal short arm and 5'-terminus of this base sequence : 43007275
  Distance between 3'-terminus of neighbour sequence of sequence listing upward to telomere on chrosomal short arm and 5'-terminus of this base sequence : -235
ggcccaatttgtagttcagaagacgtggtgctttttacaaaaagtatgttaatgttttaccatagactggactaagtagagtgtgtgtgtgtgtgtgtgtgtgtgtgtgtgtgtgtgtgtgtttagaaaatatttattgagtttcctattttatgccaggcactcttctaggcacttggga

SEQ ID NO: 24749 - DNA, 253 bp, Homo sapiens
  M13792.1_2865
  Located on chromosome 20
  Distance between a terminus base of telomere on chromosomal short arm and 5'-terminus of this base sequence : 43083741
  Distance between 3'-terminus of neighbour sequence of sequence listing upward to telomere on chrosomal short arm and 5'-terminus of this base sequence : 76285
atacaatggtgcaacttttagaatgtgtaaaagcaaaaccaaaagtatgtatgtttagacacatgcatcggtggaaaaaatgtaaagcaagggaaagatgagcatagatacgagaagagtggttatctcaggtgaaagggaaggagccgggaggaggtaaggacggagggaaataacacgcgggtacaggttatttatttatttatttatttatttatttatttatttatttatttactgagacggagtttcg

SEQ ID NO: 24750 - DNA, 252 bp, Homo sapiens
  D20S880
  Located on chromosome 20
  Distance between a terminus base of telomere on chromosomal short arm and 5'-terminus of this base sequence : 43246183
  Distance between 3'-terminus of neighbour sequence of sequence listing upward to telomere on chrosomal short arm and 5'-terminus of this base sequence : 162189
caattgtgataagtgccataaaagatatatatctatatactgtgtgtgtgtgtgtgtgtgtgtgtgtgtgtttgagtgagatagggcgagatggggtcttgctatgttgcccaggctggtcttaaactcctagcctcaagcagtcctcccgccttgacctcccgaagtgggtaggattacaggcgtgcacccccatgcccagcccagcatgcatatacgttgcagtgcatttgtgtacatgtatgtgcagct

SEQ ID NO: 24751 - DNA, 118 bp, Homo sapiens
  D20S119
  Located on chromosome 20
  Distance between a terminus base of telomere on chromosomal short arm and 5'-terminus of this base sequence : 43451607
  Distance between 3'-terminus of neighbour sequence of sequence listing upward to telomere on chrosomal short arm and 5'-terminus of this base sequence : 205172
tttccagatttaggggtgtatgtttatgcgtgtgtgtgtgtgtgtgtgtgtgtgtgtatgtttatgtttatgtttatgtttatgtttatgtgagatagagatactgaaactgtgtcag

SEQ ID NO: 24752 - DNA, 482 bp, Homo sapiens
  Z93016.2_66966
  Located on chromosome 20
  Distance between a terminus base of telomere on chromosomal short arm and 5'-terminus of this base sequence : 43497186
  Distance between 3'-terminus of neighbour sequence of sequence listing upward to telomere on chrosomal short arm and 5'-terminus of this base sequence : 45461
aaagcataagagttgtgatgctggcaatttggatttgccaaagagaagctgtaaaatgcttccttgtttatctcttactgtgcctaatttaaaaattaaactttatcataggtatatatgtataggaaaaaattgtgtatgtgtatatatatacacacattatatacatatgtatatacacattatatatctacacacacacacacacacacacacacacacacagatatctagctagatagtaccaaaatatatacatctgtggttttggacatccactggaatgtatcccttgtggataggggggactactgtaatcacaaaaaactaacagtatgcaagtacttcatattttataaaatgttatttaaagaagaaaacttgttttttgtgtttgccatttattaaatcatattctttatacatacacgtgtgtacacgcacgatgtactgagtctcctctctaggctctgtggacaaag

SEQ ID NO: 24753 - DNA, 238 bp, Homo sapiens
  D20S481
  Located on chromosome 20
  Distance between a terminus base of telomere on chromosomal short arm and 5'-terminus of this base sequence : 43570836
  Distance between 3'-terminus of neighbour sequence of sequence listing upward to telomere on chrosomal short arm and 5'-terminus of this base sequence : 73168
tgggttatgagtgcacacaggaaaattggtacctgatgtggaaggtagagaaatactgaggaaaaagctctctgaagcaggtgttctatctatctatctatctgtctatctatctatctatctatctatctatctatctatctatcatctgtctatcatcaacatcatcatcatcatcctttcctctctttctagtgcaatctgtggttacctcctagctgtgtgtctttttgctgtt

SEQ ID NO: 24754 - DNA, 381 bp, Homo sapiens
  chr20.fa.O7frz.45182841
  Located on chromosome 20
  Distance between a terminus base of telomere on chromosomal short arm and 5'-terminus of this base sequence : 43656434
  Distance between 3'-terminus of neighbour sequence of sequence listing upward to telomere on chrosomal short arm and 5'-terminus of this base sequence : 85360
agttaacttcatagtacatgctgactaaatattgtagagcttccttaaaaagaaagaaagagagagggagggagggagagggagaagagaaaaagagagaagacaaaaagagagaaagaaagcaaagaaagagaaagaaagaaagaaagaaagaaagagaaagaaagaaaagaaaagagaaagaaagagatggaagggaggaaaaaggaatgaaggaaaaagaaaggaaggaaggaaaataaaggaagggaaagaaagaaaagagagagagaaagaagaaagaaaagaaagaaagaaagaaagaaagaaagaaagaaaaagaaaaacaaagaaagaaagaaagagagaaagaatcttctctatgaggtctgatattgcttg

SEQ ID NO: 24755 - DNA, 387 bp, Homo sapiens
  chr20.fa.O7frz.45308958
  Located on chromosome 20
  Distance between a terminus base of telomere on chromosomal short arm and 5'-terminus of this base sequence : 43782492
  Distance between 3'-terminus of neighbour sequence of sequence listing upward to telomere on chrosomal short arm and 5'-terminus of this base sequence : 125677
tgtttaacaactggctaatgacataaaaaaaaaagcaacaaaaaaaaaacaggatctctctctgtagcccaggctggagtgcagtggcaaaattatggctgattgcagcctcaacctcccaggctcacgagatcctcccacctcagcctcctgagtagttgggactagacatacgccaccacgcacagctaattattattattattgttattgttattattattattattattattattttggtagagacacagtcttactatgttgcccaggctgggtttgaaggcctgggctcaagcagtcctctcaacttagcttcccaaagtgctgggattacatggcacccagccacaaaatttctaaaaattgactttcatgaaccactac

SEQ ID NO: 24756 - DNA, 354 bp, Homo sapiens
  AL031663.2_3148
  Located on chromosome 20
  Distance between a terminus base of telomere on chromosomal short arm and 5'-terminus of this base sequence : 43870511
  Distance between 3'-terminus of neighbour sequence of sequence listing upward to telomere on chrosomal short arm and 5'-terminus of this base sequence : 87632
tactgacaggataaagatgccttgtgacaaagcctcctgggtataatattcccagttataagttgtaaagatatatatacatatatatatatatatatatatatatatatatatatatatatatataaatcttttacagagcaatgcttatgtttttgtatagctaattgctgtaagtctgtaattaaaaccaagtttacagtagctgaatacataggagttaaagacaagttagtttttgcctttttgtttgttagctttttacttaaaatagcaataataattttaaagagtaatgaatgcctgtccatgtccatttccatctggcctgtaacatttgattggctgtaagtc

SEQ ID NO: 24757 - DNA, 303 bp, Homo sapiens
  AL031663.2_56145
  Located on chromosome 20
  Distance between a terminus base of telomere on chromosomal short arm and 5'-terminus of this base sequence : 43923342
  Distance between 3'-terminus of neighbour sequence of sequence listing upward to telomere on chrosomal short arm and 5'-terminus of this base sequence : 52477
ggtaatacctacatggaaacagacatcttctctgcaggaaagtgcaggtttggggttggagcgatagtaagaagttacatgagtgagctggagcttagaaaataaagttctaaagacagaccagtcagggaggggaaggtcctgccccagaaacaacatcagcagaggcattcactcattcaatatttataaagcacttactatgtgttctattctaggtggtggggatttgatagaaggaaaagagtgtgtgtgtgtgtgtgtgtgtgtgtgtgtgtgcggtggagaggatagccaataaat

SEQ ID NO: 24758 - DNA, 370 bp, Homo sapiens
  AL031663.2_72380
  Located on chromosome 20
  Distance between a terminus base of telomere on chromosomal short arm and 5'-terminus of this base sequence : 43939543
  Distance between 3'-terminus of neighbour sequence of sequence listing upward to telomere on chrosomal short arm and 5'-terminus of this base sequence : 15898
catgtacctgactttggtgtacttttggatttgcatttcctgggtgagtcaccacgacctttgtgacaattctcactggatagtgatctggatagcaccccatttgaccccagtttcatagcacaggaaggacaacggataggcccagccttacctgagtgtggcaactgtctaacagatccagggctagggaatgtggctttaatgaccgcctcaactactgacactgtgccctgtgctcctgaagaatatgtttcttttctctttcccttcccttcctttcccttcccttcccttcccttcccttcccttcccttcccttcccttccctccttcccttcttcctttcttcctttcttgacagagtttc

SEQ ID NO: 24759 - DNA, 410 bp, Homo sapiens
  AL031663.2_125491
  Located on chromosome 20
  Distance between a terminus base of telomere on chromosomal short arm and 5'-terminus of this base sequence : 43992630
  Distance between 3'-terminus of neighbour sequence of sequence listing upward to telomere on chrosomal short arm and 5'-terminus of this base sequence : 52717
accttactttctattccgcatcttgacatttggcatcaacaggtccagtttgttattagaatccagagattcactccttcctctccgccaccccagtatcccatcactcatggacttgggtcaattctgtctcctaaacctctctccaaaccctgtctcctgcctctctttactaccactccctcagatcagcacctgatctcaccccttgtctcttctcaactactgcagcagcctcctcactggtcctctcccctcaggctcatgcctagtgacttattaattaaaaaacaattaaacttgcgtgtgtgtgtgtgtgtgtgtgtgtgtgtgtgtgtgtacagtgggaatgaatgtaatcacccaagaattatgtgttgagtgatatcataagacagatgagaccagat

SEQ ID NO: 24760 - DNA, 334 bp, Homo sapiens
  AL031671.12_8234
  Located on chromosome 20
  Distance between a terminus base of telomere on chromosomal short arm and 5'-terminus of this base sequence : 44019818
  Distance between 3'-terminus of neighbour sequence of sequence listing upward to telomere on chrosomal short arm and 5'-terminus of this base sequence : 26778
ttcttagatcttaccatcttcaagaagcatgcagacatttccgcagaagacattactgcattaatgatgaatttgagattctgagtgtaacttgcagaaggttctgcctatcagtgagaatctgtgtggcatttcagttttggctttgataaaattgaggagtatatgagcagtaacacccaggagggtgtttctcactattatcagcccctccaatgctccaggacccactccattgatttcccttcttcctctccccagcgcaaggatctgggtggttttctttgttgttgttgttgttgttgttgttggcttctggagtaaagttccagtc

SEQ ID NO: 24761 - DNA, 390 bp, Homo sapiens
  AL050348.21_20134
  Located on chromosome 20
  Distance between a terminus base of telomere on chromosomal short arm and 5'-terminus of this base sequence : 44181428
  Distance between 3'-terminus of neighbour sequence of sequence listing upward to telomere on chrosomal short arm and 5'-terminus of this base sequence : 161276
tctcaggtcacttaaatgtcactataatcagtcataggcataagtttttcaggtaacttagtttaataacattcttgaaattgtgaaaattgaagttcagccaagcacagtggtgtgcacctgtagtcccagctacttgggaagctgaggcaagaagattacttgagcccagcattcaagaccagcctgggcaatacagcaagacttccatttagatagatagatagatagatagatagatagatagatagatagacagacagacagacagacagacagacagacagacagatagatatagatagccaggcgcggtggcttatgcctgtaatcccagcactttgggaggctgaggcgggcggatcatgaggtcagtagatcaagaccatc

SEQ ID NO: 24762 - DNA, 227 bp, Homo sapiens
  AL050348.21_45960
  Located on chromosome 20
  Distance between a terminus base of telomere on chromosomal short arm and 5'-terminus of this base sequence : 44207364
  Distance between 3'-terminus of neighbour sequence of sequence listing upward to telomere on chrosomal short arm and 5'-terminus of this base sequence : 25546
atgattctttaatggagatccacagtgcctggcactcaaaaatatttgtttttttaaaatgttgaagaaaaaaaggcattggaacaggaatgcttttatctctgtgtgtgtgtgtgtgtgtgtgtgtgtgtgtgtgtgtgtgtgtttccagctgggcgtggtggctcacgcctgtaattccagcactttgggaggccgagacaggcagatcacgaggtcaggagttc

SEQ ID NO: 24763 - DNA, 417 bp, Homo sapiens
  AL008726.2_56503
  Located on chromosome 20
  Distance between a terminus base of telomere on chromosomal short arm and 5'-terminus of this base sequence : 44315038
  Distance between 3'-terminus of neighbour sequence of sequence listing upward to telomere on chrosomal short arm and 5'-terminus of this base sequence : 107447
gctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacagg

SEQ ID NO: 24764 - DNA, 121 bp, Homo sapiens
  D20S838
  Located on chromosome 20
  Distance between a terminus base of telomere on chromosomal short arm and 5'-terminus of this base sequence : 44439944
  Distance between 3'-terminus of neighbour sequence of sequence listing upward to telomere on chrosomal short arm and 5'-terminus of this base sequence : 124489
ctcatgctggtgctgccacacacacacacacacacacacacacacacacacacacacacacaccctgacccctgagtcagcacttgcctgtcaaggaggggtggggtcacaggagcgcctc

SEQ ID NO: 24765 - DNA, 157 bp, Homo sapiens
  D20S856
  Located on chromosome 20
  Distance between a terminus base of telomere on chromosomal short arm and 5'-terminus of this base sequence : 44455303
  Distance between 3'-terminus of neighbour sequence of sequence listing upward to telomere on chrosomal short arm and 5'-terminus of this base sequence : 15238
ggaatgctgtgtgctgtggcagaggctgtgtgtgtgtgtgtgtgtgtgtgtgtgtcttgtgggaggagcatcccccattagttttgatgacctgtggggtggtcagtgactcactcagtgcttctgtgtgtcactatattgccagcacgttgaaggg

SEQ ID NO: 24766 - DNA, 389 bp, Homo sapiens
  AL162458.10_114045
  Located on chromosome 20
  Distance between a terminus base of telomere on chromosomal short arm and 5'-terminus of this base sequence : 44458581
  Distance between 3'-terminus of neighbour sequence of sequence listing upward to telomere on chrosomal short arm and 5'-terminus of this base sequence : 3121
aagccactgacaaattgtattaatacaagtaaagctgagccctggatcctgtccatggtcctgaaaaaagtcctgtcctataccccggtctccagggatatgaatggctctttaggatttttgcaggttttctggaggcttccccttcagttgcaagccaagagtccattctagccctgcacctctgaagcctgagcacaagaaaaggaataaagcacatctcagatgtagtgcctgtttgtttgtttgtttgtttgtttgtttttcaggagctaataatcagaggctgctgaggggcatggatatgactgcatccttgtctcttctatggaggcaagacgacttttataagttctatcaatgaagagagtcctaaactggagtaaagc

SEQ ID NO: 24767 - DNA, 238 bp, Homo sapiens
  DISO7_00049195
  Located on chromosome 20
  Distance between a terminus base of telomere on chromosomal short arm and 5'-terminus of this base sequence : 44629399
  Distance between 3'-terminus of neighbour sequence of sequence listing upward to telomere on chrosomal short arm and 5'-terminus of this base sequence : 170429
acttacctggatgccatgtctcaggctctctctctttctctcccagctcacatttctccctagctgcaccaaaaagacacacacacacacacacacacacacacacacacacacacacacatattcttccagaaactcaggccaaacaccctggagtcatccttgacccttctccatctctccccgggacatcagcccatgagcagattccactggctctatcttcagcctgtatccc

SEQ ID NO: 24768 - DNA, 209 bp, Homo sapiens
  DISO7_10000253
  Located on chromosome 20
  Distance between a terminus base of telomere on chromosomal short arm and 5'-terminus of this base sequence : 44729679
  Distance between 3'-terminus of neighbour sequence of sequence listing upward to telomere on chrosomal short arm and 5'-terminus of this base sequence : 100042
ggtggtgatacacgtgtaggtaaataacgggttggtggatagatgggtggaggtgggtgaggggtgaactgcaggcagatggatgtttaaatggaggtgggtgggctggaggatgatggattggataaatggatggattgatgaatgggtggatggatggatggatggatgggtgggtggatggatgagtggatggatggctggcttag

SEQ ID NO: 24769 - DNA, 108 bp, Homo sapiens
  DISO7_10000254
  Located on chromosome 20
  Distance between a terminus base of telomere on chromosomal short arm and 5'-terminus of this base sequence : 44731649
  Distance between 3'-terminus of neighbour sequence of sequence listing upward to telomere on chrosomal short arm and 5'-terminus of this base sequence : 1761
tcactctgcccatcacacacacaagcgcgcgtgtgcgtgcgcgtgcacacacacatacacacacactccacctccccagctcccctcccctactctgcaagcactacg

SEQ ID NO: 24770 - DNA, 144 bp, Homo sapiens
  D20S836
  Located on chromosome 20
  Distance between a terminus base of telomere on chromosomal short arm and 5'-terminus of this base sequence : 44742921
  Distance between 3'-terminus of neighbour sequence of sequence listing upward to telomere on chrosomal short arm and 5'-terminus of this base sequence : 11164
gtctgaacgccctaacagcagggtctgctccagggagcctgcaggtttgagcaggggtcagtgaagggtgtgtgtgtgtgtgtgtgtgtgtgtgtgtgtgagtgcatacacgcgtgtgtgttggggatggggaggctgctctta

SEQ ID NO: 24771 - DNA, 314 bp, Homo sapiens
  AL133227.15_51771
  Located on chromosome 20
  Distance between a terminus base of telomere on chromosomal short arm and 5'-terminus of this base sequence : 44800949
  Distance between 3'-terminus of neighbour sequence of sequence listing upward to telomere on chrosomal short arm and 5'-terminus of this base sequence : 57884
gaggaacaagttaaactgtaccacggggaaacaatcagcaaaattcagatgctaggaaactaccaaacaagcaatctggttcttcagctaataaactgcaaaggaaaagatggtgggggatgggggggcgggggaacttatgaattaagaaacttaaaagaccagtcttagactctggtttagacaagatgggtatgggggtgtgtgtgtgtgtgtgtgtgtgtgtgtgtgtgtgtgtgtgtgtatccatataaacatttatatatctgtagagaaattatgacatttataagacaattggtagaaagtcacca

SEQ ID NO: 24772 - DNA, 279 bp, Homo sapiens
  AL031686.2_46918
  Located on chromosome 20
  Distance between a terminus base of telomere on chromosomal short arm and 5'-terminus of this base sequence : 44881654
  Distance between 3'-terminus of neighbour sequence of sequence listing upward to telomere on chrosomal short arm and 5'-terminus of this base sequence : 80391
tattctttcagtaccttgttggattctatttcctagagttttatttaagtgtctcatgtatattaatagatgaaattgatttatatcttggggtgacttccagattttacacacacacacacacacacacacacacacacacacacagattgtgttcaaactatttcttattataatctctgtgggtactgaaagaatcatgcatttatggggatgaaaaaaattacctttgagagcaagcattcagtgtacccaataaagcagaaactcttgcataat

SEQ ID NO: 24773 - DNA, 155 bp, Homo sapiens
  D20S886
  Located on chromosome 20
  Distance between a terminus base of telomere on chromosomal short arm and 5'-terminus of this base sequence : 45053780
  Distance between 3'-terminus of neighbour sequence of sequence listing upward to telomere on chrosomal short arm and 5'-terminus of this base sequence : 171847
ctcaacaggaattggtgtgtggtgtgtgcgtgtgtgtgtgtgtgtgtgtgtgtgtgtgtgtgtgtgtgtgtgtgtgtctgatactcatgaatagcaacaaagttacaaatttaagaaggcaatatagcttccctgctagggacactctaaggtca

SEQ ID NO: 24774 - DNA, 450 bp, Homo sapiens
  AL031055.1_28565
  Located on chromosome 20
  Distance between a terminus base of telomere on chromosomal short arm and 5'-terminus of this base sequence : 45146281
  Distance between 3'-terminus of neighbour sequence of sequence listing upward to telomere on chrosomal short arm and 5'-terminus of this base sequence : 92346
ctccacatctgtaagatggaataattgtagcagtctcacctagggttgttatgaggatgaattgagggaaggaacataaagtcttcacacagaggaggtctccatacatgatagctgttattattactgttttatttcacgtttgtttgtttgtttgtttgtttctattgtccattggccttattgtccatttcaactgaacctgcactgatgtgttttccagtggaacctgtgggtggaagctgtgagccctttggctgggttccctttcgctgcaagaggaacccaggaaatggcaaacaaatcctgggctttcacctcgattgcttcacatggcctggaaggaccttgctttctgggaaaaagcctcaggaatgagggaggaggggcaaaggggggcgaagacagagcaggatctgagcagcatcttccaggatgtttactagtggt

SEQ ID NO: 24775 - DNA, 466 bp, Homo sapiens
  AL121776.19_22727
  Located on chromosome 20
  Distance between a terminus base of telomere on chromosomal short arm and 5'-terminus of this base sequence : 45388513
  Distance between 3'-terminus of neighbour sequence of sequence listing upward to telomere on chrosomal short arm and 5'-terminus of this base sequence : 241782
ctagtcaataccaggctgaataagatatcaggaagatgtcaggttcttatcactggaaactgtacatgtcaccttatgtggcaaaaatactttgcagatgggattcagttaaggatcttgagatgggggattatcttggattatccaggttggccccaaatgagatcacagttgttcttataggagagaggcagaaggagatttcacacacacacacacacacacacacacacacacacacacacacacacacgaagacaatgtgaagacaggacagagatttgaagatgttggccttgaagcttggagtgatgcagccacaaatcaaggtttgctggtggacaccagaggctgaaatggattctcacctggagcctctggatggaatatggccctgtagacacctggattgtggcccagcaatactgagtttggacttctgtccttcagaactgcaagaggataa

SEQ ID NO: 24776 - DNA, 309 bp, Homo sapiens
  AL121776.19_128590
  Located on chromosome 20
  Distance between a terminus base of telomere on chromosomal short arm and 5'-terminus of this base sequence : 45494388
  Distance between 3'-terminus of neighbour sequence of sequence listing upward to telomere on chrosomal short arm and 5'-terminus of this base sequence : 105409
tttaagcggtcatgtctaatactccatcccccagccctggcaatcacaagcctacttttttttgtctctgtagactatcttattctggatactttatatgaatacaaatccctcagtatgtggccttgtatgtctgacttattttatttggcataatgttttttgggtttatttgtgtgtgtgtgcgtgtgcgtgtgtgtgtgtgtgtgtgtgtgtgtgtgtgtgtgtgttttgagacagtgaggcaggagaatagggtctggaggcagagaacctaaggccaattcatgctgacttcctagaactgaa

SEQ ID NO: 24777 - DNA, 300 bp, Homo sapiens
  AL121776.19_143529
  Located on chromosome 20
  Distance between a terminus base of telomere on chromosomal short arm and 5'-terminus of this base sequence : 45509342
  Distance between 3'-terminus of neighbour sequence of sequence listing upward to telomere on chrosomal short arm and 5'-terminus of this base sequence : 14645
ggttcaacagtaagtggttgagatggtttttactgtgtgtctaacaagctgacataaaatctaatgacgtaaataatggtcagctgtagctgaggtctcctgcctctttttcctagtgttcactgtaaaggaatttaagcatatgtgtgtgcacatgtgcacgtgcgcgcgcgcgcgcacacacacacacacacacacacacacacacattcatgcactctttttaaatttcccataaaaactctacttttgaaattatccaggatatccttgagtggttggttccaaactccagaggct

SEQ ID NO: 24778 - DNA, 365 bp, Homo sapiens
  AL390211.1_29528
  Located on chromosome 20
  Distance between a terminus base of telomere on chromosomal short arm and 5'-terminus of this base sequence : 45585828
  Distance between 3'-terminus of neighbour sequence of sequence listing upward to telomere on chrosomal short arm and 5'-terminus of this base sequence : 76186
agacagtggactcaaaggaagaaaagaaagtgcaagggaggctggagtcactgagaagtgtggtggcggaaagccaagatctgacaccaggaggaggaggaagtcccaatgttcatggagaaaacaaatatttttcatctctttgggtttttctgattttgtttttgtttattttgttttgtgtgtgtgtgtgtgtgtgtgtgtgtgtgtgtgtgtgtgttttgagatggagcctcgctctgtctctcaggctggagtgcagtgctgcgatctcagctcactgcaaccttcacctccctggttcaagcaattctcatgcctcagcctcccgagtagttgggaccaccagctgatagctcctaaag

SEQ ID NO: 24779 - DNA, 210 bp, Homo sapiens
  D20S891
  Located on chromosome 20
  Distance between a terminus base of telomere on chromosomal short arm and 5'-terminus of this base sequence : 45732144
  Distance between 3'-terminus of neighbour sequence of sequence listing upward to telomere on chrosomal short arm and 5'-terminus of this base sequence : 145951
ctacaggtgagcgccaccatgcacaactaattttgtgtgtgtgtgtgtgtgtgtgtgtgtgtgtgtgtgtgtgtgtgtgtgtgttttgttttgttttttttgtagagacagggtttcaccatgttacccaggctggtattaagaggttttactgttcccaaatgcctggtatttccacaatccttgatgaagagccttgtagatgcttgc

SEQ ID NO: 24780 - DNA, 401 bp, Homo sapiens
  chr20.fa.O7frz.47222504
  Located on chromosome 20
  Distance between a terminus base of telomere on chromosomal short arm and 5'-terminus of this base sequence : 45835718
  Distance between 3'-terminus of neighbour sequence of sequence listing upward to telomere on chrosomal short arm and 5'-terminus of this base sequence : 103364
ctgtttgatgaaaggcttactgaggaggatggctgaaaagaattcccataagcagaaattggagtagggctggacgtttgaatcaattaaaaatgttttgagctgtgagcagtggctcacacctgtaatcccagcactttgggaggctgagtcaggaggatcacttgagtccagcaggtcaaggctgcagtgagccatgatcaggccactgcactgcagccttagtgacacagcaagatacacacacacacacacacacacacacacacacacacacacacacacacacggtgttttggctataagtaacaagaataacaaaatacaacaaggaatatctttaaggagtcattcatttattctacaaacattttcctgtcacttactatattccaggtcct

SEQ ID NO: 24781 - DNA, 181 bp, Homo sapiens
  Z24408.1_124
  Located on chromosome 20
  Distance between a terminus base of telomere on chromosomal short arm and 5'-terminus of this base sequence : 45963320
  Distance between 3'-terminus of neighbour sequence of sequence listing upward to telomere on chrosomal short arm and 5'-terminus of this base sequence : 127201
tgttgcctattccttagatgttaggaatataccagtgactagaaaggttacggaaaaaaaataaaactttgtagggggggacttgtgtgtgtgtgtgtgtgtgtgtgtgtgttgcagggtttacgttttagatatcatggtaagttttgctaagtaagtgatacttaaacaaggacaccag

SEQ ID NO: 24782 - DNA, 135 bp, Homo sapiens
  DISO7_10000256
  Located on chromosome 20
  Distance between a terminus base of telomere on chromosomal short arm and 5'-terminus of this base sequence : 46082342
  Distance between 3'-terminus of neighbour sequence of sequence listing upward to telomere on chrosomal short arm and 5'-terminus of this base sequence : 118841
acagagggtggctatgatgatgcagcagcagcagcagcagcaacagcagcagcagcagcagcagcagcagcaacagcaacagcaacagcaacagcagcaacagcagcaaacccaggccttcagcccacctcctaa

SEQ ID NO: 24783 - DNA, 131 bp, Homo sapiens
  DISO7_10000255
  Located on chromosome 20
  Distance between a terminus base of telomere on chromosomal short arm and 5'-terminus of this base sequence : 46086116
  Distance between 3'-terminus of neighbour sequence of sequence listing upward to telomere on chrosomal short arm and 5'-terminus of this base sequence : 3639
tccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcc

SEQ ID NO: 24784 - DNA, 273 bp, Homo sapiens
  AL354813.23_22692
  Located on chromosome 20
  Distance between a terminus base of telomere on chromosomal short arm and 5'-terminus of this base sequence : 46171867
  Distance between 3'-terminus of neighbour sequence of sequence listing upward to telomere on chrosomal short arm and 5'-terminus of this base sequence : 85620
ggcttggtttccttctacttagggcaagtaaccttagcttttcctttagggtggtggaaatcctcttaaaacaacaacaacaacaaacaattgcagccgatttttaaaaagtaaataatcgtacaagtggcacacagatatatgatgaaaattgtgagggaatgattagaatttggcaatcattggcttggtaaaacccggacctgacatcccttgatgtgtggcttggtacaaccctgacatccattgatgtcattcggctgtcgattagac

SEQ ID NO: 24785 - DNA, 193 bp, Homo sapiens
  Z95330.11_12459
  Located on chromosome 20
  Distance between a terminus base of telomere on chromosomal short arm and 5'-terminus of this base sequence : 46338910
  Distance between 3'-terminus of neighbour sequence of sequence listing upward to telomere on chrosomal short arm and 5'-terminus of this base sequence : 166770
atggagatcagctgttcactactcaatgctcccaagttatgtgaggcagcgaggcacaaaattggcatctgctgtggtgtgtgtgtgtgtgtgtgtgtgtgtgtgtgtgtgtgtgtgtatgtggtgagcttggtgcacaggtaggatgaggtttggggcaaaagggcatgaacgatacagccaatagtaattg

SEQ ID NO: 24786 - DNA, 321 bp, Homo sapiens
  Z95330.11_28028
  Located on chromosome 20
  Distance between a terminus base of telomere on chromosomal short arm and 5'-terminus of this base sequence : 46354349
  Distance between 3'-terminus of neighbour sequence of sequence listing upward to telomere on chrosomal short arm and 5'-terminus of this base sequence : 15246
ggagtttcctagaaaccacaagcgaacccatttttgaatcttcttgacctcagttgcatgatatgtgtgctcttgaccaaaaccctatcaatggaatgactgggatcacccttagaacagtgttgtagctaggatgggagcaggatgaactttcttgaatccctgggatgcagggaaaacaggattcctgaaaagtgaagaactgggtgtgtgtgtgtgtgtgtgtgtgtgtgtgtgtgtgtgtgtgtgtgtatggcattgaaattttgggtaggcagtcaacagtattcactacacctatcagattccaaaggtatcttg

SEQ ID NO: 24787 - DNA, 254 bp, Homo sapiens
  D20S178
  Located on chromosome 20
  Distance between a terminus base of telomere on chromosomal short arm and 5'-terminus of this base sequence : 46354530
  Distance between 3'-terminus of neighbour sequence of sequence listing upward to telomere on chrosomal short arm and 5'-terminus of this base sequence : -140
ggattcctgaaaagtgaagaactgggtgtgtgtgtgtgtgtgtgtgtgtgtgtgtgtgtgtgtgtgtgtgtatggcattgaaattttgggtaggcagtcaacagtattcactacacctatcagattccaaaggtatcttggtcaccttgattagaactctaaatgtgtttaatgtgtgtatgtacgcatgttcacattgtgctgaattggttagaatttcaaatggatttggcattgttctgtatggacatggc

SEQ ID NO: 24788 - DNA, 393 bp, Homo sapiens
  Z95330.11_41067
  Located on chromosome 20
  Distance between a terminus base of telomere on chromosomal short arm and 5'-terminus of this base sequence : 46367329
  Distance between 3'-terminus of neighbour sequence of sequence listing upward to telomere on chrosomal short arm and 5'-terminus of this base sequence : 12545
tcagcattcctaatagcctataaatgtgtctgctctttgaatttccttttgaattggttttaaaacctttctacttccctcatccattactgagttaaataaaactgttgacacatattcttttaatatttgtttgagagtcatgattttatctttaaaaattaggctttgataatttcaatcattgtggaaccaaaaattcacccctcataatttcaaaactccctagaaaacaatactatgcccactgtgagtcactgcatctcacacacacacacacacacacacacacacacacacacacacacacacacacacagagaaatgataaacctacagatactgaatttattttctcttctgtgtatcgtgtgacctggtagttgactgaat

SEQ ID NO: 24789 - DNA, 203 bp, Homo sapiens
  DISO7_00004442
  Located on chromosome 20
  Distance between a terminus base of telomere on chromosomal short arm and 5'-terminus of this base sequence : 46420336
  Distance between 3'-terminus of neighbour sequence of sequence listing upward to telomere on chrosomal short arm and 5'-terminus of this base sequence : 52614
aaggaaagtggttgctcagtgtctgctgtgaacctggctgtccctatgtgtcctctctcctctgtgtatgtgtgtgtgtgtgtgtgtgtgtgtgtgtcttgcaaacatcagtgcacaacacaccacagtcccataattcagtggagtgtgtatctgctcggcagactccactgtccccacagtcagggtccaggcactagaag

SEQ ID NO: 24790 - DNA, 327 bp, Homo sapiens
  AC020585.6_158331
  Located on chromosome 20
  Distance between a terminus base of telomere on chromosomal short arm and 5'-terminus of this base sequence : 46626720
  Distance between 3'-terminus of neighbour sequence of sequence listing upward to telomere on chrosomal short arm and 5'-terminus of this base sequence : 206181
ccagttaacaggtgagtcagatcccagtgccctgtagggactgcagaggcagctcccttctcttgcccttgactccatgcccttcttcttcttcctgcctagctgcacacatggcaccatgcaattcccctcctcctcctcctcctcctcctcacttctgctcatgtggggaaacctgtgccttatgtatcctgcaccccagggttcttggaccctggaccccagcctgtgggcagcaggccctccaagctccacccactgctcagcaccacgtccattaccccctgtccaagccactgtcctctcttgtcctggtgattaagacag

SEQ ID NO: 24791 - DNA, 317 bp, Homo sapiens
  AC020585.6_170448
  Located on chromosome 20
  Distance between a terminus base of telomere on chromosomal short arm and 5'-terminus of this base sequence : 46638829
  Distance between 3'-terminus of neighbour sequence of sequence listing upward to telomere on chrosomal short arm and 5'-terminus of this base sequence : 11782
agaatatcagccgcatgaggtcaacagctgtttgttcacagctgggtctgttgcacctggcattcaatacttttctgttgactggatggtggatggatggatggacggatggatggatgagtggatggatggatggatggatggatggatgggtgaatggatggatggatggatggatagatggatggatgatgagtggatggatggatgggtgaatgggtgggaaggtggatggatgaatggatggatggatgggtgaatgggtgggaaggtgggtggatgggtgggtgttggatggatagatcaatggtcgtgca

SEQ ID NO: 24792 - DNA, 228 bp, Homo sapiens
  chr20.fa.O7frz.49071875
  Located on chromosome 20
  Distance between a terminus base of telomere on chromosomal short arm and 5'-terminus of this base sequence : 46724872
  Distance between 3'-terminus of neighbour sequence of sequence listing upward to telomere on chrosomal short arm and 5'-terminus of this base sequence : 85726
tttgtatcagagatttgagcactcatggattttggtatccaagcgaggtcctggaaccaatcccccatggatactgagggacaactgcatatacacacacacacacacacacacacacacactctctctctctctctctctctctgtctctctctccctgtctcatatatattcagagaccacaggagcagaagagcattcaccagctatgtttgactttagcatcca

SEQ ID NO: 24793 - DNA, 332 bp, Homo sapiens
  DISO7_00049273
  Located on chromosome 20
  Distance between a terminus base of telomere on chromosomal short arm and 5'-terminus of this base sequence : 46978728
  Distance between 3'-terminus of neighbour sequence of sequence listing upward to telomere on chrosomal short arm and 5'-terminus of this base sequence : 253628
cagcacctgcctacaatgaacacacacacacacacacacacacacacacacgcacacacttacagaggcactcacaggcaaacacacatgcatacacacgcacacacagaggcactcacaggcaaacacacatgcatacacacacacgcacagacttacagcgggactcacaggcaaacacacacatgcatacatatacacacacacacacacacacacacacacacacacacacacacacacacagtcacaaacaagatttgtcccctctcccctaaaggagaaggggcaaaatgcagacatcaccacacgggacctttgaacagtgacaa

SEQ ID NO: 24794 - DNA, 385 bp, Homo sapiens
  HUMUT1521
  Located on chromosome 20
  Distance between a terminus base of telomere on chromosomal short arm and 5'-terminus of this base sequence : 47003431
  Distance between 3'-terminus of neighbour sequence of sequence listing upward to telomere on chrosomal short arm and 5'-terminus of this base sequence : 24371
cattcacttcagacctagcagaggttttggagacagataaagttgggttcaatggccagctccaccacttcctagctgggtgactttgaccaaagaccttaacttctctgggcttaggttgtctcagatgaacaatgggggtcaaacggtaccacttccttcttccttttttcctgcttccttcttctgcttccccttccttcttctacgtccccttccttcctcctttctttcctccttccttccttcttcttcttccttcttcctcattctttccttactctttccttccttccttcttccttccctccttcctccttccttcctccttccttccttcctccttccttccttcctactttcctgccttcctttttttgtcatt

SEQ ID NO: 24795 - DNA, 173 bp, Homo sapiens
  D20S176
  Located on chromosome 20
  Distance between a terminus base of telomere on chromosomal short arm and 5'-terminus of this base sequence : 47116008
  Distance between 3'-terminus of neighbour sequence of sequence listing upward to telomere on chrosomal short arm and 5'-terminus of this base sequence : 112192
cttgggacttgtcagcctccataatcacgagtcaactgcttattataaatctctttacacacacacacacacacacacacaccctattgggtctatctggagaatcttgacttaatacaaattttggtaccatttactggtaatgaggaagatccaaggggcagaagttaaga

SEQ ID NO: 24796 - DNA, 323 bp, Homo sapiens
  AL133342.14_95587
  Located on chromosome 20
  Distance between a terminus base of telomere on chromosomal short arm and 5'-terminus of this base sequence : 47293309
  Distance between 3'-terminus of neighbour sequence of sequence listing upward to telomere on chrosomal short arm and 5'-terminus of this base sequence : 177128
gctgaaccagaattcgaacccacgactttccaaaaattcttttgatttacagtgagctgcctctataaaagcacaagaggttgcaccacaaaacctgttgttatcagccccctacatttatcctttgggaccacagaggaggggtgtccgtgtgtgtgtgtgtgtgtgtgtgtgtgtgtgtgtgtgtgtgtgtgtgtagggggtgggtggtgtcgtgtgatttaggagagtgttcactatgactagcgttgtggcgggagtttgggagacatgatgaagaggaggaaagaccttcaccctcaggtcacttacaattaagccaa

SEQ ID NO: 24797 - DNA, 293 bp, Homo sapiens
  AL049537.48_13547
  Located on chromosome 20
  Distance between a terminus base of telomere on chromosomal short arm and 5'-terminus of this base sequence : 47322011
  Distance between 3'-terminus of neighbour sequence of sequence listing upward to telomere on chrosomal short arm and 5'-terminus of this base sequence : 28379
tagtaccaggaactgataaacaaagaagcaaacgacctcctcaccatctacagtctagccaggtgatggtgggggggggggcggagagagaaagagagagagagagagagagagagagagagtgtgtgtgtgtgtgtgtgtgtgtgtgtgtgtgtgtggtcagaggatgtcggatgtcagatatcccaactctaaggaattctgagatgtgtaaaagggattgttttgcccaaaggaggttttcaggctctgaaaagaataaaatcccaggataactgctttaatggaggcac

SEQ ID NO: 24798 - DNA, 408 bp, Homo sapiens
  AL133174.15_18395
  Located on chromosome 20
  Distance between a terminus base of telomere on chromosomal short arm and 5'-terminus of this base sequence : 47517330
  Distance between 3'-terminus of neighbour sequence of sequence listing upward to telomere on chrosomal short arm and 5'-terminus of this base sequence : 195026
acttgtttctgtaatgttgcatgagaaatttcaagttctcttaagtctatttgtaccatctagtcatttaagggctttttgttgttgttgttgttgttgttgttgttgttgttgttgttggttttgacacagtaatgggaatactacattttacgttattactttggcttaagtggtcgttggtagaaagatactgaaatattactgaagccatttttaagccacaatttatttggaaagtctgggacaacagggaattgctagtgatggtttctgtatgtttttcactcacatgagctccttaagtatttatttggctttgctcttcctgaagctgcttgtgaacagtcagtcagataccgttctggaggctgcttgattcaacatcttaaactcagatcgagttcg

SEQ ID NO: 24799 - DNA, 256 bp, Homo sapiens
  AL035685.21_15485
  Located on chromosome 20
  Distance between a terminus base of telomere on chromosomal short arm and 5'-terminus of this base sequence : 47767559
  Distance between 3'-terminus of neighbour sequence of sequence listing upward to telomere on chrosomal short arm and 5'-terminus of this base sequence : 249821
catttctgagagttgcttgaaggctgggagggcctggtgatgctacctaagtgtgtgtgtgtgtgtgtgtgtgtgtgtgtgtgtgtgtgtgtgtgtagtgtctgggctgtgtggagccaagctgcctgggtctgaatctcagctttgcctcttctgtgccgtggcattttgggcaagtgagttaatctctcggtgccttagttccctctaatgtaaaataaggtggacagtagtacctcataggactgttatgagg

SEQ ID NO: 24800 - DNA, 361 bp, Homo sapiens
  AL035685.21_33169
  Located on chromosome 20
  Distance between a terminus base of telomere on chromosomal short arm and 5'-terminus of this base sequence : 47784997
  Distance between 3'-terminus of neighbour sequence of sequence listing upward to telomere on chrosomal short arm and 5'-terminus of this base sequence : 17182
agcaccataagacagccagccagggatgggggacagcgtggattgctccttggctggcctggggaagggtagcatgagtctcatcccaatgtggtgcctggtaggccactggggatgggttggattggtgactgacagtcattaaaatgttccaagacggagccggaaggaagcagacttgtctcttggacaccccctctgagagctccaaagcccagaagttgcattcctgctaattgtgctgcatgcctttgcctcagtggcttgagcttatatccagagtgttgaaaccacctacacacacacacacacacacacacacacacacacacacacacactccaagaaacaaagaggaatt

SEQ ID NO: 24801 - DNA, 362 bp, Homo sapiens
  AC027023.2_120122
  Located on chromosome 20
  Distance between a terminus base of telomere on chromosomal short arm and 5'-terminus of this base sequence : 47831541
  Distance between 3'-terminus of neighbour sequence of sequence listing upward to telomere on chrosomal short arm and 5'-terminus of this base sequence : 46183
gttcagtaatctgtccatttgttcatctgttatctatccatccatccatccatccatccatccatccatccatccatccattcggcaagcatttatggagagcctgtggcagattctggggatgcaaaaactaaataaactcaatctatcccctcaagaagcccagagccccttcagcagagtaagcacctaagttgctttatgaaacataacagaaatcatagagttcaaattccactctgccactttgctcatatgacctcaagatagtgactttttacccctttgaaccttaactttctcatgaatacaatggagatgataatctctgcctctgaagattcgatgagatcagaaaggta

SEQ ID NO: 24802 - DNA, 147 bp, Homo sapiens
  chr20.fa.O7frz.52236206
  Located on chromosome 20
  Distance between a terminus base of telomere on chromosomal short arm and 5'-terminus of this base sequence : 48084444
  Distance between 3'-terminus of neighbour sequence of sequence listing upward to telomere on chrosomal short arm and 5'-terminus of this base sequence : 252541
gttatgatcatgtcactgcactccagcctgggtaacacagcaagaccctgtctctcaaaaagggggggtgggggggtagtagtaataataataataataataataataataataataataataatgaagaaacatcaagtcctaagg

SEQ ID NO: 24803 - DNA, 264 bp, Homo sapiens
  chr20.fa.O7frz.52345802
  Located on chromosome 20
  Distance between a terminus base of telomere on chromosomal short arm and 5'-terminus of this base sequence : 48194066
  Distance between 3'-terminus of neighbour sequence of sequence listing upward to telomere on chrosomal short arm and 5'-terminus of this base sequence : 109475
attcgtggataaacaagataaacaagatgtatacattttcctgtgtgcttgcagctacacacacacacacacacacacttgtgcatgcatttggacacacaaacactggggccagagagaggcccagcctccccttagacacattgttgtccaatgtcccccacccccagttggggttctgtaagtaaaaaagaaggaacaggatgagtattcaacaggcaacctttaggttttccatggacctcacctcatttgatagacaga

SEQ ID NO: 24804 - DNA, 480 bp, Homo sapiens
  chr20.fa.O7frz.52433585
  Located on chromosome 20
  Distance between a terminus base of telomere on chromosomal short arm and 5'-terminus of this base sequence : 48281744
  Distance between 3'-terminus of neighbour sequence of sequence listing upward to telomere on chrosomal short arm and 5'-terminus of this base sequence : 87414
attgtcattagtgttcatcttgtttttctccctcattagcctgaggggaggagctccttaagggcagcagctttgctctcatctctgaaccccagaaaataacagtacctgggacaaagtaggtgaacaataaacgtttggctgactgaatgaatgatggtatgaatgaatgaatgaatgagcgaataagcaagaaatgttttaagttaatttctaagaactttgtgtatataacattttaatttatttctgttttctttcatttcctagcacagctgaaggtttaacaagaaaaaatatgtcagatgtcagtgggtggcaaacatttttacaagcccttgactacttcctcaaaatgttctttggctctgcagcgctcggcactctcactggcttaatttctgcattaatatccttttaatgtgatgaacatgcagggttaaaattattcctgataacttctgtctctagccagtttct

SEQ ID NO: 24805 - DNA, 464 bp, Homo sapiens
  chr20.fa.O7frz.52684532
  Located on chromosome 20
  Distance between a terminus base of telomere on chromosomal short arm and 5'-terminus of this base sequence : 48532566
  Distance between 3'-terminus of neighbour sequence of sequence listing upward to telomere on chrosomal short arm and 5'-terminus of this base sequence : 250342
gtctagttcctatctagatcctcaccacatctccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcattcattcattcaaccaaacaaacaaacattaagcacctactatgtaccagacactgtgctaggcgctggggatggatagacatctctgaagaagcaaatccctgctttcagggacttacattctagtcgtagacagcaagtaaat

SEQ ID NO: 24806 - DNA, 235 bp, Homo sapiens
  chr20.fa.O7frz.52776843
  Located on chromosome 20
  Distance between a terminus base of telomere on chromosomal short arm and 5'-terminus of this base sequence : 48625110
  Distance between 3'-terminus of neighbour sequence of sequence listing upward to telomere on chrosomal short arm and 5'-terminus of this base sequence : 92080
actttcgcttcagtaatgtttaaaagaaaaatgctaatctagatagggactgccattcattcattcattcattcatttatattcctcttaacaacttgtgactttgggcatgtggcttaacttctcggttcctcagtttcctgtttacaaaataatgatggtaataatagtacctatctcacaagatgtggagaggattaatggagatgataggtgcaaagtgcttagaatactg

SEQ ID NO: 24807 - DNA, 258 bp, Homo sapiens
  AL161660.11_222664
  Located on chromosome 20
  Distance between a terminus base of telomere on chromosomal short arm and 5'-terminus of this base sequence : 48726646
  Distance between 3'-terminus of neighbour sequence of sequence listing upward to telomere on chrosomal short arm and 5'-terminus of this base sequence : 101301
gtgctcctataaataccatgctcagtgcgtggaggaagcagcttatcaaggccaactagcattttttttattattattattattattattattatcaccactgtcatttcctggctttgtggcctcaggcatcacttgcttcactgtgcctcagttttctcctctgtgagatggggtaatagtcccaccttcgaagagttgccatgaggactgagcctgacgcatgtaaatgagcctggagcagagtaggtactctgt

SEQ ID NO: 24808 - DNA, 399 bp, Homo sapiens
  AL161660.11_26902
  Located on chromosome 20
  Distance between a terminus base of telomere on chromosomal short arm and 5'-terminus of this base sequence : 48842008
  Distance between 3'-terminus of neighbour sequence of sequence listing upward to telomere on chrosomal short arm and 5'-terminus of this base sequence : 115104
cacttgagatcaggagttcaaggccagactggctaacatggtgaaacctcgtgtccactaaaaatacaaaaattagctaagtgtggtggcacatgcctataatcccagacacttgggaggctgaggcaggagaattgtttgaacccaggatggggaggctgcagtgagccgagatcacgccactgcactccagcctgggcgacacagacagactccatctctaaataaataaataaataaataaataaataaataaatgaaagtctggaaggagggtggggctctcgtgttctgggaggatgatttatgaagaactttgaccccaaatccctgggaggggcctgtggccaatcccagacaagcagggcctggctctccttggacagtgtttacaagctc

SEQ ID NO: 24809 - DNA, 324 bp, Homo sapiens
  AL034429.1_87089
  Located on chromosome 20
  Distance between a terminus base of telomere on chromosomal short arm and 5'-terminus of this base sequence : 48872235
  Distance between 3'-terminus of neighbour sequence of sequence listing upward to telomere on chrosomal short arm and 5'-terminus of this base sequence : 29828
tagaattcaggacagccattaaccttgggggtggtggtggggaggatttaccaggagagacatcaagggggcttctggaatgtcctgtgtacatctgggtgctcattccacgaatgtgtccacttggcgagaattcactgagctctttatgtataatgtgtgtacttttccttgcaattaaaacacacatacaaacacacgcagatgcatgcgtgcgcgcgcgcgcgcgcacacacacacacacacacacacacacacacacacacacacacacagtgttcttagagcgcaggctgtcctgtctggaaatacatgtttaatgct

SEQ ID NO: 24810 - DNA, 429 bp, Homo sapiens
  AL034429.1_78899
  Located on chromosome 20
  Distance between a terminus base of telomere on chromosomal short arm and 5'-terminus of this base sequence : 48880474
  Distance between 3'-terminus of neighbour sequence of sequence listing upward to telomere on chrosomal short arm and 5'-terminus of this base sequence : 7915
gttcatagcaattcatagccacttgtgtttgatgaatttccagtgtactcagagtgatttttttcactgactatcaacaaataattttgctgcaaagaaatacagatatgggaaaggatgcacaatatattatcaaatgaccacaggcctcagaaacattgtatacaaacactctatctgtgtgtgtgtgtgtgtgtgtgtgtgtgtgtgtgtgtgtgtgtgtgtgcgcgcgcgcgcgcagagagagagagagaatcttggttgttaaccagcctggagtgaacacgactcactgcagcctccacctcctaagctcaagcaatcctcccacctcaaccttccaagtagttgggactacaggcacctgccatcatatttagtagagacagggttttaccatgttgcccagactggtttcaaactcctgga

SEQ ID NO: 24811 - DNA, 398 bp, Homo sapiens
  AL034429.1_34148
  Located on chromosome 20
  Distance between a terminus base of telomere on chromosomal short arm and 5'-terminus of this base sequence : 48925385
  Distance between 3'-terminus of neighbour sequence of sequence listing upward to telomere on chrosomal short arm and 5'-terminus of this base sequence : 44482
gacagaacaagactctaactcaaacaaaacaaaacaaaacaaaacaaaacaaaacaaaacaaaacaggctactccagtcactgggcagcaccccctgcaggcgtgagggccacttgggcttgggatgggcatttatttacttacttagcttgacatacagggacaggaatgaaccagccctgtttttgttccaggatgctctcaggattgtgagttccagacaaaccagaacccaaaaagtataagggtttaagggcgggaggagcacaggagtctggacagtcacttaaaggaactaagacttcaattaggtagcttccaagtgtggcagctcccacagttttcactggaatgggcatttttgttaatttttcccctatggaatgctcactttctaa

SEQ ID NO: 24812 - DNA, 233 bp, Homo sapiens
  DISO7_00000022
  Located on chromosome 20
  Distance between a terminus base of telomere on chromosomal short arm and 5'-terminus of this base sequence : 49256897
  Distance between 3'-terminus of neighbour sequence of sequence listing upward to telomere on chrosomal short arm and 5'-terminus of this base sequence : 331114
ggtattaacgctgggagcgtaaaattggaatcggctggaggaaggggagtcggcactttcgtctgagttttacaagcatatgtgctggctgagccaggcctctgaggctagagcccttggcatatgcttcctggcccatttcccacccacccacctctacacacacacacacgcacacatctgcacatacacacacacacacacacacacatgacgtggctgattcagccttt

SEQ ID NO: 24813 - DNA, 218 bp, Homo sapiens
  AL034553.12_61534
  Located on chromosome 20
  Distance between a terminus base of telomere on chromosomal short arm and 5'-terminus of this base sequence : 49359013
  Distance between 3'-terminus of neighbour sequence of sequence listing upward to telomere on chrosomal short arm and 5'-terminus of this base sequence : 101883
cgcaatcagagatcttaatcatatcacaaatgactctttagccttagggtatagcctcccctctctttcatccccaagttcagctctccagtctatttgcattttagttctagagaggcttcatttttctttttgactgtcaacagccaggtcctaatttgtgtgtgtgtgtgtgtgtgtgtgtgtgtgtgtgtgtgtcaattctcacatttaaggac

SEQ ID NO: 24814 - DNA, 282 bp, Homo sapiens
  D20S869
  Located on chromosome 20
  Distance between a terminus base of telomere on chromosomal short arm and 5'-terminus of this base sequence : 49359150
  Distance between 3'-terminus of neighbour sequence of sequence listing upward to telomere on chrosomal short arm and 5'-terminus of this base sequence : -81
tgtcaacagccaggtcctaatttgtgtgtgtgtgtgtgtgtgtgtgtgtgtgtgtgtgtgtcaattctcacatttaaggacctagattttcctgcattaagcaaaggacccaagaatcaacattatttagtggaaaaaagtatcaactagtagaaattattaagtaatgtttggggggcttgggggtcactaaagtagatgcaggggcattttatagtttcagagattaaaaaaaaaaatctggcaagttttgtcatttgccatggtcagtcacacaaagca

SEQ ID NO: 24815 - DNA, 345 bp, Homo sapiens
  AL034553.12_100811
  Located on chromosome 20
  Distance between a terminus base of telomere on chromosomal short arm and 5'-terminus of this base sequence : 49398251
  Distance between 3'-terminus of neighbour sequence of sequence listing upward to telomere on chrosomal short arm and 5'-terminus of this base sequence : 38819
ctcagctgaactgttaaagtcacctcctctctggtctcttgttcccagagggaacgtgttaacacctcaggggtatctttttacgcctgtgctgaaaatgccccccttctggcctgctgcaatggctcatgcctgtgactcccgcttgaggccaggagtttgagatcagcctgtgcaacatagcgagaccccatctctacacacacacacacacacacacacacacacacacacacacacacacatgattacctaggcatggtggtgcatgcctgtggcctcagctgctcagggggctgatgccagaggattgcttgagcctgggagttggaggctgcagtaatc

SEQ ID NO: 24816 - DNA, 346 bp, Homo sapiens
  AL121915.8_24412
  Located on chromosome 20
  Distance between a terminus base of telomere on chromosomal short arm and 5'-terminus of this base sequence : 49543082
  Distance between 3'-terminus of neighbour sequence of sequence listing upward to telomere on chrosomal short arm and 5'-terminus of this base sequence : 144486
aagttgcagtgagtcgagatcatgccattgcactgcagcctggacaacaagagtgaaactctgtcttaaataaataaataaataaataaataaataaataaataaatagctagctagctttggggcctgaacctgacttctcctaaaactgttggtctgctatgttactttcaaccccttcctatagcaatttgtgaaataagtcatttctctaattaaaaaaccaaccaactaaccaacaggatgcctagttaaattagaaatgtagctacacaatgaataacattgcatgatacagtaaaaaaaaaaaattacttattgtgtacctgaaattcaaatttacctg

SEQ ID NO: 24817 - DNA, 309 bp, Homo sapiens
  AL035457.13_112789
  Located on chromosome 20
  Distance between a terminus base of telomere on chromosomal short arm and 5'-terminus of this base sequence : 49683106
  Distance between 3'-terminus of neighbour sequence of sequence listing upward to telomere on chrosomal short arm and 5'-terminus of this base sequence : 139678
accatcagatctcatgagacttattcactatcacgagaacagcacaggaaaacccgcccccatgactcagttacctcccactgggtccctcccacgaaacatgcaaaacatggggattatgggagttacaattcaagatgagatttgggtgagaacacagccaaaccatatcacttactgtgtgtgtgtgtgtgtgtgtgtgtgtgtgtgtgtgtgtgtgtgtgtgtgtgagagagagagagagagtgagagattgagagattgagaatgtgactgatagctgtcatataactatggattctgcaatgc

SEQ ID NO: 24818 - DNA, 266 bp, Homo sapiens
  AL035457.13_118769
  Located on chromosome 20
  Distance between a terminus base of telomere on chromosomal short arm and 5'-terminus of this base sequence : 49689193
  Distance between 3'-terminus of neighbour sequence of sequence listing upward to telomere on chrosomal short arm and 5'-terminus of this base sequence : 5778
ccttaacctttctagacctcagttttcacatctgtccaatgggaatatttatagactatatcccataagcctgtgtgtgtgtgtgtgtgtgtgtgtgtgtgtgcacgtgtgtgtgtgtgtgcatagtgaaatactctgtatatcttcattgttattcttctttccgtccttcctaattgggaagcaagactttgatttatcagtagcttcctgaccatctgactcagtgcccagcatgtaggaggtgctcagtgagcaatagtttc

SEQ ID NO: 24819 - DNA, 409 bp, Homo sapiens
  20_49715039
  Located on chromosome 20
  Distance between a terminus base of telomere on chromosomal short arm and 5'-terminus of this base sequence : 49795825
  Distance between 3'-terminus of neighbour sequence of sequence listing upward to telomere on chrosomal short arm and 5'-terminus of this base sequence : 106366
aggaccattagtaattctgaaatgtctttcagaaaaagcacgtgtgtttgtgtgtgtgtatacagtgtgcaggtatgcagtacgtatgtgtattcagatgtgtgtgtatacagtgtgcatgtatgcagtatgtatgtgtatacagatgtgtgtgtgtatacagtgtgcgtgtatgcagtatgtatgtatatgcagatgtgtatacagcatgtgtatatgcagtatgtgtgtttgcattgtggatgtgtgtgtttgtatgcagtgtgtgtatgcagtatgtgtgtatgcagtgtgaatttatgtcattgtgtgtgtatgagtttatgtcattgtgtgtgtgtgtgtgtgtgtgtgtgtgcgtgtgtgtggtcatcccatgaatgggacgcacaggtctgcactttgcgtt

SEQ ID NO: 24820 - DNA, 209 bp, Homo sapiens
  AL132866.29_8209
  Located on chromosome 20
  Distance between a terminus base of telomere on chromosomal short arm and 5'-terminus of this base sequence : 49896546
  Distance between 3'-terminus of neighbour sequence of sequence listing upward to telomere on chrosomal short arm and 5'-terminus of this base sequence : 100312
agattcctagaaacctgtgaaatatttaaaatatatatatatacacatatatatatacatatgtgtgtgtgtgtctatatatatatatatatatatatatatatatatatatatatatataaaataacaagagacaaaaggacattggtctagagtttgatgatgtgttcctgtcttgtcattgagtggagaaacactagacaaatcat

SEQ ID NO: 24821 - DNA, 302 bp, Homo sapiens
  AL132866.29_22552
  Located on chromosome 20
  Distance between a terminus base of telomere on chromosomal short arm and 5'-terminus of this base sequence : 49910746
  Distance between 3'-terminus of neighbour sequence of sequence listing upward to telomere on chrosomal short arm and 5'-terminus of this base sequence : 13991
catgtaacagagttcctggaactttaaaaatcagctctcacaaggccacgaaaacgggctccaggacactcctgggcacccataggtctctgtgtgcatctgtttaggtgcataactactcagattgcagtctgcccatctcttactctcttctcccattgattttcacatctgctcgttgagaacagccccacccccaccaacacacacatacacatacacacacacacacacacacacacacacacacacacacacaccccttgccccagccctactccctgtgaaagcttatgaggacc

SEQ ID NO: 24822 - DNA, 216 bp, Homo sapiens
  D20S857
  Located on chromosome 20
  Distance between a terminus base of telomere on chromosomal short arm and 5'-terminus of this base sequence : 49910819
  Distance between 3'-terminus of neighbour sequence of sequence listing upward to telomere on chrosomal short arm and 5'-terminus of this base sequence : -229
gggcacccataggtctctgtgtgcatctgtttaggtgcataactactcagattgcagtctgcccatctcttactctcttctcccattgattttcacatctgctcgttgagaacagccccacccccaccaacacacacatacacatacacacacacacacacacacacacacacacacacacacacaccccttgccccagccctactccctgtgaaa

SEQ ID NO: 24823 - DNA, 212 bp, Homo sapiens
  HUMUT7073
  Located on chromosome 20
  Distance between a terminus base of telomere on chromosomal short arm and 5'-terminus of this base sequence : 50245359
  Distance between 3'-terminus of neighbour sequence of sequence listing upward to telomere on chrosomal short arm and 5'-terminus of this base sequence : 334324
aaactctggaacctgggaggcggaggttgcagtgatccgagatcgcaccactgcactccagcctgggagacagagtgagactccatctcaaacaaacaaaaacacagagagagagagagagagagagattatgactgtcttggtaccagcagatgttgctttgtaatcaccaagtggggagagggggtggcagcctgtcttacacacctgga

SEQ ID NO: 24824 - DNA, 373 bp, Homo sapiens
  AL034420.16_61695
  Located on chromosome 20
  Distance between a terminus base of telomere on chromosomal short arm and 5'-terminus of this base sequence : 50257899
  Distance between 3'-terminus of neighbour sequence of sequence listing upward to telomere on chrosomal short arm and 5'-terminus of this base sequence : 12328
gatgacttgctgaaggatacagagctcattacagtggaggttcagggtctgagctctagaaaagatgctccaccctatgaaggaaaaggttcattggtattatctatctatctatctatctatctatctatctatctatctatatatttttttctgggatggagtctcactctgttgcccaggctggagtgcagtggtgcgatctcagctcactgcaaactctgcctcccgggtttaagctattctcctgcctcagcctcctgagtagctgggattacaggtgtgtgccaccacacctggctaatttttgtatttttagtagagacggggtttcaccatgttggccaggctggtctcaaactcctgacctcag

SEQ ID NO: 24825 - DNA, 371 bp, Homo sapiens
  AL035072.16_5452
  Located on chromosome 20
  Distance between a terminus base of telomere on chromosomal short arm and 5'-terminus of this base sequence : 50365678
  Distance between 3'-terminus of neighbour sequence of sequence listing upward to telomere on chrosomal short arm and 5'-terminus of this base sequence : 107406
gctgcagagttgtagaagtcacagggagatggcaatgtccagaggcaaaaagaaaagtcccagccttctgtccctttttaagggtgaagaaaaccttccctgaaggcctctcaaccactctccctcatatcttgttggtcaaagttgcatcacatacctattcctaactcacaacttggcaagaaattgagattgccctggtgggctcacatccaagggaacatgggtgtgtgtgtgtgtgtgtgtgtgtgtgtgtgtacatgcttacatatctaacattaatataaaagacattttattccagtgtattctgatttggttagtagttagtagtttcctttggcaatcttacactagtgagctgaacatca

SEQ ID NO: 24826 - DNA, 154 bp, Homo sapiens
  D20S845
  Located on chromosome 20
  Distance between a terminus base of telomere on chromosomal short arm and 5'-terminus of this base sequence : 50365845
  Distance between 3'-terminus of neighbour sequence of sequence listing upward to telomere on chrosomal short arm and 5'-terminus of this base sequence : -204
ctcacaacttggcaagaaattgagattgccctggtgggctcacatccaagggaacatgggtgtgtgtgtgtgtgtgtgtgtgtgtgtgtgtacatgcttacatatctaacattaatataaaagacattttattccagtgtattctgatttggtt

SEQ ID NO: 24827 - DNA, 293 bp, Homo sapiens
  AL035072.16_59330
  Located on chromosome 20
  Distance between a terminus base of telomere on chromosomal short arm and 5'-terminus of this base sequence : 50419582
  Distance between 3'-terminus of neighbour sequence of sequence listing upward to telomere on chrosomal short arm and 5'-terminus of this base sequence : 53583
gtggctaacacggtgaaaccccgtctctactaaaaaatacaaaaaattagccaggcgtcgtggcgggcgcctgtagtcccagttactcgggaggctgaggcaggagaatggcgtgaacccgggaggcggagcttgcagtgagcccagatcgcgccactgcactccagcctgggcgacagagcgagactccgtctcaaaattaaataaataaataaataaataaataaataaataaataaataaataaataaataaatgtgtctgtaaaatgtgaattcttttgccatctagat

SEQ ID NO: 24828 - DNA, 303 bp, Homo sapiens
  AL035072.16_74238
  Located on chromosome 20
  Distance between a terminus base of telomere on chromosomal short arm and 5'-terminus of this base sequence : 50434627
  Distance between 3'-terminus of neighbour sequence of sequence listing upward to telomere on chrosomal short arm and 5'-terminus of this base sequence : 14752
ttagattgctaacctatcctttgtgtttaaaaatttttaacaaaaacctcacacactgatactacacacacacacacacacacacacacacacacacacactcctacaatctgttggaaatatttctaaaggaccaccttgggtcaggaaaaaaacatgctttggctgcttggtttgaataagtggtataattgctatttgtctatttttaaaattccaattcttattgaattaggcacacggaccctgatgaagctgcaggaaacagctgaactacttgtgtggctaatttcagaaattcaa

SEQ ID NO: 24829 - DNA, 208 bp, Homo sapiens
  D20S893
  Located on chromosome 20
  Distance between a terminus base of telomere on chromosomal short arm and 5'-terminus of this base sequence : 50561397
  Distance between 3'-terminus of neighbour sequence of sequence listing upward to telomere on chrosomal short arm and 5'-terminus of this base sequence : 126467
gtgagccgagattacgccactgcactccagcctaggcgacagagtgagacttcatcacacacacacagacacacacacacacacacacacacacacacacacacacacaaattgcttaatgggtaaaatgtacattatttgggtgatagttacattaaaagcccagatttcacctctatgcaatatatccatgtaacaaaactgcatg

SEQ ID NO: 24830 - DNA, 244 bp, Homo sapiens
  D20S839
  Located on chromosome 20
  Distance between a terminus base of telomere on chromosomal short arm and 5'-terminus of this base sequence : 50824339
  Distance between 3'-terminus of neighbour sequence of sequence listing upward to telomere on chrosomal short arm and 5'-terminus of this base sequence : 262734
tgcccatcagtgattaggactttgctttcaattgtgatcttcagtctttattaactgcaacccacagtaagaaacaattttacatcatgatgtattatatgtgttcaacacacacacacacacacacacacacacacacacacaaaacaaaagtttcatggaataaaatttgccatgacaggatgtcatgcactcatattttctattctatttgtcattaaaaatgttctggtcacagttcacc

SEQ ID NO: 24831 - DNA, 288 bp, Homo sapiens
  AL109610.7_8354
  Located on chromosome 20
  Distance between a terminus base of telomere on chromosomal short arm and 5'-terminus of this base sequence : 50850176
  Distance between 3'-terminus of neighbour sequence of sequence listing upward to telomere on chrosomal short arm and 5'-terminus of this base sequence : 25593
ccagcatctaaatctatttgctttgcctcttcctctcccagtctcttattggatgggaaaaaatcttgctctaccttatcatatgttcatatatatatatatatatatatatatatatatatatatatatataaaacctcaaaattttgggctcaagcaatcttcctgcctcagcctcccaagtagctcggattacaggcacataccaccatgcccagcttatttgttgtattagtctgttttcacactgctataaagaaatgcctgagactgcgtaatttataaagg

SEQ ID NO: 24832 - DNA, 252 bp, Homo sapiens
  D20S833
  Located on chromosome 20
  Distance between a terminus base of telomere on chromosomal short arm and 5'-terminus of this base sequence : 50853900
  Distance between 3'-terminus of neighbour sequence of sequence listing upward to telomere on chrosomal short arm and 5'-terminus of this base sequence : 3436
ccaaggggatttgctttttgttagggactttcaaagtcttttctgtggtttattttcttctgactctaatacttatataggtttttcatcaaaatttggcaactaatgaaaatgtatgtttgagcatcacttattgagcatcacttttactcagaaatgtgcaaattattaaatatgagcatgtgtgtgtccatctacataacacacacacacacacacacacacacacacagaggcactcacccagtcacc

SEQ ID NO: 24833 - DNA, 386 bp, Homo sapiens
  AL049765.16_40792
  Located on chromosome 20
  Distance between a terminus base of telomere on chromosomal short arm and 5'-terminus of this base sequence : 50916597
  Distance between 3'-terminus of neighbour sequence of sequence listing upward to telomere on chrosomal short arm and 5'-terminus of this base sequence : 62445
aggtcttccttagaattcctgtagtttcctctaaaaatagtggaaatactttgaaaaggaggaaaatttgcagtgggatctcgaaagagctcacagagattgatccttaagagaatctggaggatgcagaggtgtgtgtgtgtgtgtgtgtgtgtgtgtgtgttcacacgtgtgaggttgattttggaaaagacacgggtagaaataagtcctatgtaagagaagcaaagccttttgacagaaatatcagtagttgctaatttaaaagcaaccaactaaccaataaagtaaccctttaacccctaacactattagagattattccaagttagaaatcttgaattcaactttatagtacctcctagtagcaattctgaatcagcttc

SEQ ID NO: 24834 - DNA, 100 bp, Homo sapiens
  D20S877
  Located on chromosome 20
  Distance between a terminus base of telomere on chromosomal short arm and 5'-terminus of this base sequence : 50916710
  Distance between 3'-terminus of neighbour sequence of sequence listing upward to telomere on chrosomal short arm and 5'-terminus of this base sequence : -273
aatctggaggatgcagaggtgtgtgtgtgtgtgtgtgtgtgtgtgtgtgttcacacgtgtgaggttgattttggaaaagacacgggtagaaataagtcct

SEQ ID NO: 24835 - DNA, 205 bp, Homo sapiens
  AL049736.10_5736
  Located on chromosome 20
  Distance between a terminus base of telomere on chromosomal short arm and 5'-terminus of this base sequence : 51019118
  Distance between 3'-terminus of neighbour sequence of sequence listing upward to telomere on chrosomal short arm and 5'-terminus of this base sequence : 102308
agagtctttgcagatgtgattaagaatcatgagatggggagataaccctggattacccaggtgtgccctaaatgccatcgcaagtgtctttatgagagagtgatagagggaatttcacacacacacacacacacacacacacacacacacacgagaaggcaatgtgaagatggaggcagagatttgttatctggtcacaaactct

SEQ ID NO: 24836 - DNA, 281 bp, Homo sapiens
  AL049736.10_8419
  Located on chromosome 20
  Distance between a terminus base of telomere on chromosomal short arm and 5'-terminus of this base sequence : 51021803
  Distance between 3'-terminus of neighbour sequence of sequence listing upward to telomere on chrosomal short arm and 5'-terminus of this base sequence : 2480
ataccatgcactttatgaccagggctgccttttttaacttctctgagtctctctctctctctctctctctctctctctctctctctctctctctctctgtctgtctctgtctctgtgtgtgtgtgtgtgtgtgtgtgtgtgtgtgtgtgtgtgtgtgtgtgttttataagcctgccccaacaagcctatttactcagaatgtaaaacaaatttactgtagtatatcgactaaatacacatcgggtatcaattttatttgttgcaggaatgagtatactgtg

SEQ ID NO: 24837 - DNA, 240 bp, Homo sapiens
  Z67157
  Located on chromosome 20
  Distance between a terminus base of telomere on chromosomal short arm and 5'-terminus of this base sequence : 51067465
  Distance between 3'-terminus of neighbour sequence of sequence listing upward to telomere on chrosomal short arm and 5'-terminus of this base sequence : 45381
caaatatctcccagggcagagaaaatggaagtagaaatcaagttattgaaaaatcaacttaagtttgtgtgtgtgtgtgtgtgtgtgtgtgtgcacctgcgttgtaaacagggcatccttgcccactgtgctctgctgccagcccttcgaacaggctgtttccatggtcatttttaaaatgttgtcttgcaacatggtgaactgaggaattagcaaaaagaccgttaaaggagaataggc

SEQ ID NO: 24838 - DNA, 197 bp, Homo sapiens
  AL031674.1_37875
  Located on chromosome 20
  Distance between a terminus base of telomere on chromosomal short arm and 5'-terminus of this base sequence : 51124303
  Distance between 3'-terminus of neighbour sequence of sequence listing upward to telomere on chrosomal short arm and 5'-terminus of this base sequence : 56598
ttgtcatagatattcagtttgcagtgtctatgaattgttttgttttggaaaatgagatgtttggagaagaggtctatgtacgtgtgtgtgtgtgtgtgtgtgtgtgtgtgtgtgtgtgtgtattttccctgctccaagcatttcattcacctgattttgataagacagcctcaaaatttcggttaatgaatcatagc

SEQ ID NO: 24839 - DNA, 474 bp, Homo sapiens
  AL121902.13_20752
  Located on chromosome 20
  Distance between a terminus base of telomere on chromosomal short arm and 5'-terminus of this base sequence : 51288519
  Distance between 3'-terminus of neighbour sequence of sequence listing upward to telomere on chrosomal short arm and 5'-terminus of this base sequence : 164019
acatggtcaagtttggttaaaggccaaatgctgtgccagagagagaaaaggtgaggttgcacaggttgcaggactcagagaacagcaaatattgagggctgtggtaacaagtcagactttatcttgagggtactaggagtcattgaacaattgattggcctgcccttaagaacctcacacttggtgagctggtgtatcaatcagacatatatatacacacacacacacacacacacacacacacacaccctacagacactgaatcagtgacattgttcctaggggaattacataattaggttcctataagcctctggtcacatttttgccaactgatgaatatatgatcttgtacgatgtgtgtttatgttcaaagacaccttcttcagtatatattcttgattcattaacattgaacttacaaccaacagcactattactcatgccggaacaagcttacctggcatacctatt

SEQ ID NO: 24840 - DNA, 272 bp, Homo sapiens
  HUMUT1680
  Located on chromosome 20
  Distance between a terminus base of telomere on chromosomal short arm and 5'-terminus of this base sequence : 51364579
  Distance between 3'-terminus of neighbour sequence of sequence listing upward to telomere on chrosomal short arm and 5'-terminus of this base sequence : 75586
gatttcgtggctgccagagggatggtaaagtccagtctttcaactttttacagtggaaggtaaaggcacaatctctcacttactctacatgcaatgagagtttctctaacactggaaagagaaatacaaatgacaaagaaatgacaaggtctttgtcagagaaacagagccaacagggtagatagatgacagatgatagatagatagatagatagatagatagatagatagatagatagatagagatttattatgagaaattggctcgcgtg

SEQ ID NO: 24841 - DNA, 152 bp, Homo sapiens
  G08058
  Located on chromosome 20
  Distance between a terminus base of telomere on chromosomal short arm and 5'-terminus of this base sequence : 51364739
  Distance between 3'-terminus of neighbour sequence of sequence listing upward to telomere on chrosomal short arm and 5'-terminus of this base sequence : -112
gaaacagagccaacagggtagatagatgacagatgatagatagatagatagatagatagatagatagatagatagatagatagagatttattatgagaaattggctcgcgtgactatggaggctaggaaataaagcaaccttctgtctgcaa

SEQ ID NO: 24842 - DNA, 271 bp, Homo sapiens
  AL121902.13_128528
  Located on chromosome 20
  Distance between a terminus base of telomere on chromosomal short arm and 5'-terminus of this base sequence : 51396397
  Distance between 3'-terminus of neighbour sequence of sequence listing upward to telomere on chrosomal short arm and 5'-terminus of this base sequence : 31506
tgtttaaacatccttcagaaagacaagttcacatcttgaatatttaaatatctcacgcgatggattccttcacttgcccaaaagtatgtttttaacaaatgaatggaaaaatacacacacacacacacacacacacacacacacacacacacacacacacgcatggacacaataaagtccaaagggtcttagcagcacaaactcttttggccattcttgttacttaaggcagatatctgaaaaaggaaggatagattccttgaaatcgctt

SEQ ID NO: 24843 - DNA, 449 bp, Homo sapiens
  AL121902.13_152312
  Located on chromosome 20
  Distance between a terminus base of telomere on chromosomal short arm and 5'-terminus of this base sequence : 51420024
  Distance between 3'-terminus of neighbour sequence of sequence listing upward to telomere on chrosomal short arm and 5'-terminus of this base sequence : 23356
acttagaaagacagatgagcaaacctcagatggattcagaggtttggtggggaaatctgagaggctctctagttcagccaggagtggaagagggggacagccatctgataatgactgttgctattttaagacacagatagcagagatgaggagtagcgtgatgaaaactcacattaaaacaaccaagagaggcacaacaggaactctatgaaccccagagagacccggtctgggtttacaatgacaatgttgtgtgtgcgttcatgtgcgtgtgtgtgtgtgtgtgtgtgtgtgtgtgtgtgtgtgtgtgtgtgtgtgtttgggagggggtgctgatatttttttaaatgcagatggttttgttctctgtagttgaagcttcagttcagcagctctgagacaaacaggaaagcctgtgttattctctacaggaacacatcaaaggtagt

SEQ ID NO: 24844 - DNA, 204 bp, Homo sapiens
  AL121902.13_154362
  Located on chromosome 20
  Distance between a terminus base of telomere on chromosomal short arm and 5'-terminus of this base sequence : 51422217
  Distance between 3'-terminus of neighbour sequence of sequence listing upward to telomere on chrosomal short arm and 5'-terminus of this base sequence : 1744
aagcacttccagtatgaaatttagttcaccgtccaggtactgtccttcattgtggggagaaacatcctgcctgtctacctggggttctattttatttcatcagcctcctgtttttctccagggatggtgtgtgtgtgtgtgtgtgtgtgtgtgtgtgtgtgtgtgtgaaattttttcctaaatattaagtcagtgcaccttcct

SEQ ID NO: 24845 - DNA, 382 bp, Homo sapiens
  AL121902.13_160087
  Located on chromosome 20
  Distance between a terminus base of telomere on chromosomal short arm and 5'-terminus of this base sequence : 51427870
  Distance between 3'-terminus of neighbour sequence of sequence listing upward to telomere on chrosomal short arm and 5'-terminus of this base sequence : 5449
tacattccaagacctccagtagatgcctgaaacctcagatcataccaagtcttatacatattatgtttttcctatacaaatatacctgtgctaaagcttaacttataaattaagcacagtaagagattaacaacaataaaaaatagaacaattataataatatactctagtagaagttatttgaatgttgtctttctcctctctctctctctctctctctctctctctctctctctctctctctctctcaaaatatcttgtactggctgggcatggtggctcacacctataacaccaacaatttgggaggccaaagtaggaggattgcttgagcccaggagttcaagactagcctgaaaaaatagtgagaccaatcgctaca

SEQ ID NO: 24846 - DNA, 285 bp, Homo sapiens
  AL050316.15_31924
  Located on chromosome 20
  Distance between a terminus base of telomere on chromosomal short arm and 5'-terminus of this base sequence : 51470439
  Distance between 3'-terminus of neighbour sequence of sequence listing upward to telomere on chrosomal short arm and 5'-terminus of this base sequence : 42187
ttgtaccacttgtattcagaggaatgaatgtattttggtaaaaatgacttttgagtgggtaccaaatctaaagaaatattcttatcatattactctgtggcgcacgcacacacacacacacacacacacacacacacacacacaattcaggtggatttgcactggagccctgtaagtattcaagctcttttgctgtagagaactaaagaaaacatcaagatatcaagtagttttattgatttattccataatattttctggaacatattggcttgtctgagttac

SEQ ID NO: 24847 - DNA, 228 bp, Homo sapiens
  AL050316.15_50129
  Located on chromosome 20
  Distance between a terminus base of telomere on chromosomal short arm and 5'-terminus of this base sequence : 51488732
  Distance between 3'-terminus of neighbour sequence of sequence listing upward to telomere on chrosomal short arm and 5'-terminus of this base sequence : 18008
aaaggtcaatgctttgatacacacacacacacacacacacacacacacacacacacacacacacacgctcaagtttccatataacgagaggaaaagcaaagagacgccactggatgaggggagccattaatacagtgggtttgacagttggatgcttgaaaaaaagatgacttcttattaacatgcaattgtcaccatgttaataatgaaatattgatctgttcttgc

SEQ ID NO: 24848 - DNA, 218 bp, Homo sapiens
  D20S902
  Located on chromosome 20
  Distance between a terminus base of telomere on chromosomal short arm and 5'-terminus of this base sequence : 51553967
  Distance between 3'-terminus of neighbour sequence of sequence listing upward to telomere on chrosomal short arm and 5'-terminus of this base sequence : 65007
ggacgttcacactttatgccatgggaatatgacctgtttgtgacatttatactctttttctctccaggccatctctcccctgacaaagaaacacacacacacacacacacacatacatgcacatgcagacacacacacacacacacacacacacacaagggttgtggcactgcctttttattttttaatctatgtttgtgaaaatggcaagcatcctc

SEQ ID NO: 24849 - DNA, 398 bp, Homo sapiens
  AC004499.1_20091
  Located on chromosome 20
  Distance between a terminus base of telomere on chromosomal short arm and 5'-terminus of this base sequence : 51608986
  Distance between 3'-terminus of neighbour sequence of sequence listing upward to telomere on chrosomal short arm and 5'-terminus of this base sequence : 54801
catggtgaaacctcatgtctacgaaaaatacaaaaattagctgagcgtgatggcacatgcttgtagtgccagctactcaggaggctgaggtgggaggatcacccgagccagggcaggttgaggttgctatgagccatgatcatgccactgtactccagcctgggtgaccaaacaagaccctgtctcaaatatatatatatatatatatatatatatatatatatatatatatatatatattttcttaaatgcctctgtttctttttgtatatcgctatctgtgtttctgtgtgtttaggtctctctttctctttctttctctcattaaattaaaataaggatgagaatagattaccaggcaagctggcaaaatggctaagtaggttgtccaaccagtt

SEQ ID NO: 24850 - DNA, 172 bp, Homo sapiens
  AC004505.1_16477
  Located on chromosome 20
  Distance between a terminus base of telomere on chromosomal short arm and 5'-terminus of this base sequence : 51645185
  Distance between 3'-terminus of neighbour sequence of sequence listing upward to telomere on chrosomal short arm and 5'-terminus of this base sequence : 35801
gatggctcacagactaaatttaacacacacacacacacacacacacacacacacacacacacatgcacacaaacacaatgctaactcagctactaataaacccagtggccatgggagctttggggacaggcctaggatttgggtctcagccttgccgtattctgtcagtaac

SEQ ID NO: 24851 - DNA, 277 bp, Homo sapiens
  AC004505.1_17821
  Located on chromosome 20
  Distance between a terminus base of telomere on chromosomal short arm and 5'-terminus of this base sequence : 51646361
  Distance between 3'-terminus of neighbour sequence of sequence listing upward to telomere on chrosomal short arm and 5'-terminus of this base sequence : 1004
gtgcagcctctgtctatttataattatattttgtataaacatatttggtgactgtggaaaagacttcatgggcacacaatggcaagcgttcttcaaaactgtctttaattattcatttggctgtgctatattttatgtttgttttcataaatgttaatctttattattgccttagtaagtggggaggaaaacacacacacacacacacacacacacacacacacagagtaatacctgttattaaatgacctatcagagtgacatggataaatgttgg

SEQ ID NO: 24852 - DNA, 312 bp, Homo sapiens
  AL109930.8_1679
  Located on chromosome 20
  Distance between a terminus base of telomere on chromosomal short arm and 5'-terminus of this base sequence : 51705682
  Distance between 3'-terminus of neighbour sequence of sequence listing upward to telomere on chrosomal short arm and 5'-terminus of this base sequence : 59044
ggtgactaaagtaggaacatcaacggcttgagcccaggagtttgagaccagcctgaacaacacagtgaggtcctttctctacaaaaataatttatttttacttagtcaggtagggtagtgtgcacctgtagtcccagctacttgggaggatcacttaatcccaggagttcaaggctgcagtgagctatgattgtaccaatatacttcagcatgggtaacagagcaagaccctgtctcaaaaatacacacacacacacacacacacacacacacacacacacacgtaacacttctgaattgatgaccagatgc

SEQ ID NO: 24853 - DNA, 103 bp, Homo sapiens
  D20S883
  Located on chromosome 20
  Distance between a terminus base of telomere on chromosomal short arm and 5'-terminus of this base sequence : 51705888
  Distance between 3'-terminus of neighbour sequence of sequence listing upward to telomere on chrosomal short arm and 5'-terminus of this base sequence : -106
cagcatgggtaacagagcaagaccctgtctcaaaaatacacacacacacacacacacacacacacacacacacacacgtaacacttctgaattgatgaccaga

SEQ ID NO: 24854 - DNA, 140 bp, Homo sapiens
  D20S854
  Located on chromosome 20
  Distance between a terminus base of telomere on chromosomal short arm and 5'-terminus of this base sequence : 51799156
  Distance between 3'-terminus of neighbour sequence of sequence listing upward to telomere on chrosomal short arm and 5'-terminus of this base sequence : 93165
cttgaaggttgatggttggagagtgtgtgtgtgtgtgtgtgtgtgtgcacacgcatgtgtgttataaaaggtttatttaaaactgtggtaaattctttcataacagtgtttccaaaaatatgggactcctacctgcaata

SEQ ID NO: 24855 - DNA, 253 bp, Homo sapiens
  D20S183
  Located on chromosome 20
  Distance between a terminus base of telomere on chromosomal short arm and 5'-terminus of this base sequence : 51812538
  Distance between 3'-terminus of neighbour sequence of sequence listing upward to telomere on chrosomal short arm and 5'-terminus of this base sequence : 13242
tgcacataaaacagccagcagagtgtttgtaacatagtaggtaccaaacacattgtacctgttaatatcattattctgtttgttccaagcagtctgtatcttagtttcggtggtgattacataaatctatgcaagggacaaagttgcatagaactacacacgcaaacacacacacacacacacacacacacaaattgtaaaaactaaggtctgtagtctagttaacagtattgtaccaatgtcggtatcccgg

SEQ ID NO: 24856 - DNA, 402 bp, Homo sapiens
  AC011429.2_36821
  Located on chromosome 20
  Distance between a terminus base of telomere on chromosomal short arm and 5'-terminus of this base sequence : 51829317
  Distance between 3'-terminus of neighbour sequence of sequence listing upward to telomere on chrosomal short arm and 5'-terminus of this base sequence : 16526
tactttcactcagccttcaaaccaccagctccaccagcttcctcatcaaacttgctttctccaggcacatccctgagcagaattcacttaaaagttactgatgtaagaaaaaacagagcaaatcaaggcacctgtaagttatgccaaggcacctgtaagttatgaaaaaggtctcagtacgataacaaaatcggtggaggaggaggcatagcatttgaattaaatcaacttacaaaacacataactctctgggcttggcatacataacaacctaagaagaagtttgggaattctgttattatcgtcacattattattattattattattattattattattattattagctgtgttatatttatgaaaatgtaaaatccatggtattgatcataagcacctt

SEQ ID NO: 24857 - DNA, 289 bp, Homo sapiens
  AL157838.24_19297
  Located on chromosome 20
  Distance between a terminus base of telomere on chromosomal short arm and 5'-terminus of this base sequence : 51949701
  Distance between 3'-terminus of neighbour sequence of sequence listing upward to telomere on chrosomal short arm and 5'-terminus of this base sequence : 119982
catggagctatgagttcattaaacctcttctgcaaattgcccagtctctggtatgtctatcagcagcatgaaaatggactaatacagagggcaatattgcatttgcattgccatatggctgtcatcagtgacagctaagtagccataactcccatgaaatgggttgaagtctcctcatacccctcccaattctgtatgcacacacacacacacacacacacacacacacacacacacacacacacacacccctgagcccccctctggcctgcagttacctgaataagcc

SEQ ID NO: 24858 - DNA, 159 bp, Homo sapiens
  D20S840
  Located on chromosome 20
  Distance between a terminus base of telomere on chromosomal short arm and 5'-terminus of this base sequence : 51949852
  Distance between 3'-terminus of neighbour sequence of sequence listing upward to telomere on chrosomal short arm and 5'-terminus of this base sequence : -138
ccatgaaatgggttgaagtctcctcatacccctcccaattctgtatgcacacacacacacacacacacacacacacacacacacacacacacacacacccctgagcccccctctggcctgcagttacctgaataagccctggtgaggctggaatttgcc

SEQ ID NO: 24859 - DNA, 284 bp, Homo sapiens
  AL157838.24_40596
  Located on chromosome 20
  Distance between a terminus base of telomere on chromosomal short arm and 5'-terminus of this base sequence : 51971106
  Distance between 3'-terminus of neighbour sequence of sequence listing upward to telomere on chrosomal short arm and 5'-terminus of this base sequence : 21095
attaagatagcatcaggatcagagtgagggttttgtagcaaagtttttgtttggttttgttttgttatttggaatcaatggagcaaaagcaaacacacacacacacacacacacacacacacacaaacacacacagagcctttgaagtgagacacgcgtttgaattttggctctgccacctacaacctggaccacattgggtaaagctgtttagactctcgaatcctcagtttcccagctccttaagtacaggatctcatctgaccttcctcattaatactgaa

SEQ ID NO: 24860 - DNA, 140 bp, Homo sapiens
  D20S211
  Located on chromosome 20
  Distance between a terminus base of telomere on chromosomal short arm and 5'-terminus of this base sequence : 51971174
  Distance between 3'-terminus of neighbour sequence of sequence listing upward to telomere on chrosomal short arm and 5'-terminus of this base sequence : -216
ttggaatcaatggagcaaaagcaaacacacacacacacacacacacacacacacacaaacacacacagagcctttgaagtgagacacgcgtttgaattttggctctgccacctacaacctggaccacattgggtaaagct

SEQ ID NO: 24861 - DNA, 375 bp, Homo sapiens
  AL157838.24_126677
  Located on chromosome 20
  Distance between a terminus base of telomere on chromosomal short arm and 5'-terminus of this base sequence : 52057146
  Distance between 3'-terminus of neighbour sequence of sequence listing upward to telomere on chrosomal short arm and 5'-terminus of this base sequence : 85832
aaactcactatgactggagcagagtggatgaggtcagaaagcaaggatggaccagatcacgcacagtctttgctcctagcctgaggcagatgggagccatggcaggtgtgtgtgtgtgtgtgtgtgtgtgtgtgtgtgtgtgtgtgtgtgtgagagagagagatagggttttgctctgtcatccaggctggagcacagtggtgcaatcatagcttactgcagcctcaacctcctggcctcaagtgatcctcccacctcattctcccaagtagctgggactacagacatgagccaccatgcctggctaattttaaaatttcttgtagagatagtgtctgactacgttgcccaggctggtcttaaactcctgtcctc

SEQ ID NO: 24862 - DNA, 362 bp, Homo sapiens
  AC006076.1_1266
  Located on chromosome 20
  Distance between a terminus base of telomere on chromosomal short arm and 5'-terminus of this base sequence : 52208140
  Distance between 3'-terminus of neighbour sequence of sequence listing upward to telomere on chrosomal short arm and 5'-terminus of this base sequence : 150619
acatgcctgtagtctcagctacttgggaggctgaggcaggagaatcggttgaacccggggggcagaggttgcagtgagccaagatcacaccactgcacttcagcctgggcgacagagcgagactccatctcaaaaacagacaaaaaaatacacacacatatgcatattcacacacacacacacacacacacacacacacacacacgcttgtagatatcacagagaaagtcatattgccttttatttgcatttctttgctagtaatagttctttatgaaacatgagaaatttatgcacttaacaagaagtagtgggggagtagtagttaaagatagactctgcaatatgaggaatagtgagac

SEQ ID NO: 24863 - DNA, 256 bp, Homo sapiens
  D20S913
  Located on chromosome 20
  Distance between a terminus base of telomere on chromosomal short arm and 5'-terminus of this base sequence : 52303552
  Distance between 3'-terminus of neighbour sequence of sequence listing upward to telomere on chrosomal short arm and 5'-terminus of this base sequence : 95050
ctgctctaaggtcagagtgatgaacaagcaaaacgtggccttgggctttctaaattgggaagaaaaagtcaagggactctcctacaatatcgtgttctccaaggtgaccttctctccccaggtgggcttgttctaggttgtggacatgatccacatgctccagacctaggaacacacacacacacacacacacacacacacacacacattcacttaccttctccctagactagaaaccttgtaaacctacatatcg

SEQ ID NO: 24864 - DNA, 168 bp, Homo sapiens
  AC005220.1_121353
  Located on chromosome 20
  Distance between a terminus base of telomere on chromosomal short arm and 5'-terminus of this base sequence : 52326291
  Distance between 3'-terminus of neighbour sequence of sequence listing upward to telomere on chrosomal short arm and 5'-terminus of this base sequence : 22483
tgccatgactcaacattagttaagttcttgagtcatctgtgttgctaaattaaccaccaatgcaaagcacatgtaggcacgcacacaagcacacacgcacatgttacaacacacacacacacacacacacacacacacacacacacagctcagttctatgttgcattt

SEQ ID NO: 24865 - DNA, 336 bp, Homo sapiens
  AC005220.1_74417
  Located on chromosome 20
  Distance between a terminus base of telomere on chromosomal short arm and 5'-terminus of this base sequence : 52373085
  Distance between 3'-terminus of neighbour sequence of sequence listing upward to telomere on chrosomal short arm and 5'-terminus of this base sequence : 46626
tgacttaggcctgactaatcagagcattgtatatgattggccagctgtgattggctcagcatagccaaatgcagataacactggagctaatctcagagctttgctgaaatgagagagaggctggttccctttctgttagatctgaagctgtgaaaatgtaagactggagcttccagaaccaccaatatttctagggaaaatctccccgaaaaggaagccaacacagagaaaatcacagctgagaaatggagagagagagagagagagagagagagagagagagagagagggaccaggcattgatggtatcatgcgtgcctcctagatctagctgtt

SEQ ID NO: 24866 - DNA, 385 bp, Homo sapiens
  AL138805.8_11640
  Located on chromosome 20
  Distance between a terminus base of telomere on chromosomal short arm and 5'-terminus of this base sequence : 52528302
  Distance between 3'-terminus of neighbour sequence of sequence listing upward to telomere on chrosomal short arm and 5'-terminus of this base sequence : 154881
ataaaagccatgaggtatccacctcacacctgttaggatagcctttataaaagaaaaaaaaaaccacttgtgtgctgttggtgggaatgcaaaatggtgtgcagcttctatgaaaaatagtatggaagtttctggaaaaagtaaaactggaattaccatatggtccagtcatccacttctgggtttatttgttttaaacacatgcatgtgttcacacacacacacacacacacacacacacacacacacacacagcctttttcctttttagcttatttattttgtttcatatgaggaattgagaaagcaccatggggtactggagccatggtggtgatagctttctagaattatctgagactaactgtgtggtcagaggcatttc

SEQ ID NO: 24867 - DNA, 304 bp, Homo sapiens
  AL138805.8_18245
  Located on chromosome 20
  Distance between a terminus base of telomere on chromosomal short arm and 5'-terminus of this base sequence : 52534936
  Distance between 3'-terminus of neighbour sequence of sequence listing upward to telomere on chrosomal short arm and 5'-terminus of this base sequence : 6249
atagatgtttggtaagaaagcaagtttttcttttttaaattgtttgcctaagagggatataaggaaatgtctgtgttcgattttgcaatatgtgtgcgaaatgactttgcagtgagtcgtggaggtgatgaagttcagctggcaatcattggcagaccccgccgcccccccgccacccccactacacacacacacacacacacacacacacacacacacacacacacagttcccctgcttgggagctgtgacctttaactgagttcctgagattaaagtttagtcctagtttgaggctagacct

SEQ ID NO: 24868 - DNA, 156 bp, Homo sapiens
  Z66824
  Located on chromosome 20
  Distance between a terminus base of telomere on chromosomal short arm and 5'-terminus of this base sequence : 52545084
  Distance between 3'-terminus of neighbour sequence of sequence listing upward to telomere on chrosomal short arm and 5'-terminus of this base sequence : 9844
tcttcatgcttttggagttagaatgtatatatatatttataataattttattttcttcttaataaatagtgcggacatttggatcaaggaaaaggagtgtgtgtgtgtgtgtgtgtgtgtgtataatttttaaaaattgctggtaagatgtgtcaa

SEQ ID NO: 24869 - DNA, 220 bp, Homo sapiens
  chr20.fa.O7frz.55382802
  Located on chromosome 20
  Distance between a terminus base of telomere on chromosomal short arm and 5'-terminus of this base sequence : 52725114
  Distance between 3'-terminus of neighbour sequence of sequence listing upward to telomere on chrosomal short arm and 5'-terminus of this base sequence : 179874
ggaattagtaagcatctgtatcagtgaggattttccagagaaatagaatcagtacggggagataacaaatgatggatgatagatagatagatagatagatagatagatagatagatagatattcattgaatccaaggaattcatttatataattaagaaggttggtgtccttcttaattcgtctgttttcacactgctgataaagacatacctgagactg

SEQ ID NO: 24870 - DNA, 235 bp, Homo sapiens
  D20S120
  Located on chromosome 20
  Distance between a terminus base of telomere on chromosomal short arm and 5'-terminus of this base sequence : 52807981
  Distance between 3'-terminus of neighbour sequence of sequence listing upward to telomere on chrosomal short arm and 5'-terminus of this base sequence : 82647
ttttactaaggagactcaacagggtcctctagagatcttcaggaacatttcgggggtggaaatgtcatctgggtacatgcacatacatgcgtgcacgtgcacacacacacacacacacacacacacacacacacacacacacacacacgatcctgaaaggagaaataacttgcttaactctagaaatcgtggctctcatttactcagcactgattctcttccaggcattgtgcaa

SEQ ID NO: 24871 - DNA, 231 bp, Homo sapiens
  chr20.fa.O7frz.55546461
  Located on chromosome 20
  Distance between a terminus base of telomere on chromosomal short arm and 5'-terminus of this base sequence : 52888709
  Distance between 3'-terminus of neighbour sequence of sequence listing upward to telomere on chrosomal short arm and 5'-terminus of this base sequence : 80493
tttcttactccttacatagcacactgctgactccttttcaccaccatgtatagctatttacattgtttattttcttgtttattttttctctctcctaccgagacataagctccatggggactggaaccttttttatccgtttgtgtgtgtgtgtgtgtgtgtgtgtgtgcatgtttgcgtgtgccaaagtttattgtggacaatctttgctcatagcagatgctcaataag

SEQ ID NO: 24872 - DNA, 250 bp, Homo sapiens
  AL118501.22_8198
  Located on chromosome 20
  Distance between a terminus base of telomere on chromosomal short arm and 5'-terminus of this base sequence : 52961060
  Distance between 3'-terminus of neighbour sequence of sequence listing upward to telomere on chrosomal short arm and 5'-terminus of this base sequence : 72120
caccactagcaattcctatcactgtccttggtttatttcccttcgtggtgcatcacaccatgagacatattataagatacacacacacacacacacacacacacacacacacacacacgcatgtaagcatatatatcttattgattgtatgaaagcacaacaaagacagcagattttctcccttttgttcatagccatagcccctgtacctaaataatgcctggcacatggtaggcacctgataaatatt

SEQ ID NO: 24873 - DNA, 298 bp, Homo sapiens
  AL118501.22_107638
  Located on chromosome 20
  Distance between a terminus base of telomere on chromosomal short arm and 5'-terminus of this base sequence : 53060381
  Distance between 3'-terminus of neighbour sequence of sequence listing upward to telomere on chrosomal short arm and 5'-terminus of this base sequence : 99071
tttcaagttgaatctcatgaactacaatgagttttggtcttcaacatatgaagcctcctattattttggctttactgagtgaattatgcctgaaactaccatgctgaggggatgtgtacagtggagacttttttttctttaagagattggaaatttttaaaaaaaaaatcctaacatgggcattgcaatttctaattatcatcatcatcatcatcatcatcatcatcatcatcatcatctccatctccatttttcccctttacctatttgttactaggtaagtccaagtaggtatcat

SEQ ID NO: 24874 - DNA, 417 bp, Homo sapiens
  AL035667.12_78307
  Located on chromosome 20
  Distance between a terminus base of telomere on chromosomal short arm and 5'-terminus of this base sequence : 53147671
  Distance between 3'-terminus of neighbour sequence of sequence listing upward to telomere on chrosomal short arm and 5'-terminus of this base sequence : 86992
caacagataagtgcagtgttgaattgaatataattcgaacttagatctcccagtatactgaaactaaaacattaaatttagacatacatgtataatgaaacgttaaaggagatatgttttagctaagaaaggtgtgtgctatttatttatttatttatttatttaatgtttttagaaatgaggtctctctctctattgcttccctgtcacccaggctggagtgcagtggtgcaactgtagctcactgcagcctcaacaagtgatcctcctgtctgcgcgtcctgaatagctgggactaaaggtgtaagccactgcacccagcaggtgtgttctattaaaaatattggttttgtaggtttcacaagagaatgattttacactggacacacagaaaataaattacgttggcctacgtta

SEQ ID NO: 24875 - DNA, 249 bp, Homo sapiens
  AL138809.18_26241
  Located on chromosome 20
  Distance between a terminus base of telomere on chromosomal short arm and 5'-terminus of this base sequence : 53315518
  Distance between 3'-terminus of neighbour sequence of sequence listing upward to telomere on chrosomal short arm and 5'-terminus of this base sequence : 167430
agtaaaggacaacctaagccagtgaccctcaaactcatgaatgccagtgtttcactgaccatattagaaccactagtgtggttctcagggtggtgaacaaaaaaatagcgacgatgtacatgcatacagccacagatacacacacacacacacacacacacacacacacacacacacacacaggtaccccatacatcacatcctggattccactcaagatattttgtttcagtgcttctaaagtgaaac

SEQ ID NO: 24876 - DNA, 287 bp, Homo sapiens
  AL138809.18_55365
  Located on chromosome 20
  Distance between a terminus base of telomere on chromosomal short arm and 5'-terminus of this base sequence : 53344604
  Distance between 3'-terminus of neighbour sequence of sequence listing upward to telomere on chrosomal short arm and 5'-terminus of this base sequence : 28837
tgaggtagtcatttactcaacagtccacatcagtgtggattcacagacatatactttatactttgggctataatccaatatgacttatttactatactgctgtaattcattcttccaggtttgcctttggcagctcttctagttagccactgtgtccctttgacacgtctccatctgtgtgtgtgtgtgtgtgtgtgtgtgtgtgtgtgtgtgtagcactttgttacttcctggtactgcatgagcttcatgttgtatgttaattgtcgttgtactattaccagcca

SEQ ID NO: 24877 - DNA, 362 bp, Homo sapiens
  AL162294.8_27830
  Located on chromosome 20
  Distance between a terminus base of telomere on chromosomal short arm and 5'-terminus of this base sequence : 53411637
  Distance between 3'-terminus of neighbour sequence of sequence listing upward to telomere on chrosomal short arm and 5'-terminus of this base sequence : 66746
tatggtgaaactgcatctctactaaaaatacaaaaaactagcccgcatggtggctcgtgtctataatcccagctattcgggaggctgaggcaggagaatcacttgaacctgggaggtggaggttgcggtgagccgagatcataccattgcactccagcctggctgacacagtgagactctgtctcaaaataataataataataataataataataaaagaagaagaagaagaagaagaagaagaagaagtgagtgtatgcaacagcaacagttaacatgtacaaaaatgttcatgtcagcaatgttcacaatagatccacttgggaacaaaccaatgcacgttgaccatagaatgaagacaa

SEQ ID NO: 24878 - DNA, 223 bp, Homo sapiens
  D20S469
  Located on chromosome 20
  Distance between a terminus base of telomere on chromosomal short arm and 5'-terminus of this base sequence : 53441394
  Distance between 3'-terminus of neighbour sequence of sequence listing upward to telomere on chrosomal short arm and 5'-terminus of this base sequence : 29395
agcaaaggttaaaagcacccatagaagtatatattcttaaaagaatgaaaatatattattttcttgaataatcattggcttataattttgtgtatttctctctctcttttccttccttccttccttctccttccttccttccttccttccttccttccttccttccttccttccttccttctttccttccttgttatagatgcatggagtggctaggaaagct

SEQ ID NO: 24879 - DNA, 307 bp, Homo sapiens
  AL121593.10_27171
  Located on chromosome 20
  Distance between a terminus base of telomere on chromosomal short arm and 5'-terminus of this base sequence : 53472216
  Distance between 3'-terminus of neighbour sequence of sequence listing upward to telomere on chrosomal short arm and 5'-terminus of this base sequence : 30599
tctcaaacttgcctttattgactccgtgtgtgtgtgtgtgtgtgtgtgtgtgtgtgttttcctttcataatcaaattattctgactctagattttccaaattcatcttttcaactttcctatgaaaggtgtttaggggagaaaaactaaaataattaatgaatcacatgggaagagaaggagattttggaggagaggaatggtgtagaaaatcaggttgcccattctcctatgttctgtaaccataatttagaatcttatcttgcatggtttgttggtgagaaatgttaacatttgcatttcaaggt

SEQ ID NO: 24880 - DNA, 170 bp, Homo sapiens
  AL121593.10_49144
  Located on chromosome 20
  Distance between a terminus base of telomere on chromosomal short arm and 5'-terminus of this base sequence : 53494125
  Distance between 3'-terminus of neighbour sequence of sequence listing upward to telomere on chrosomal short arm and 5'-terminus of this base sequence : 21602
catgacatcatagatgacatcaacagtggtgctgtggaatgcccagccagttaagcacaaaggaaaatatttcagtaaaggatcatttgacacacacacacacacacacacacacacacacacacacacacacacacacacacaagaaacaggttaacattggatgtctc

SEQ ID NO: 24881 - DNA, 310 bp, Homo sapiens
  AL121593.10_113383
  Located on chromosome 20
  Distance between a terminus base of telomere on chromosomal short arm and 5'-terminus of this base sequence : 53558353
  Distance between 3'-terminus of neighbour sequence of sequence listing upward to telomere on chrosomal short arm and 5'-terminus of this base sequence : 64058
gaaggtacattgtcactacagaagagcatcagtgacagtagtattgttctctctcttttctttcttttcatccttggtttcattctcttctttttctcctttcccttcccttcccttcccttcccttcccttcccttcccttcccttcccttcccttccctttccttcccttccctgcccttgccgcctcctttcctcctttcctgccttccttccttcctccctccctccctccctccctcccttctgtcttttcttaaagaagactacattatttgggatgctgaacttccactaccttaccactacc

SEQ ID NO: 24882 - DNA, 476 bp, Homo sapiens
  AL158015.9_31516
  Located on chromosome 20
  Distance between a terminus base of telomere on chromosomal short arm and 5'-terminus of this base sequence : 53594446
  Distance between 3'-terminus of neighbour sequence of sequence listing upward to telomere on chrosomal short arm and 5'-terminus of this base sequence : 35783
cttaaatgcaaagccagataactaatctctgtctctcatatattagcagaatgctgagctcattattgcccttgtaaactggcaatattctctggaatgccagcctattgagccttcattaggaacagagggtgtccttcttcagtggcagtcgttttttctcttccacccaagtttaaccttgagaggggtgtgtgtgtgtgtgtgtgtgtgtgtgtgtgtgtagttggctaccccaaattaagttgtgtacattgtataccaagatcacgtattacaattattataattactggtagcacttatggagcaagtgcattatgcctagtactagtttaacctctttatattaatctcttatataatcttcaaaatagctcacaatatatggaacatatagccctatgctattagctatggaaaatagcagattatcagtaaatgctcgtcaaatgttcaatctgatgttagccact

SEQ ID NO: 24883 - DNA, 212 bp, Homo sapiens
  Z67129
  Located on chromosome 20
  Distance between a terminus base of telomere on chromosomal short arm and 5'-terminus of this base sequence : 53594558
  Distance between 3'-terminus of neighbour sequence of sequence listing upward to telomere on chrosomal short arm and 5'-terminus of this base sequence : -364
ccttcattaggaacagagggtgtccttcttcagtggcagtcgttttttctcttccacccaagtttaaccttgagaggggtgtgtgtgtgtgtgtgtgtgtgtgtgtgtgtgtagttggctaccccaaattaagttgtgtacattgtataccaagatcacgtattacaattattataattactggtagcacttatggagcaagtgcattatgc

SEQ ID NO: 24884 - DNA, 386 bp, Homo sapiens
  AL158015.9_33458
  Located on chromosome 20
  Distance between a terminus base of telomere on chromosomal short arm and 5'-terminus of this base sequence : 53596339
  Distance between 3'-terminus of neighbour sequence of sequence listing upward to telomere on chrosomal short arm and 5'-terminus of this base sequence : 1569
tgagcaagctgagtcaactatgtggcccagaactcttaggcagtcgaagtgttccacttgcaatttgagagtaggggatgaggcttgaagaacaaacaggagctgtccaggtgaaatgcagtggggtggaaagggggagtccttgctaaccaaaaagactatcaggagaagagaatgtaaggcaagaaagagttcagcaaattcaaggaattgaaaagtgtcccatagagaaaagagcaagagagagagagagagagagagagagagagagagagagagaatgaatgtgactgtggaaattgacaggagcaccatcaagctggacttgcagcaccagtatatcattgatgggaagttatttaaggaaatgactcataagatctgac

SEQ ID NO: 24885 - DNA, 223 bp, Homo sapiens
  AL035663.18_2297
  Located on chromosome 20
  Distance between a terminus base of telomere on chromosomal short arm and 5'-terminus of this base sequence : 53671336
  Distance between 3'-terminus of neighbour sequence of sequence listing upward to telomere on chrosomal short arm and 5'-terminus of this base sequence : 74611
ccaaatgtaaacaagacctaaaatacggatgccatgtttcagtatggatacattcccaaagttcatatctttgcaaaaatatttatcaaaaagtttactgtaagcacacacacacacacacacacacacacacacacacatacacataaaaaagtaagaaaggtacaacaattatccttttgcatgagaagaaattcgtgttaaattatccatgcctttcata

SEQ ID NO: 24886 - DNA, 193 bp, Homo sapiens
  AL035663.18_5954
  Located on chromosome 20
  Distance between a terminus base of telomere on chromosomal short arm and 5'-terminus of this base sequence : 53675045
  Distance between 3'-terminus of neighbour sequence of sequence listing upward to telomere on chrosomal short arm and 5'-terminus of this base sequence : 3486
atgagccatccttataagcatatttttatagagcctttgtctctctaaaaaatgtgtgtgtgtgtgtgtgtgtgtgtgtgtgtgtgtggtgtagtgtgtacataatttatctttttaaaagagaatgttttcaataagaaattcacagtggtttactcacaaccttattagaataggtttctcagtttgaggc

SEQ ID NO: 24887 - DNA, 295 bp, Homo sapiens
  AL121826.11_5022
  Located on chromosome 20
  Distance between a terminus base of telomere on chromosomal short arm and 5'-terminus of this base sequence : 53785837
  Distance between 3'-terminus of neighbour sequence of sequence listing upward to telomere on chrosomal short arm and 5'-terminus of this base sequence : 110599
aggaacattgatcatacaagaaacaataaatttgacttctgttcattagatattatcaagaaaattaatatgtatgcatggagaaaaaatccagaatacataaagaaatcttatgatggtaataaaaagataaactaataataaatgcaataatccatatttcacaaggaagataagcagaatggccaatacacacacacacacacacacacacacacacacacacacacacacaatcaacatcattagtcattggggaaatgcaaattaaagctgtattgagaaaccactgcat

SEQ ID NO: 24888 - DNA, 289 bp, Homo sapiens
  AL121826.11_34478
  Located on chromosome 20
  Distance between a terminus base of telomere on chromosomal short arm and 5'-terminus of this base sequence : 53815301
  Distance between 3'-terminus of neighbour sequence of sequence listing upward to telomere on chrosomal short arm and 5'-terminus of this base sequence : 29169
taacttcagttccaccgtaagttaattataacaccaagttagacagctagatcttagggttggactactaaggagatatacaatatcttgagatgttccagtgaaatgacatgataaaaatgtcaaccttggattaatcaggagatgcatagtgtactttaatccctgacatttctagtggggtgtgtgtgtgtgtgtgtgtgtgtgtgtgtgtgtgtgtgtgtgtgtgctgttgggaagggaaattttcatctggcagaaatcaaagttaatggaggtacagacctga

SEQ ID NO: 24889 - DNA, 130 bp, Homo sapiens
  DISO7_10008651
  Located on chromosome 20
  Distance between a terminus base of telomere on chromosomal short arm and 5'-terminus of this base sequence : 53945359
  Distance between 3'-terminus of neighbour sequence of sequence listing upward to telomere on chrosomal short arm and 5'-terminus of this base sequence : 129769
tcagttatggatggaataatgctacacacacacacacacacacacaactaaattcactgccttagaacaaaaataatttactgatatggataagacttaagtcagctggggcatgtcttcagaccggact

SEQ ID NO: 24890 - DNA, 185 bp, Homo sapiens
  DISO7_10008659
  Located on chromosome 20
  Distance between a terminus base of telomere on chromosomal short arm and 5'-terminus of this base sequence : 54030112
  Distance between 3'-terminus of neighbour sequence of sequence listing upward to telomere on chrosomal short arm and 5'-terminus of this base sequence : 84623
tggtagcatgcgaaagagaggcttgaacccaggaagcagaggttgcagtgagccgagattgtaccactgcactccagcctgggcaacagagtgagactccatttcaaataaataaataaataaataaataaataaataaaatctttaatgtgttcatttttcatctgtatgagaattacgatttg

SEQ ID NO: 24891 - DNA, 455 bp, Homo sapiens
  AL109829.21_39812
  Located on chromosome 20
  Distance between a terminus base of telomere on chromosomal short arm and 5'-terminus of this base sequence : 54062737
  Distance between 3'-terminus of neighbour sequence of sequence listing upward to telomere on chrosomal short arm and 5'-terminus of this base sequence : 32440
tagtctcagtgactctggaggtggaagcaagaggatcatttgggcctaggagtttgtgtccagtctgggcaaaatagggagaccctggatctaaaataaagaaaaataaaaatgacctcttatgttcatatgatatagataatcagcagaagtgtgtgtgtgtgtgtgtgtgtgtgtgtgtgtgtgtgtgtgtgtttaaaaagaacattgggaagggaaatattcaaacaggaatgtggacatttattaaaattttttgtgggtgaccgttttctaaataaacttctcacttttttaaactaagtttaaactcactttaaattaattttagttttcagaagtgttgcaaaggttgtacagtgagccgtgcacaccttgtatccagagtcttctattattaacacatttcataaccatggtacatttgtcaaaacttacgaaaccaacactgatac

SEQ ID NO: 24892 - DNA, 212 bp, Homo sapiens
  D20S100
  Located on chromosome 20
  Distance between a terminus base of telomere on chromosomal short arm and 5'-terminus of this base sequence : 54116564
  Distance between 3'-terminus of neighbour sequence of sequence listing upward to telomere on chrosomal short arm and 5'-terminus of this base sequence : 53372
attgggtttacttgtgccttggcttaaggtctagaatataataaacttaaaggtctgaacacagtgaggttaattatgcttaaaacctgcaaagcagcaagttttaggtccattacacacacacacacacacacacacacacacacacacacacacaccccccaacaggaaaatgagtcaaagaaattcttccagcaagaaatgaaatcacg

SEQ ID NO: 24893 - DNA, 331 bp, Homo sapiens
  AL109829.21_93602
  Located on chromosome 20
  Distance between a terminus base of telomere on chromosomal short arm and 5'-terminus of this base sequence : 54116608
  Distance between 3'-terminus of neighbour sequence of sequence listing upward to telomere on chrosomal short arm and 5'-terminus of this base sequence : -168
acttaaaggtctgaacacagtgaggttaattatgcttaaaacctgcaaagcagcaagttttaggtccattacacacacacacacacacacacacacacacacacacacacacaccccccaacaggaaaatgagtcaaagaaattcttccagcaagaaatgaaatcacgccttccttctcaggtctgtgtgccgccatagctcaggttataatatagcacttgcttttttcccacctcttggtagagctttctgccaaattatttgtcctcaagggctattcagctcacagttctatgttcaaaatggttctccagtgcctatgaaattaaa

SEQ ID NO: 24894 - DNA, 134 bp, Homo sapiens
  DISO7_10004498
  Located on chromosome 20
  Distance between a terminus base of telomere on chromosomal short arm and 5'-terminus of this base sequence : 54260116
  Distance between 3'-terminus of neighbour sequence of sequence listing upward to telomere on chrosomal short arm and 5'-terminus of this base sequence : 143177
agtgttatgcaaatgcatagcaaatatatatacacacatatatatgcatatacatgcatagtgtacatatacctacatatgcatacacacacacacacacacacacatacacacatggcaacttggtcactgtg

SEQ ID NO: 24895 - DNA, 249 bp, Homo sapiens
  DISO7_00049418
  Located on chromosome 20
  Distance between a terminus base of telomere on chromosomal short arm and 5'-terminus of this base sequence : 54355376
  Distance between 3'-terminus of neighbour sequence of sequence listing upward to telomere on chrosomal short arm and 5'-terminus of this base sequence : 95126
tggtgctgacttactgcttttggtgagctgtaacactgctcctcccaacacacacacacacacacacacacacacacatacacacacacacacacactctgtctctctttctctctctctctctctccccatctctctctctctctctctctctctctctcagctgaactccctggggacaggaggtgggaaacgagctggtggggaaactaagttctacaagcatccccggcctagattcaccaggga

SEQ ID NO: 24896 - DNA, 241 bp, Homo sapiens
  chr20.fa.O7frz.57707691
  Located on chromosome 20
  Distance between a terminus base of telomere on chromosomal short arm and 5'-terminus of this base sequence : 54686578
  Distance between 3'-terminus of neighbour sequence of sequence listing upward to telomere on chrosomal short arm and 5'-terminus of this base sequence : 330953
aggtagtgaaatctcaaggataaggaagctatatatatgtatatacacacatacatatacatatacacacacatatatatacatatatacacacacatatacacacacacacacacacacacacacatatatatatatggcttcttctattcattcttcaggatggaaggaaatttccaaagggttacaatgtgtgagatttaacaatggaaaaatacatatgaaacttgtttaactggct

SEQ ID NO: 24897 - DNA, 179 bp, Homo sapiens
  D20S102
  Located on chromosome 20
  Distance between a terminus base of telomere on chromosomal short arm and 5'-terminus of this base sequence : 54793990
  Distance between 3'-terminus of neighbour sequence of sequence listing upward to telomere on chrosomal short arm and 5'-terminus of this base sequence : 107171
ttttggtagtttcaagatgccttagttacgaaaatagagtctgcaatgtactttagtgattcagtcctgtttgctataaattctgtttacttccgtgtgtgtgtgtgtgtgtgtgtgtgtgtgtatgcacacatgccattacaggtaatattgaaattagcatcttcatacacagccct

SEQ ID NO: 24898 - DNA, 301 bp, Homo sapiens
  AL109806.22_41901
  Located on chromosome 20
  Distance between a terminus base of telomere on chromosomal short arm and 5'-terminus of this base sequence : 54882976
  Distance between 3'-terminus of neighbour sequence of sequence listing upward to telomere on chrosomal short arm and 5'-terminus of this base sequence : 88807
gaggttacagtgagctaggatcatgccactgcactgcagtctgggcaacagagtgagatgccatctcataataataataataataataataataatatttgccctgtgggtgcacctggactagacggcagatctgctcacactggcccattcctgggggtcgagggttggtgctgggtttcacttcttgtctcacattctacatctggaaggaggaagccattctaagccaaatagcagtggaagaagcaactgaggaaatgctggggagtgttgcccacattaaacgttacacttccac

SEQ ID NO: 24899 - DNA, 445 bp, Homo sapiens
  chr20.fa.O7frz.58137773
  Located on chromosome 20
  Distance between a terminus base of telomere on chromosomal short arm and 5'-terminus of this base sequence : 55071076
  Distance between 3'-terminus of neighbour sequence of sequence listing upward to telomere on chrosomal short arm and 5'-terminus of this base sequence : 187799
acatatgaatcagatttctgtcacaaaccggagtctgggctgattcctcttctgcctctgatcctgtttattgtaacagaaagggttttctttttctgtctttcttgtttgtttgtttgtttgtttgagacagagtctcactctgtcactcaggctggagtgcagtggtgtaattttcactcactgtaacctctggctcctggattcaaacaattcttgtgcctcagcctcctgagtagctgggattgcacgtgcccgccaccatgcctaattttttttttttttttgtatttttagtagagacagggttttgccatgttagccaggatggtctcgatctcctgacctcgtgatctgcccgcctcggcctcccaaagtgctgggattacaggcgtgagccaccgcccccagcaggatcactgttaaacctccttgattgtaagtg

SEQ ID NO: 24900 - DNA, 408 bp, Homo sapiens
  AL161657.22_17098
  Located on chromosome 20
  Distance between a terminus base of telomere on chromosomal short arm and 5'-terminus of this base sequence : 55191087
  Distance between 3'-terminus of neighbour sequence of sequence listing upward to telomere on chrosomal short arm and 5'-terminus of this base sequence : 119566
ccaaactacatccgagctaacacttccgctgctcgggacttctctaagagaagcaatttcaaggaaggcaaaccctgactcttttttcttttttttaatttaatttaatttaatttaatttaatctaatttaattttaagttctgggatacacgtgcaggacgtgcaggttggttacataggtaaacatgtgccgtggtggtttgctgcacccatcaacccgtcacctaagtattaagccccgcatgcattagctatatatcctgatgctctccctccctcattccccctgcaacaagccccagtgtgtgttgttgccctccctgtgttctgattgctaggctctcacttataactgagaacatgcagtgtttggttttctgttcctgtgttcgtttgctgaggataa

SEQ ID NO: 24901 - DNA, 477 bp, Homo sapiens
  chr20.fa.O7frz.58338760
  Located on chromosome 20
  Distance between a terminus base of telomere on chromosomal short arm and 5'-terminus of this base sequence : 55271882
  Distance between 3'-terminus of neighbour sequence of sequence listing upward to telomere on chrosomal short arm and 5'-terminus of this base sequence : 80387
gtcttagagtccttggtttgagcaagcaatctcgtgtggtaatatatgtatacaaatgtagaatgttgtcttagttcattttgtgctgctgtaaaaaaatatctgacattgagtaatttatagagaaaagacatttatttttcatcgttttgaaggctgagaagtccaggatcaaggtgcaaacatctggcaagtgtcttcttgctgcaccatcccggggggaaggtggaaggcagaagggcagagagggtgagagagagaaaaggagactaaacttgcccctttcttccttccttccttctttccttccttccttccttgcttccttccttccttccttccttccttccttccttccttccttccttccttccttcctttccctttctctctctctctctttcttcctttctttctttcattcttttactttaagttctgggatacatgagctgaacatgcaggtttgttacatag

SEQ ID NO: 24902 - DNA, 289 bp, Homo sapiens
  HUMUT488
  Located on chromosome 20
  Distance between a terminus base of telomere on chromosomal short arm and 5'-terminus of this base sequence : 55316639
  Distance between 3'-terminus of neighbour sequence of sequence listing upward to telomere on chrosomal short arm and 5'-terminus of this base sequence : 44280
ctctggtccttgtaaccacactgtcagcgaggaaagtgatgatgcaggaagagagagagagagagaaagggagggaaggagggagggaggagggaaggaaggaagggagggagaaagaaagagagagagaaagaaagaaagaaagagagagaaagagagagagagaaagaaaggaagaagaaagaaagaaagaaagaaagaaagaaagaaagaaagaaagaaagaaagaaagaaagaaagaaagaaagaaagaaagaaaggggccaggcacggtggctcacgcctgtaa

SEQ ID NO: 24903 - DNA, 393 bp, Homo sapiens
  AL117380.28_151179
  Located on chromosome 20
  Distance between a terminus base of telomere on chromosomal short arm and 5'-terminus of this base sequence : 55417196
  Distance between 3'-terminus of neighbour sequence of sequence listing upward to telomere on chrosomal short arm and 5'-terminus of this base sequence : 100268
agttgatgtcatcctaccattaaggagtgattcagagaacaggtttttggttgccacagcaactttaagtatcagagctctctctatagactttggatgtgtgtgtgtgtgtgtgtgtgtgtgtgtgtgtgtgtgtgtgtgtgtgtgtttagggatggggagactagcactcttaagttcagacaaacattgagacgacaggatgtgagctgtctattagatcttgaagggtgttgtcaaggggagaagctgaacttgttttccaaatcccaaagtattaaacctcaagggcttagtttgagggcaaataaatatctatcaagtggcaagctcacaaaatccagcattcaagagagccttgaaatggaagttaatacttccagtttggagatg

SEQ ID NO: 24904 - DNA, 309 bp, Homo sapiens
  AL133212.2_13920
  Located on chromosome 20
  Distance between a terminus base of telomere on chromosomal short arm and 5'-terminus of this base sequence : 55437802
  Distance between 3'-terminus of neighbour sequence of sequence listing upward to telomere on chrosomal short arm and 5'-terminus of this base sequence : 20213
gaatattagaaaggaaccatctcaggacagaggcaatggggaagtgggtggggtgcgggtgagcagggctgtgaagtcttgagatttgcctctgcggttgctgacagagaacgagttattattattattattattattattattattattatttgagacagagtctcactctgtcgctcaggctgaagtgtagtgacacaaagtcagctcactgcaatctccacctcccaggttcaagcaacttcaccgtggagacagttttcttattaaattgcttgtactctcttagaaggattactcatttgatca

SEQ ID NO: 24905 - DNA, 424 bp, Homo sapiens
  AL117380.28_171803
  Located on chromosome 20
  Distance between a terminus base of telomere on chromosomal short arm and 5'-terminus of this base sequence : 55437803
  Distance between 3'-terminus of neighbour sequence of sequence listing upward to telomere on chrosomal short arm and 5'-terminus of this base sequence : -308
aatattagaaaggaaccatctcaggacagaggcaatggggaagtgggtggggtgcgggtgagcagggctgtgaagtcttgagatttgcctctgcggttgctgacagagaacgagttattattattattattattattattattattattatttgagacagagtctcactctgtcgctcaggctgaagtgtagtgacacaaagtcagctcactgcaatctccacctcccaggttcaagcaacttcaccgtggagacagttttcttattaaattgcttgtactctcttagaaggattactcatttgatcagcgggaggaaccactcccaaaataccttttgagtcatttggggtttctattgccttttgcataaactttgaattattctttttgttgaaaaggttactattaggaaacacgttcac

SEQ ID NO: 24906 - DNA, 221 bp, Homo sapiens
  AL157414.19_66615
  Located on chromosome 20
  Distance between a terminus base of telomere on chromosomal short arm and 5'-terminus of this base sequence : 55510996
  Distance between 3'-terminus of neighbour sequence of sequence listing upward to telomere on chrosomal short arm and 5'-terminus of this base sequence : 72769
gctaaacatgctccagtttaagcagctcaggtggggagcagggcttggacacagctggcctctggccccctgtttttgtttggcatgcatggtgtctttcagttttcacacacacacacacacacacacacacacacacacacaaatccagatttccagattcttctaaaattgtttccactgtggccacaattgtgtggctctgagtagcgacataggct

SEQ ID NO: 24907 - DNA, 396 bp, Homo sapiens
  AL157414.19_109819
  Located on chromosome 20
  Distance between a terminus base of telomere on chromosomal short arm and 5'-terminus of this base sequence : 55554095
  Distance between 3'-terminus of neighbour sequence of sequence listing upward to telomere on chrosomal short arm and 5'-terminus of this base sequence : 42878
ctaactcgtgagtcaagaccaggtcttggggactgctctagctctggagtcaaaccccagctctcctagatcttggactcctggtttgcaaaatgaagagagctcctataactcctggggtaggcttgagtgttcatggcagtttcatattttcttcttcttcttctagcccacttgttagggaaatttgaaactacgcacattctccattcacacacacacacacacacacacacacacacacacacacacctgttaactgtttgaatgcatggctctttcctccacacccactacatgccattagggtatatgtcaaagagtggaacaccactcaatttttggcttttctctgattcatgagaattctatctgcatagcttctaggataatgag

SEQ ID NO: 24908 - DNA, 170 bp, Homo sapiens
  AL122058.19_41172
  Located on chromosome 20
  Distance between a terminus base of telomere on chromosomal short arm and 5'-terminus of this base sequence : 55610310
  Distance between 3'-terminus of neighbour sequence of sequence listing upward to telomere on chrosomal short arm and 5'-terminus of this base sequence : 55819
ggaacgacaatgttactctattctccctgaaacccacattgtcacatgttctgaaaataattttgtatccattatcaaagaaagaacagtcatgaagtacacacacacacacacacacacacacacacacacacacacacacacaaataagcagtggataattcaaagtc

SEQ ID NO: 24909 - DNA, 342 bp, Homo sapiens
  AL160176.3_26817
  Located on chromosome 20
  Distance between a terminus base of telomere on chromosomal short arm and 5'-terminus of this base sequence : 55871595
  Distance between 3'-terminus of neighbour sequence of sequence listing upward to telomere on chrosomal short arm and 5'-terminus of this base sequence : 261115
gaagtgcagtgaggtcattaaggctcactgtagcctcaacctccctggctcaggtgatcctcccacctcagccccctgagtagctaggactataggtgcataccaccacatctggctaatttgtgtgtgtgtgtgtgtgtgtgtgtgtgtgtgtgtgtgtgtgtgtgtgtatatatatatatatatattttttttttttgtaaagacatggtttcaccatgttgcccagactggtctttaactcctggactcaagcaaccctgcccaccttggtcttccaaagtgctgggattacaggcatgagccaccagacccagcctaattaagtttgttgatggcact

SEQ ID NO: 24910 - DNA, 199 bp, Homo sapiens
  HUMUT2447
  Located on chromosome 20
  Distance between a terminus base of telomere on chromosomal short arm and 5'-terminus of this base sequence : 55952559
  Distance between 3'-terminus of neighbour sequence of sequence listing upward to telomere on chrosomal short arm and 5'-terminus of this base sequence : 80622
gaattctgcctgggcagtgagggaaggtgcatttgcattccacctccccccttccttccttccttccttccttccttccttccttccttcctttcttccttcctttcatccatccagtcatccatccttctgtccatctatccatccatccatccttccttccttccatccattcatccacccttgtattcattgttcc

SEQ ID NO: 24911 - DNA, 288 bp, Homo sapiens
  chr20.fa.O7frz.59235736
  Located on chromosome 20
  Distance between a terminus base of telomere on chromosomal short arm and 5'-terminus of this base sequence : 56060922
  Distance between 3'-terminus of neighbour sequence of sequence listing upward to telomere on chrosomal short arm and 5'-terminus of this base sequence : 108164
tcctttaattactccaggaaagacccaattacagcgcagacgcatctgccagcctgaggatccaatatttaatagcccatccttcaggaacattcctgcttgggagcttcctggagcgagcagccctgcatgcattacgaacttgcattactatactaactcggtggtggtgttctggcctgtgtgcgtgtgtgtgtgtgtgtgtgtgtgtgtgtgtttcttttaaaagtctcttcccctgaaaatacttcatgttgatatttcttcttaaagatgctgtaattatga

SEQ ID NO: 24912 - DNA, 365 bp, Homo sapiens
  HUMUT2218
  Located on chromosome 20
  Distance between a terminus base of telomere on chromosomal short arm and 5'-terminus of this base sequence : 56349160
  Distance between 3'-terminus of neighbour sequence of sequence listing upward to telomere on chrosomal short arm and 5'-terminus of this base sequence : 287950
gaacttccttgtgatagccctcactctacaggatgggtggctgtatagatggaaagaaggaaggaaggaaggaaggaaggaaggaaggaaggaaggaaggaaggaaggaaggaaggaaggaaggaaggaaagaaggaaggaaggaaggaaagatgaatggaagaatggatgggtggaggatggaaggatggatggatggaggatggatggatggatggatggatggatggatggatggatgaatggaaggctggatggatggacaaatggccagatggatggatggatggatgcatggatggatggatggatagatagatgaacctaataacaaacttaccatccatcgaatgtcagctggtgta

SEQ ID NO: 24913 - DNA, 197 bp, Homo sapiens
  chr20.fa.O7frz.59653029
  Located on chromosome 20
  Distance between a terminus base of telomere on chromosomal short arm and 5'-terminus of this base sequence : 56478316
  Distance between 3'-terminus of neighbour sequence of sequence listing upward to telomere on chrosomal short arm and 5'-terminus of this base sequence : 128791
gaagccttatctgaatcaactctgcattcctgtagcttggcatcttgtttggggaatggtgggtgcttggtaggaattttaaggcaattcattcatgcattcattcatgcattcattcattcattcattcattcatacattgcttctggctgccgaaatgcctgcattctctccgctattgatggctaagtcatgag

SEQ ID NO: 24914 - DNA, 189 bp, Homo sapiens
  HUMUT1772
  Located on chromosome 20
  Distance between a terminus base of telomere on chromosomal short arm and 5'-terminus of this base sequence : 56855854
  Distance between 3'-terminus of neighbour sequence of sequence listing upward to telomere on chrosomal short arm and 5'-terminus of this base sequence : 377341
gggtgctaggtgtgctcactgctagtgggctgtcactttaggcttcttaactttttcttttctccttccttccttccttccttccctctgtcctttcttcctccctccttccttcccttttccccttcccttcccttccctcatttctcccttcctctgcctgtgactccacgagtctgccagcctcat

SEQ ID NO: 24915 - DNA, 359 bp, Homo sapiens
  AL050327.6_33202
  Located on chromosome 20
  Distance between a terminus base of telomere on chromosomal short arm and 5'-terminus of this base sequence : 56952051
  Distance between 3'-terminus of neighbour sequence of sequence listing upward to telomere on chrosomal short arm and 5'-terminus of this base sequence : 96008
atcttccttagatgactgcactagcttcctgactggtttccctaaaacccattcatttatctatcccttctaccatttctcccaccaaacatccatctcaccacccaccatcctgccacttatctttccctccctccctcattcccttcctccatctatctctccatccatccatccatccatccatccatccatccatccacccactaatatgtatttagtggttacaatgtcccaagcactgtatgggtcccagtgtaggtggaaaaggaaacagatttcctgacctcaaacaaaacaataaatttcaaagtaagaagccccacgagggaggaagtgtaggctgtcttgaaagagga

SEQ ID NO: 24916 - DNA, 382 bp, Homo sapiens
  AL109840.24_52190
  Located on chromosome 20
  Distance between a terminus base of telomere on chromosomal short arm and 5'-terminus of this base sequence : 57332156
  Distance between 3'-terminus of neighbour sequence of sequence listing upward to telomere on chrosomal short arm and 5'-terminus of this base sequence : 379746
agttgacagaacaggactctgtctcaaaaagaaaaaatagaaaaagacacttgcacaggcatgtttctagcagcacaattcataattgcaaaaatatggaaccagcctaaatgcccatcaaccaacaaagtggataaggaaaatgtgatacacacacacacacacacacacacacacacacacacacgcataccatggaatactactcagccataaaaaggattgaaataatggcattcacagcaacctggatggaattggagaccattattctaagtgaggtaactcaggaatggaaaatcaaatatcgtatgttctcacttgtaagtgggagctaagctatgagaacacaaaggcataagaatgatacaatggatgtcag

SEQ ID NO: 24917 - DNA, 339 bp, Homo sapiens
  chr20.fa.O7frz.60604935
  Located on chromosome 20
  Distance between a terminus base of telomere on chromosomal short arm and 5'-terminus of this base sequence : 57427501
  Distance between 3'-terminus of neighbour sequence of sequence listing upward to telomere on chrosomal short arm and 5'-terminus of this base sequence : 94963
ggaatcacattactcctaatttaatacaaatctttctttctttctctccttctctttctttctctctttctttctttctttctttctttctttctttctttctttctttctttctctctctctctctctctctctttcttctttctttctttctttttgtttttttctttgagacaaggtctcttatgttgcccaggctggtcaaaccctggcctcaagtgatcctcctgcctcagcttcccaaagtgctgggattacaggcatgagccaccccacgcagcctagaatctagagtcaaattcaattttgtttccattagtgattgaagatttcaggtag

SEQ ID NO: 24918 - DNA, 139 bp, Homo sapiens
  D20S171
  Located on chromosome 20
  Distance between a terminus base of telomere on chromosomal short arm and 5'-terminus of this base sequence : 57610517
  Distance between 3'-terminus of neighbour sequence of sequence listing upward to telomere on chrosomal short arm and 5'-terminus of this base sequence : 182677
tataggtgaggaccctgaggcacacacacacacacacacacacacacacacacacacacacacacacacatagagagagagagacagacagagacagagacagacagacagacttgccccaggttacatggcttggtgt

SEQ ID NO: 24919 - DNA, 243 bp, Homo sapiens
  Z67390
  Located on chromosome 20
  Distance between a terminus base of telomere on chromosomal short arm and 5'-terminus of this base sequence : 57777665
  Distance between 3'-terminus of neighbour sequence of sequence listing upward to telomere on chrosomal short arm and 5'-terminus of this base sequence : 167009
gcctccagcacacgatgctcattccctgcagttcttggctcatgagcaattgccaatttgtgtctgtcttcaggcacaagacattctctcacccagaaagggcccccaagaaaacacaattcagataacacacacatacacacacacacacacacacacacctttctccaattctcactaaggcttcaccacctagaacatgatttctcagttcttggaatattttgtgtctgtttacgggca

SEQ ID NO: 24920 - DNA, 341 bp, Homo sapiens
  chr20.fa.O7frz.61075195
  Located on chromosome 20
  Distance between a terminus base of telomere on chromosomal short arm and 5'-terminus of this base sequence : 57888801
  Distance between 3'-terminus of neighbour sequence of sequence listing upward to telomere on chrosomal short arm and 5'-terminus of this base sequence : 110893
cctagcgcctacttaggagtgagaacatataatagttggttttccatccctgagttacttcacatagaataacagtctccagtcttatcaaggtctctgtgaatgccattcgttcgttcctttcgatagctgagtagtattccattatatatatatatatatatatgtgtttctttatccacttgttgattgataggcatttgtgttggttacacgtttttgcaattgcaaattgtgctgctataaacatgcgtgtgcgagtatcttttttggataatgacttgttttcctctgggtagatggccagcagtgggattgctggatcaaatggtagatctact

SEQ ID NO: 24921 - DNA, 270 bp, Homo sapiens
  chr20.fa.O7frz.61404048
  Located on chromosome 20
  Distance between a terminus base of telomere on chromosomal short arm and 5'-terminus of this base sequence : 58016524
  Distance between 3'-terminus of neighbour sequence of sequence listing upward to telomere on chrosomal short arm and 5'-terminus of this base sequence : 127382
ctaggtagacataccagtggataggtgggtgggtggatgggtggggtggatggacagatggataaatggagatggatagatggatggatggatggatggatggatggatggatggatgggtagacggatgtatgggttgatgatggctaggtagatatatgagtgggtaggtgggtgggtgggtctgtggatggatggatgagtgggtagaaatccaggcagctggaaggacagtggtggaaggacaggtatttggaaggacagtcattt

SEQ ID NO: 24922 - DNA, 414 bp, Homo sapiens
  20_61480694
  Located on chromosome 20
  Distance between a terminus base of telomere on chromosomal short arm and 5'-terminus of this base sequence : 58093697
  Distance between 3'-terminus of neighbour sequence of sequence listing upward to telomere on chrosomal short arm and 5'-terminus of this base sequence : 76903
gaccttcagcaatgaggttccctgcccctgctttgctcttcccttcaccctttgtgtgtgtgtgtgtgtgtgtgtgtgtgtgtgtgtgtgtgtgtgtgtgtgtgtgtgttgtgacagagtctcgttctgttgcccaggctggagtgcagtggtgcgatctcgatctcagctcactgcaacctctgcctcccaggttcaagcgattcttgtgcctcagcctcccaagaagctggaattataggtgtgtgccaccatacctgtctaattttcatatttttactagagacggggtttcaccatgttgcccaggctggtcttgaactcccaacctcagatgattcacacacctcagccacccagattacaggcatgatccactgcacccggccctcttcactcttcaactgagagtcc

SEQ ID NO: 24923 - DNA, 374 bp, Homo sapiens
  AL109928.33_58102
  Located on chromosome 20
  Distance between a terminus base of telomere on chromosomal short arm and 5'-terminus of this base sequence : 58363937
  Distance between 3'-terminus of neighbour sequence of sequence listing upward to telomere on chrosomal short arm and 5'-terminus of this base sequence : 269826
gaatcactcaagatctatttccaatattttattttttactattctatatgtatttttaaaaaagtaaatatccaccatatttcctttctcctgactctctttcttgactactgagttaaaaccctccctcttctttcctgggacacactgtagctcctttgtgctttcttctgcttagtagtgttctacttaatcagttttatttattttataaatccccctacacacacacacacacacacacacacacacacacacacacacactcagctctcagctccatcaaggacggaatttttgcctgtcttgttcatggcatctgaaatggaatgtggcacatagaagctgttgttgaataaatgatgcaaacaatt

SEQ ID NO: 24924 - DNA, 371 bp, Homo sapiens
  AL109928.33_18336
  Located on chromosome 20
  Distance between a terminus base of telomere on chromosomal short arm and 5'-terminus of this base sequence : 58403819
  Distance between 3'-terminus of neighbour sequence of sequence listing upward to telomere on chrosomal short arm and 5'-terminus of this base sequence : 39508
ttaaggtgaataaccagctgattgtaaaatagggcattgatcttgcatcttgtgtgtgggcccagtgcaattctatgagcccacgagagtggagacagctctctggctggagttagagagagagagagagagagagagagagagagagagggagaagaggaggcagaagggaggtgaggcagaagggacttcacagagaccggaagcaagaaaagcactcaccctgccattagtggctttgaagggggccacaagccaaggaatgtggatggcctccaggatctgagcatcccctcaccccactggtgattgccagcaaggacacaagaacctcagtcccacaaacaaggacctgcatttggtcaagaacc

SEQ ID NO: 24925 - DNA, 280 bp, Homo sapiens
  AL132822.15_47541
  Located on chromosome 20
  Distance between a terminus base of telomere on chromosomal short arm and 5'-terminus of this base sequence : 58473706
  Distance between 3'-terminus of neighbour sequence of sequence listing upward to telomere on chrosomal short arm and 5'-terminus of this base sequence : 69516
aatccatgctaagctcctagtaaaatgccggcatagacgctccgggtggatgtgagctgctgctgataatgatggtgattaaaataaaacctcaattataatgaaatgtaattcccatgcgaatgctgttgctcccttccccacggtgaagtgtgtgtgtgtgtgtgtgtgtgtgtgtgtgtgcgtgcccacgtgtgcgtgtgggggagggggcttggaattgtggcatctacaatgccaggagaagctttcataagcctaaggctgtagtccttgttca

SEQ ID NO: 24926 - DNA, 347 bp, Homo sapiens
  AL132822.15_51695
  Located on chromosome 20
  Distance between a terminus base of telomere on chromosomal short arm and 5'-terminus of this base sequence : 58477747
  Distance between 3'-terminus of neighbour sequence of sequence listing upward to telomere on chrosomal short arm and 5'-terminus of this base sequence : 3761
gactgtctcctaatggtgagtattgagaatttcttcttatagtcgcagcagtgaaaaggaacttttcatccaaaaattacaaaacagatttatgttgaaaataatgagaactttgttggtgccctggaaaaatatttgagagaagcagagagtgattccttttattgggccagagtgtaaaattcagctcattggtctcaagggaagaaaaagttcttttcttcagttggcaatttgttttcaacaaaagatttggaatgcctttttcttttcttttcttttcttttcttttcttttcttttctttttaataaaggaaggatatagttagttgaccaggaattagct

SEQ ID NO: 24927 - DNA, 165 bp, Homo sapiens
  AL035070.3_91440
  Located on chromosome 20
  Distance between a terminus base of telomere on chromosomal short arm and 5'-terminus of this base sequence : 58636495
  Distance between 3'-terminus of neighbour sequence of sequence listing upward to telomere on chrosomal short arm and 5'-terminus of this base sequence : 158401
ccacggcagatagctacttactcagctatttccgtgtgtgtgtgtgtgtgtgtgtgtgtgtgtgtgtgtgtgtgtgttgcggaggtcttcatatttgaaaaaatattttctttatatatgacaatacttgattccaacaaattatatcataatgctggaagtcca

SEQ ID NO: 24928 - DNA, 181 bp, Homo sapiens
  D20S173
  Located on chromosome 20
  Distance between a terminus base of telomere on chromosomal short arm and 5'-terminus of this base sequence : 58680495
  Distance between 3'-terminus of neighbour sequence of sequence listing upward to telomere on chrosomal short arm and 5'-terminus of this base sequence : 43835
atccaacctcccacttatttcttcctgcacccaggcaggtaaatatgtacacacacacacacacacacacacacacacacacagacacacggacacacacagacacacacacacacacacaccactcaatgttctgtttttattttaaatgcaaaaccacagatgagtcacgagtctttgg

SEQ ID NO: 24929 - DNA, 445 bp, Homo sapiens
  AL121918.26_19028
  Located on chromosome 20
  Distance between a terminus base of telomere on chromosomal short arm and 5'-terminus of this base sequence : 58720358
  Distance between 3'-terminus of neighbour sequence of sequence listing upward to telomere on chrosomal short arm and 5'-terminus of this base sequence : 39682
tcatttgaaatctttaacggatgaaaaacagatgttagacattcatccaaaagcattggtcagccacggtagctcacacctgtaatcccagcactttgggaggctgaggtgggaagatggcttgaactcaggagttcaaaaccagcctgggcaatatggcaaaaccccatatcaacaaaaatacaaaaagttagccaggcatggtggtgcgtgctgtagtccaggctacttgggaggcttgagcccaggaggtcgaggctgcagtgaaccaagatggtgcgaccgcgcttccagcctgggtgacagagtgagaccctgtctcagtaaataaataaataaataaataaataaataaataagcattacattaaaaaggggtgttttctatttagcactattatgtcccagggaagaaggactcctgtcctagaagctgaatctgtac

SEQ ID NO: 24930 - DNA, 228 bp, Homo sapiens
  AL121918.26_62223
  Located on chromosome 20
  Distance between a terminus base of telomere on chromosomal short arm and 5'-terminus of this base sequence : 58763791
  Distance between 3'-terminus of neighbour sequence of sequence listing upward to telomere on chrosomal short arm and 5'-terminus of this base sequence : 42988
attaaagacatccagacaagaaagaaagaagtcaaactatttccatttgtagatgaaacaatcttataaacaaaaaatcctaaggaacacacacacacacacacacacacacacacacacacacacacacacacaattagaactaatgaatgacttcaacaatgttgcaggatataagataaatattaaaaattagttgtatttctatacacttgcaatcaacgatta

SEQ ID NO: 24931 - DNA, 239 bp, Homo sapiens
  AL161940.6_75089
  Located on chromosome 20
  Distance between a terminus base of telomere on chromosomal short arm and 5'-terminus of this base sequence : 59025123
  Distance between 3'-terminus of neighbour sequence of sequence listing upward to telomere on chrosomal short arm and 5'-terminus of this base sequence : 261104
agtggataaacacaaggtctgtattatatacacacagtggatacacacaagggtctgcatgaatctttctctctctctctctgtgtgtgtgtgtgtgtgtgtgtgtgtgtgtgtgtgtgtgtgtgtgtatctgtctggtagtctcagaaccttggcactgaatgaggcttctgtcaaacccttggagaacttatctttttttctgatctgagattgacttcctcaatctgagatcctat

SEQ ID NO: 24932 - DNA, 321 bp, Homo sapiens
  chr20.fa.O7frz.62527601
  Located on chromosome 20
  Distance between a terminus base of telomere on chromosomal short arm and 5'-terminus of this base sequence : 59140276
  Distance between 3'-terminus of neighbour sequence of sequence listing upward to telomere on chrosomal short arm and 5'-terminus of this base sequence : 114914
tatctgtttcttaagcacctgtacccccaccacagcctctggaatgtgataggcatgtatttgatgaatgaatgaatgaatgaatgaatttcactcagctgactctctctaaattccagcttccagtctgcctcttctgttgcacagaaagctttgagaacccaggctaggtttaccagttgtttcttctgagtctaacacaaaagacatgcttattaatagctgtggaattgatttgaattacatgcaaactccctcagaaaaagacccatgtctaactgatctttgtacccttcatccttgtacttcaaagacttgcac

SEQ ID NO: 24933 - DNA, 432 bp, Homo sapiens
  chr20.fa.O7frz.62640422
  Located on chromosome 20
  Distance between a terminus base of telomere on chromosomal short arm and 5'-terminus of this base sequence : 59252854
  Distance between 3'-terminus of neighbour sequence of sequence listing upward to telomere on chrosomal short arm and 5'-terminus of this base sequence : 112257
actgctttgacaataggaattctgatgtgcaattcatgtccagctgctctagttccaacctgcagcagcagtcagacatgaggtgcaaggggcttcaagggtggaaacccagacgcgaacgagcacagtggcctcggctccacttgctgagacatctctgcaagggatgttggaatgacgtcactccagcaagcctcccgggaagctcagagatctgttcatacctgccctggctaatctttagaagcaggatctgtgcacaaggtgtggccgcttctcatattcacaatcacttttcttttctttctttctttctttctttctttctttctttctttctttctttctttctttctttcttttttttgagatagagtctcgctctgtcacccaggctggagtgcagtggcgtgatttcagcttactgcaagc

SEQ ID NO: 24934 - DNA, 315 bp, Homo sapiens
  DISO7_00004489
  Located on chromosome 20
  Distance between a terminus base of telomere on chromosomal short arm and 5'-terminus of this base sequence : 59350599
  Distance between 3'-terminus of neighbour sequence of sequence listing upward to telomere on chrosomal short arm and 5'-terminus of this base sequence : 97313
acctcaatgcagtggattaaaaactaaagtgaaatccatacttttccctcaacctcaaggctcccccatgacctctcctgcctcccaggatcctcccacactggtccccacgctctggtcggctggtcctcaggtccaaggagctgcttacctttggactgtgtgcatgtgcatggctccacctagacagctctcctgccatgcatctgcaccgacagccattgagtacattctgagtgtgtgtgtgtgtgtgtgtgtgtgtgtgtgtgtgtgtacgggggggtgtagtatttaattcaaggcaaacattaatca

SEQ ID NO: 24935 - DNA, 111 bp, Homo sapiens
  DISO7_10000257
  Located on chromosome 20
  Distance between a terminus base of telomere on chromosomal short arm and 5'-terminus of this base sequence : 59405189
  Distance between 3'-terminus of neighbour sequence of sequence listing upward to telomere on chrosomal short arm and 5'-terminus of this base sequence : 54275
aattctaatttaagccaggcctttgaatgtcagctggcctctctctctctgctctctcttttcttctctctctctctttcctgcccccacccgcaaataataagcatatga

SEQ ID NO: 24936 - DNA, 207 bp, Homo sapiens
  DISO7_10000259
  Located on chromosome 20
  Distance between a terminus base of telomere on chromosomal short arm and 5'-terminus of this base sequence : 59592173
  Distance between 3'-terminus of neighbour sequence of sequence listing upward to telomere on chrosomal short arm and 5'-terminus of this base sequence : 186873
actttcttgctggcacatcctgcattttaatgtgtgtgtgtgtgtgtgtgtgtgtgtgtgtttaacctagcatttttagatgcttttggtggggggagtttttacatctggcccatcattccgccaggaggcattctttttaatagctgcataaaattccacattataaatggcccacttttaaaatcattgatggacggatagtca

SEQ ID NO: 24937 - DNA, 156 bp, Homo sapiens
  DISO7_10000260
  Located on chromosome 20
  Distance between a terminus base of telomere on chromosomal short arm and 5'-terminus of this base sequence : 59616466
  Distance between 3'-terminus of neighbour sequence of sequence listing upward to telomere on chrosomal short arm and 5'-terminus of this base sequence : 24086
acatccgtcaactccagccgctgctgattgcccccaggggattaccagtatgcctccccacacacacacacacacacacacacactctctctctctctctctctctctcagctcagcctgcacacatctgaggagcccctgaagccagaagacatg

SEQ ID NO: 24938 - DNA, 381 bp, Homo sapiens
  chr20.fa.O7frz.64361101
  Located on chromosome 20
  Distance between a terminus base of telomere on chromosomal short arm and 5'-terminus of this base sequence : 59823758
  Distance between 3'-terminus of neighbour sequence of sequence listing upward to telomere on chrosomal short arm and 5'-terminus of this base sequence : 207136
ctgtccatcttcctacttgttagcccatctatcatttcatctattcttccagtcattcatccgtctttccttccatccatccatccatccatccatccatccatccatccttgctagattctaggtattccatgaccaacaaggctaatgaggtgcctgctttcacgggtctaatgttcttactgttcattcttcaccaccctgtaccaccatggaaaagggggaactgtgtagtttcctgacaaggccttcattacatccccactgagcatccacctctgggttcatctagtatgactctgctttcaaaactgcctcagtcactccctcatgcaaggaaaagccgcattcattgatgtaaagactgtgcctagataattg

SEQ ID NO: 24939 - DNA, 200 bp, Homo sapiens
  DISO7_10004512
  Located on chromosome 20
  Distance between a terminus base of telomere on chromosomal short arm and 5'-terminus of this base sequence : 59958512
  Distance between 3'-terminus of neighbour sequence of sequence listing upward to telomere on chrosomal short arm and 5'-terminus of this base sequence : 134373
gatacggtgcgtgttcacatgtgtgtatgtgtgtgtgtggaggggtatgtgtgcatgtgtgtagagggtatgtgggatacggtatgtgttcgtatgtgtgtgtgtggaggggtgtgtgtgcatgtgtggagggggtatgtgggatacggtgtgtgttcgtgtgtgtgtgtgtgtgtgtggaggggtgtctgtgcatgtgt

SEQ ID NO: 24940 - DNA, 289 bp, Homo sapiens
  AL109911.46_126160
  Located on chromosome 20
  Distance between a terminus base of telomere on chromosomal short arm and 5'-terminus of this base sequence : 60301961
  Distance between 3'-terminus of neighbour sequence of sequence listing upward to telomere on chrosomal short arm and 5'-terminus of this base sequence : 343249
ggttgtaatccacctgacataaggagaggtctctttaaagcatggatggatggatggatggatggatggatggatggatggatggatgggtgagtggatggtggatgatggatgatggatgggtgggtggatggtggatgatggatgagggatgggtgggtagatgatgggtgatagatgaatggatgatgcatggatggatggatggatggatggatagatgatggatgagtgagtggatgatggatggatgatggatggatggatgatggatgagtaagtggatggt

SEQ ID NO: 24941 - DNA, 384 bp, Homo sapiens
  chr20.fa.O7frz.63675271
  Located on chromosome 20
  Distance between a terminus base of telomere on chromosomal short arm and 5'-terminus of this base sequence : 60486850
  Distance between 3'-terminus of neighbour sequence of sequence listing upward to telomere on chrosomal short arm and 5'-terminus of this base sequence : 184600
cagatccaaattctgttgatactctttgtctaaatctctagttgagcactgaactacatgtatgggacagactccaagcaactcgacctagaataaaacaacagaaatgagatttgagccactgtccaagggactgggtttgcagtctcagttccatcaagccgattgtttgctaccacacacacacacacacacacacacacacacacacacatatcaatgctctactccaaactgtcacaatgttcaggataaaattcaaaattactgaatatacaaagaaaaaaattgttatacattctccatcctactggaaattgacccgataggactcagattgatgaattcgcaaacaaggattttaaagcaactattgtaattgct

SEQ ID NO: 24942 - DNA, 248 bp, Homo sapiens
  DISO7_10000265
  Located on chromosome 20
  Distance between a terminus base of telomere on chromosomal short arm and 5'-terminus of this base sequence : 60572928
  Distance between 3'-terminus of neighbour sequence of sequence listing upward to telomere on chrosomal short arm and 5'-terminus of this base sequence : 85694
gagaagccactccaggagcagccgcagctctcgggtcgggggtggggagaggtgggatggggagaggtggggtggggagaggtggggtggggtggggagaggtggagagaggtggggtggggagaggtggagagaggtgggatggggagaggtggggagaggtggggtggggagaggtgggatggggagaggtgggatgggggccctgcgtctccctggagcctctccgggtgctttgagccactgtg

SEQ ID NO: 24943 - DNA, 133 bp, Homo sapiens
  DISO7_10000263
  Located on chromosome 20
  Distance between a terminus base of telomere on chromosomal short arm and 5'-terminus of this base sequence : 60742053
  Distance between 3'-terminus of neighbour sequence of sequence listing upward to telomere on chrosomal short arm and 5'-terminus of this base sequence : 168877
agctcagagtcctggcagcagcagcccagcccagcccagcccagccctgggccctggctgctcaggggaggccactccaagccaaacagcagctttcgggggcatgaggaggcagcagcattcatgagacctc

SEQ ID NO: 24944 - DNA, 170 bp, Homo sapiens
  DISD22_0001347
  Located on chromosome 20
  Distance between a terminus base of telomere on chromosomal short arm and 5'-terminus of this base sequence : 61058358
  Distance between 3'-terminus of neighbour sequence of sequence listing upward to telomere on chrosomal short arm and 5'-terminus of this base sequence : 316172
gacttagcaggagggagatcttgagagagagagagagagagagagagagagagagagagagagaaggcgctggtgcagagttagggagaggcggccgagctgcacaccttgagccccggcctcctccgaagggaacccctgcaccccagcggggtcagcacaaggtagag

SEQ ID NO: 24945 - DNA, 164 bp, Homo sapiens
  DISO7_00001091
  Located on chromosome 20
  Distance between a terminus base of telomere on chromosomal short arm and 5'-terminus of this base sequence : 61315457
  Distance between 3'-terminus of neighbour sequence of sequence listing upward to telomere on chrosomal short arm and 5'-terminus of this base sequence : 256929
atgagtctgcagaaatctggggcacctgccaaagtccaggcatcatcccatcagatagcagcatgtgtgtgcatgtgaccatgtgaccacacacacacacacacacacacacacagttgtcatgcagtgtcccggtgaatgggggctcctagcccatcctgaag

SEQ ID NO: 24946 - DNA, 295 bp, Homo sapiens
  AL035669.43_40338
  Located on chromosome 20
  Distance between a terminus base of telomere on chromosomal short arm and 5'-terminus of this base sequence : 61424033
  Distance between 3'-terminus of neighbour sequence of sequence listing upward to telomere on chrosomal short arm and 5'-terminus of this base sequence : 108412
gtttagaaggctttggtcaaacatatatatatatatatatatatatatatatatatatatatttggggcatacttacactacaaaattattcaatgtttttctgaaattcaaatttacctgggcatcctgtatttttatgttaaatctggcaacccctgaaaagagccaaaaccccctcaggcggtcgagagtgcggcagccaagccagcacgctgcagctccctccttctcggggccgtggcctggccctgcaggggacatcgtgggaacaataattgtccaagtctagtgctg

SEQ ID NO: 24947 - DNA, 292 bp, Homo sapiens
  chr20.fa.O7frz.65151000
  Located on chromosome 20
  Distance between a terminus base of telomere on chromosomal short arm and 5'-terminus of this base sequence : 61718797
  Distance between 3'-terminus of neighbour sequence of sequence listing upward to telomere on chrosomal short arm and 5'-terminus of this base sequence : 294469
gatttgatggtaagcttcactaataaactgtttaaaacatacgctaattgtgtttattgtattctttaattatcatatgtatcattaaggatgtgcttctcctggaatccgagggccttgcagcctctccccgccgtgtgtgcatgcgtgcacatgtctgtgtctccatgcgtgtctgtgtgtgtgtgtgtgtgtgttcctagtgcacagaacatttaccttttacaaattagaagaaacatctgtgggagcctgtggtcagttcggccttcatttaaagtgaggatttaga

SEQ ID NO: 24948 - DNA, 460 bp, Homo sapiens
  AL096828.29_121515
  Located on chromosome 20
  Distance between a terminus base of telomere on chromosomal short arm and 5'-terminus of this base sequence : 61844582
  Distance between 3'-terminus of neighbour sequence of sequence listing upward to telomere on chrosomal short arm and 5'-terminus of this base sequence : 125493
tcatacctgtaatcctagcactttgggaggccaaagcaggaagatcacttgagcccagaagttcaagactagcctgagcaacacaaagagaccctgtgtctacaaccaaccaatcaatcaatcaccaggtgtagtggtgcatgcctgtagtcccagctattcaggaggctgaggcaggaggattgcttaagcccaggaatttgaggctacagtgagctataatcatgcccctgaactctagcttgggtaacagcaggaccctgtctccaaaatacacacacacacacacacacacacacacacacacacacacacacacacttttaagtgtactgatgcaacctccctccccctttattggctaaaattcagtacataataccattaaagtactaaaataataagaacacactagaaaacaagaaattcaaaaaattagttaacttcctgccattacctc

SEQ ID NO: 24949 - DNA, 189 bp, Homo sapiens
  DISO7_10375115
  Located on chromosome 20
  Distance between a terminus base of telomere on chromosomal short arm and 5'-terminus of this base sequence : 61992708
  Distance between 3'-terminus of neighbour sequence of sequence listing upward to telomere on chrosomal short arm and 5'-terminus of this base sequence : 147666
tcctcacatgagcccttcccaccccaggacctgtgtgtgtgccgggcgtgcgctctgtgtgtgtgtgtgtgccgggcgtgtgctgtgtgtgtgtgtgtgtgtgtgtgtgtgtgtgccgggcgtggcgtgcgctgacctctcttggcctccggctctctcccacccctgggtgtaattgtgatttcctcg

SEQ ID NO: 24950 - DNA, 113 bp, Homo sapiens
  DISO7_10385100
  Located on chromosome 20
  Distance between a terminus base of telomere on chromosomal short arm and 5'-terminus of this base sequence : 62095892
  Distance between 3'-terminus of neighbour sequence of sequence listing upward to telomere on chrosomal short arm and 5'-terminus of this base sequence : 102995
aaatcatactggctggacatcattttatatatttcagggtttccgtgggtgtcttttctgtgtgtgtgtgtgtgtgtgtgtgtgtgtgtgcacatgtcatgtgaatttgacct

SEQ ID NO: 24951 - DNA, 159 bp, Homo sapiens
  chr20.fa.O7frz.65699945
  Located on chromosome 20
  Distance between a terminus base of telomere on chromosomal short arm and 5'-terminus of this base sequence : 62247612
  Distance between 3'-terminus of neighbour sequence of sequence listing upward to telomere on chrosomal short arm and 5'-terminus of this base sequence : 151607
gcaaattagtgaaagtactgaaagtctctgataagcagaaataatggcgtaagcggtctctctctctctctcctctctctctgcctcagctgccaggaagggaagggccccctggccagtgggcacgtgacccacatgaccttacctatcactggacat

SEQ ID NO: 24952 - DNA, 206 bp, Homo sapiens
  AL121845.20_34519
  Located on chromosome 20
  Distance between a terminus base of telomere on chromosomal short arm and 5'-terminus of this base sequence : 62363758
  Distance between 3'-terminus of neighbour sequence of sequence listing upward to telomere on chrosomal short arm and 5'-terminus of this base sequence : 115987
tctttatttggcaaagttgaagattgcagttctgtctgtccccacatttcctcttcattctctctctctctctctctctctctctctctctctctctctctctctctgtgtgtgtgtgtgtgtgtgtctcggttttggttttaattttactggttcactgatgcctaaaagtcaaggcatcactatttcataagcaggttctccta

SEQ ID NO: 24953 - DNA, 133 bp, Homo sapiens
  DISO7_10008716
  Located on chromosome 20
  Distance between a terminus base of telomere on chromosomal short arm and 5'-terminus of this base sequence : 62456731
  Distance between 3'-terminus of neighbour sequence of sequence listing upward to telomere on chrosomal short arm and 5'-terminus of this base sequence : 92767
gacctttgtcctctaggaaccttgtgtgtgtgtgtgtgtgtgtgtgtgtgtgttctttgggactgctccgttttctgtttgtaaaaggaaatgtaaaccgttgaatgggctccccacaggactaacgtaaacg

SEQ ID NO: 24954 - DNA, 148 bp, Homo sapiens
  DISO7_10000266
  Located on chromosome 21
  Distance between a terminus base of telomere on chromosomal short arm and 5'-terminus of this base sequence : 7782483
  Distance between 3'-terminus of neighbour sequence of sequence listing upward to telomere on chrosomal short arm and 5'-terminus of this base sequence : 0
catggattagtttgtgtaagtgtgttgaagagacgtgtggatggatggatgaatggatggatggatgaatggatggatggatggatggatggatgaatggatggatggatggatggatggatggatggggtatacttgctcatgtgcc

SEQ ID NO: 24955 - DNA, 441 bp, Homo sapiens
  chr21.fa.O7frz.10136449
  Located on chromosome 21
  Distance between a terminus base of telomere on chromosomal short arm and 5'-terminus of this base sequence : 7855384
  Distance between 3'-terminus of neighbour sequence of sequence listing upward to telomere on chrosomal short arm and 5'-terminus of this base sequence : 72753
gatgagcttgtaacatcttgttacaccaaaaagtatgaaatgttcaaaaaagcggtgagggcagaacaccagtgccagcttgaaggagcaactgacagcaagtatgcgactatttgagccaaaaaataattaggtaatgagttgtaaatgattgaagataataggagttcatgagtcaatattaatagtaagtaagcttaacatgtgaaagaagtgttcttgcttacaaaagaaagcagagggctaactggtaaatgtggtgggagtgctagacctggaaatgcatcatttgcaaccaaaagaaagcatgttaaaatggcatcatcaggcagtaagtttgttgttgttgttgctgttgttgctgttgttgttgctgttttttgagatagagtctatctctgtcacccaggctggagtgtagtagcatgagtccaactcact

SEQ ID NO: 24956 - DNA, 463 bp, Homo sapiens
  chr21.fa.O7frz.10230106
  Located on chromosome 21
  Distance between a terminus base of telomere on chromosomal short arm and 5'-terminus of this base sequence : 7948949
  Distance between 3'-terminus of neighbour sequence of sequence listing upward to telomere on chrosomal short arm and 5'-terminus of this base sequence : 93124
gtggtcttcatgtaaagacaaggtgtttcttctggaagattcatcaggaaggtgccatcttggaggcaaagaagagccctcatcagggctgtttatctatccacctacctatctatcaatatctattgataggtaggtggatagatagatacatagatgattgatagatgatagatgatgaatatatagatagatgatagatgattgatagttgatagatgattgatagatgattgatagttgatagatgattgatagatgatagatgttagatacatagatgatagattgatgataggtagatgatagatgaatatatagataaatgatagatgattgatagaaagatgatagatgttagatatatagatagatagatagtagatagatcaattgactgatagatgatagataggtaatagacagataggaactctccagtcagcctagacttagctagtca

SEQ ID NO: 24957 - DNA, 101 bp, Homo sapiens
  DISD22_0001459
  Located on chromosome 21
  Distance between a terminus base of telomere on chromosomal short arm and 5'-terminus of this base sequence : 11182681
  Distance between 3'-terminus of neighbour sequence of sequence listing upward to telomere on chrosomal short arm and 5'-terminus of this base sequence : 3233269
tctagtgtagctgaacatcacgtttattgacaatattgcacttgtgtgtgggtgtgtgtgtgtagctactctttacctttgttctcacgtaatgattagat

SEQ ID NO: 24958 - DNA, 307 bp, Homo sapiens
  chr18.fa.O7frz.18221617
  Located on chromosome 21
  Distance between a terminus base of telomere on chromosomal short arm and 5'-terminus of this base sequence : 11467498
  Distance between 3'-terminus of neighbour sequence of sequence listing upward to telomere on chrosomal short arm and 5'-terminus of this base sequence : 284716
taacttgaaggtgagttgtgatgaggtaaatccatacactataaatcctaaaacaaccactaagacagcaaagcaaagttatacctaatagccaaataaacttataccacaaaaagatatgactaaatcatgaagaaatatacaaccagatcaataactaaaaaacattatacctatatatatatatatatatatatatatatacatataaaactaaattataaaaattactaaactagtctgaaggaagcaataaaagaacaaaacaaagcaaagaagatctgggactaacagaaatcaaacagca

SEQ ID NO: 24959 - DNA, 268 bp, Homo sapiens
  AL163203.1_292311
  Located on chromosome 21
  Distance between a terminus base of telomere on chromosomal short arm and 5'-terminus of this base sequence : 11631208
  Distance between 3'-terminus of neighbour sequence of sequence listing upward to telomere on chrosomal short arm and 5'-terminus of this base sequence : 163403
ttcgttcttaggctgaaatattaccttcttcatcaaacttacctgaccgcatgtttgatgttgtttgagtaaaatataatactcttttatttcccaaatgcacacagacacacacacacacacacacacacacacacacacacacatattatgttttgggaaatatatgtgctatagtatctatatttattcacttcttaaatttgtacttaattaaaatgacaagatgaatttgctgaaaggagttggtaaaatgatcagctgtatt

SEQ ID NO: 24960 - DNA, 388 bp, Homo sapiens
  AL163204.1_332428
  Located on chromosome 21
  Distance between a terminus base of telomere on chromosomal short arm and 5'-terminus of this base sequence : 12010148
  Distance between 3'-terminus of neighbour sequence of sequence listing upward to telomere on chrosomal short arm and 5'-terminus of this base sequence : 378672
actctgaatgtcagtgaatgattaatggtgggaaggaaaagtgttattctgtaagctgagagatattgccagtaatatttcctttcacttcccagtcacaaatgtagagaaagacagataagtcaggctaatttactgaaaaggagaactttgaaggaagtagcacctatcaaatgccaattcttctagagatttcttacgtttttgagatacagaaatttatatgttgcacttatctgttctggggttcttaatcaggagtgtatcctaaacttgagggtttttgtgtgtgtgtgtgtgtgtgtgtgtgtgtgtgtgtgtgctgttattgttgttagaggcaagagtctcactatgttgctcaagctgaacttaaactcaggctcaa

SEQ ID NO: 24961 - DNA, 419 bp, Homo sapiens
  AP001660.1_50710
  Located on chromosome 21
  Distance between a terminus base of telomere on chromosomal short arm and 5'-terminus of this base sequence : 12067504
  Distance between 3'-terminus of neighbour sequence of sequence listing upward to telomere on chrosomal short arm and 5'-terminus of this base sequence : 56968
agatgttaatgagttcaagaccatgcctttagacccggctattgtaggagcaaatacaaattagaaagaaaaggtttaatgctttctctttaaaatgagggaagaatttttgctcttctttcttttcttaaagcatttagtttgaaaacctttctctacttctttgaaatatatgtaaatcatttttatcagttaaataggtcatttggttgtgtgtgtgtgtgtgtgtgtgtgtgtgtgtgtgtgtgtgtatgtgtttgactcagaattgtcttaatctaggacctgggaactattgctttgaaatgtaattagcaagtttatacaccctatcccacagtttctgtaggagagtagaaggctgccttcagcaggtgtctaactccacattgcaacactacctcctgtcatgaagatga

SEQ ID NO: 24962 - DNA, 450 bp, Homo sapiens
  AP001660.1_101073
  Located on chromosome 21
  Distance between a terminus base of telomere on chromosomal short arm and 5'-terminus of this base sequence : 12117891
  Distance between 3'-terminus of neighbour sequence of sequence listing upward to telomere on chrosomal short arm and 5'-terminus of this base sequence : 49968
acatagaaattacacatagccaagtgcagtggctcacgcctgtaatctcagcactttgggaggctgagacaggtggatcactttgtagcatcattgctgcctcgaaaggacagaggcgtgtgtttatgtcactattggttttatttttttcttttttcctggaaactcattttttattattattattagtagtagtagtagtagtagtagtagtagtattttggatacggagtttcactcttcttgcccaggctggagagtaatggtgcaatctcggctcaccgcaacctctgtctcacggattcaaggattacaagcaagtgctgccatgcccagctaacttggtatttttagtacagatagggtttctccatgttggtcaggctggtctcgaactcccaacctcaggtgattcccccgcatcagcctctgtaagtgccaggattacat

SEQ ID NO: 24963 - DNA, 211 bp, Homo sapiens
  Z67245
  Located on chromosome 21
  Distance between a terminus base of telomere on chromosomal short arm and 5'-terminus of this base sequence : 12340608
  Distance between 3'-terminus of neighbour sequence of sequence listing upward to telomere on chrosomal short arm and 5'-terminus of this base sequence : 222267
ctgattcagtcaaagtggaagcaatttagttttctttatggttgtaccatcattttttatcttcacgattgtgtgtgtgtgtgtgtgtgtgtgttgtttgtttgtatgtgtgagtttttttcttctatgatatagattggcagatcattatcgtgtgactcatttacagatcctcaaactttatgcatgggaaccctcctataaaaataag

SEQ ID NO: 24964 - DNA, 391 bp, Homo sapiens
  AL163206.1_35805
  Located on chromosome 21
  Distance between a terminus base of telomere on chromosomal short arm and 5'-terminus of this base sequence : 12391623
  Distance between 3'-terminus of neighbour sequence of sequence listing upward to telomere on chrosomal short arm and 5'-terminus of this base sequence : 50804
agaaagcatgtgaaattgaaaccaatgcagttgctgttgaaagagtttgtgaatatgaaaatatggataaagaagtaagcacgcctcctgtaatcccagtactttgggagtcatgggaggatcacttaagttcaagagttcaagaccagcctggtcaacatagtgagattctgtctctacaaaaataaagaaagaaagaaagaaagaaagaaagaaagaaagaaagaaagaaagaaagaaagaaagaaagaaagctgggtatggtggcttatgcctttagttcaagctacttgggagggtgaagtaggagaatcccttctgcttgggagttcaaggttgcagtgagctatgatcacgccactgcactctagcttgagtgatagagcaagat

SEQ ID NO: 24965 - DNA, 445 bp, Homo sapiens
  AL163207.1_59832
  Located on chromosome 21
  Distance between a terminus base of telomere on chromosomal short arm and 5'-terminus of this base sequence : 12754658
  Distance between 3'-terminus of neighbour sequence of sequence listing upward to telomere on chrosomal short arm and 5'-terminus of this base sequence : 362644
caattcaatccatagcaaatctactcaaaaacttagatattacaaattgaaatcctcccaaaatggcaaactcactcacaggaaggcaagaaaagggagacacagggatgagaaacagatggactagaaaacaaacaaacaaacaaacaaacagtatggcagacttaagccctatcatattacctataatgtaaataatttaaatatacaatatagtaacagaggttggcagaatgaataaaatatatgattcaactagatgctatctacaagaaactcagttcaaaaacaacatatgtaggttgaaagtaaaagaatagaaagagatgcaccatgcaggtgtaaattttcaagagctcagaaggaactctttgatcccttacacactcatgatgctcagatactttaatacacagtgagtctcagtcttcgtgaaattgataat

SEQ ID NO: 24966 - DNA, 378 bp, Homo sapiens
  AL163207.1_107159
  Located on chromosome 21
  Distance between a terminus base of telomere on chromosomal short arm and 5'-terminus of this base sequence : 12801928
  Distance between 3'-terminus of neighbour sequence of sequence listing upward to telomere on chrosomal short arm and 5'-terminus of this base sequence : 46825
atcacctcaataagtattctgcactgagatagtctttatctccccgaaagccttccaatgagaataaacttctaattccctgcattaaacatttcaaacttgcaatacgtagagtagctgagatttccttgaacaaaccttgacatataatgtccatcattatgccataacgctctcaagtagggacacacacacacacacacacacacacacacacacataaaaaccaaaattcttaccattaccaaaatccaattcattgttttgatacatgcttttctgtatggcatgtccttttcctgacatttctgtctgacaaaagtcctgttcatccttcaaattcaaataccaccgtctaactgagtccttccataattc

SEQ ID NO: 24967 - DNA, 126 bp, Homo sapiens
  D21S1911
  Located on chromosome 21
  Distance between a terminus base of telomere on chromosomal short arm and 5'-terminus of this base sequence : 12804952
  Distance between 3'-terminus of neighbour sequence of sequence listing upward to telomere on chrosomal short arm and 5'-terminus of this base sequence : 2646
agctcctgaggagacatccttgacaaaatacacacacacacacacacacacacaagcacatgcatgcactcacacgtgcacacacacacacacactcactcatacttgctgtgtgtatgtaaggga

SEQ ID NO: 24968 - DNA, 101 bp, Homo sapiens
  DISO7_10004521
  Located on chromosome 21
  Distance between a terminus base of telomere on chromosomal short arm and 5'-terminus of this base sequence : 13192271
  Distance between 3'-terminus of neighbour sequence of sequence listing upward to telomere on chrosomal short arm and 5'-terminus of this base sequence : 387193
atctggaggaagaaatgaaggtcagacccgtcacacacacacacacacacacacacacacacacacacacactccccacgtggcactgtggaattagatga

SEQ ID NO: 24969 - DNA, 317 bp, Homo sapiens
  AL163208.1_301542
  Located on chromosome 21
  Distance between a terminus base of telomere on chromosomal short arm and 5'-terminus of this base sequence : 13335191
  Distance between 3'-terminus of neighbour sequence of sequence listing upward to telomere on chrosomal short arm and 5'-terminus of this base sequence : 142819
ctgaggttggaagttcaagaccagcctgaccaacatggagaaaccccatctctactaaaaaaatacaaaattagccgggcgtggtggcatatgcttgtaatcccagctactcgtgaggctgaggcaggagaatcgcttgaacccggaaggcagaggttctggtgagctgagatctcgccattgcactccagcctgggcaacaagagtgaaactctgtctcaaaaaaatgaaaaaataaataaataaataaataaataaataaataaataaataaattaaataaattctacacgtctaactacttgcagatcgcaata

SEQ ID NO: 24970 - DNA, 279 bp, Homo sapiens
  AL163209.1_265491
  Located on chromosome 21
  Distance between a terminus base of telomere on chromosomal short arm and 5'-terminus of this base sequence : 13638218
  Distance between 3'-terminus of neighbour sequence of sequence listing upward to telomere on chrosomal short arm and 5'-terminus of this base sequence : 302710
ctcttatctgaaatctgagtccagtttttctgcctgccccatgaatttcaggcttgccagtcccaataattgagtcaattctttaaaatagatctctctctctcaatctctctctcaatctctctctctctctctctctctctctctctctcgtgtgtgtgtgtgtctgtgtgtgtgtgtgtgtgtgtgtgtgtgtgtgtgtgtgtttccctggagaaccctgactaattcttacaccttccaaggaaggaataagtttccaatggttatttgtaacat

SEQ ID NO: 24971 - DNA, 238 bp, Homo sapiens
  AL163209.1_277489
  Located on chromosome 21
  Distance between a terminus base of telomere on chromosomal short arm and 5'-terminus of this base sequence : 13650196
  Distance between 3'-terminus of neighbour sequence of sequence listing upward to telomere on chrosomal short arm and 5'-terminus of this base sequence : 11699
gctctagtcctttacatttggactggctttcctggctccccagcttctagatggcctattgtggagctcaggctccataatcccatgagccaattgccctaataaattccctctcatctgtctatctatctatctatcatctatctatctatctatctatctatctatctatctatctatctatcatctatctatctatcatctatctatcatctcctattggttctatctcttagga

SEQ ID NO: 24972 - DNA, 473 bp, Homo sapiens
  AL163210.1_3461
  Located on chromosome 21
  Distance between a terminus base of telomere on chromosomal short arm and 5'-terminus of this base sequence : 13715096
  Distance between 3'-terminus of neighbour sequence of sequence listing upward to telomere on chrosomal short arm and 5'-terminus of this base sequence : 64662
taggaaattaccattcagcaactgtcaaagcaatacctgatctcggcaagaatcatcaatgaatgctaaacctcgtgagtgaaagtaatatgaaaaatagattgtatcggtcagagttctcctgagacacagattcaacagaatctgttacatctctctatttatatttatataaaatataaaattatacatatagacatatattctattacacacacacacacacacacacacacacacacacacagatgtaatttaaggaattggtgcatatgattgtggcggctggcaagtcaggccagcaggctgaaaacaaaggcaaaatttctgtgttacaatctcaaggcagaattcttcctctccagaaaacttcaggttttgttcctaaagccttcagttaattgaatgatgcccaatcacattactgagagtaaccttctttatttaaagtgaactgattggaaacaatactc

SEQ ID NO: 24973 - DNA, 376 bp, Homo sapiens
  AL163210.1_215993
  Located on chromosome 21
  Distance between a terminus base of telomere on chromosomal short arm and 5'-terminus of this base sequence : 13927713
  Distance between 3'-terminus of neighbour sequence of sequence listing upward to telomere on chrosomal short arm and 5'-terminus of this base sequence : 212144
caggaaagttattcagataccaactgttccatgatggttaaatctcagaaatctataattctcatagaagataccataggagagtatctttaaatcttggaataacaatgggtctcttcatacacacacacacacacacacacacacacacacacacacacacacacaaattaaacatggtggaaatttttgacaaatttaaccacattaaatattctgtccattaagattccccaaagatggtggaaagatggcaggttagtgggagaagatatttgcagcatgcaaggcaagatgacaatgcactaataacaaaatttcataaaacaatggacttggggcttgggaaaaataattatgacatgctttctgaagt

SEQ ID NO: 24974 - DNA, 225 bp, Homo sapiens
  AP001666.1_206516
  Located on chromosome 21
  Distance between a terminus base of telomere on chromosomal short arm and 5'-terminus of this base sequence : 14257181
  Distance between 3'-terminus of neighbour sequence of sequence listing upward to telomere on chrosomal short arm and 5'-terminus of this base sequence : 329092
tcattgacgtttcataaatgtagtgttaatatcgcacaaagcaaaatgtttagaggaggaagaataacattaggaatagcaacctgccatatatatatatatatatatatatatatatatatatatgacttaccaacataatccatagggtgtcacaattaggagtttattagggacgtttgtgagaccagtctcagtaacatagtggaagtataagtggagcac

SEQ ID NO: 24975 - DNA, 289 bp, Homo sapiens
  AP001666.1_311653
  Located on chromosome 21
  Distance between a terminus base of telomere on chromosomal short arm and 5'-terminus of this base sequence : 14362226
  Distance between 3'-terminus of neighbour sequence of sequence listing upward to telomere on chrosomal short arm and 5'-terminus of this base sequence : 104820
atactgttaggtgcatctgactttttccatcttaaattttgcatgcacaaagtatatttcttgttcaaaatttaaatcctaacaataatatagcaaaggtagatcatgcttttgagaagctttttaaattaacaagtgtttaaaagtctttgtatatatgtctgttacatgtgtgtgctatgtgtgtgtgtgtgtgtgtgtgtgtgtgtgtgtgtgtgtgtttagcattgagcctaagttccaagcaaccagtgtgggtcaggcagatttagttcagctggaacgtaag

SEQ ID NO: 24976 - DNA, 233 bp, Homo sapiens
  D21S1886
  Located on chromosome 21
  Distance between a terminus base of telomere on chromosomal short arm and 5'-terminus of this base sequence : 14393893
  Distance between 3'-terminus of neighbour sequence of sequence listing upward to telomere on chrosomal short arm and 5'-terminus of this base sequence : 31378
catgcaatctgttgttgaacctcaaattttaaggaagcaagagatagtcctttgactcctcagccgtgtggggtgtgtgtgtgtgtgtgtgtgtgtgtgtgtgtgtgtgtgtgtgtttaagcacatataggtgatgagtattagaagggggaaatcttgcaaagccacaccacatcacaataaaaaatgtgctattcttctgagttgactctaatggtagggtatagatcccg

SEQ ID NO: 24977 - DNA, 221 bp, Homo sapiens
  AP001667.1_40017
  Located on chromosome 21
  Distance between a terminus base of telomere on chromosomal short arm and 5'-terminus of this base sequence : 14429682
  Distance between 3'-terminus of neighbour sequence of sequence listing upward to telomere on chrosomal short arm and 5'-terminus of this base sequence : 35556
ggtaaggctaactagtgtacatgtgcctgtctaattaataggtagacacatgtaggtgaaggagccacagaggaggaagacatcttttttattattattattattattattattatactttaagttttagggtacatgtgcacaatgtgcaggttagttacatatgtatacgtgtgccatgctgctgtgctgcacccattaactcgtcatttagctttagg

SEQ ID NO: 24978 - DNA, 324 bp, Homo sapiens
  AP001667.1_305009
  Located on chromosome 21
  Distance between a terminus base of telomere on chromosomal short arm and 5'-terminus of this base sequence : 14694710
  Distance between 3'-terminus of neighbour sequence of sequence listing upward to telomere on chrosomal short arm and 5'-terminus of this base sequence : 264807
tacctatgtagcaaacctgcacatgtatccctgaacttaaaataaaagttaaacacacacacacacacacacacacacacacacacacacacacacacaaattagtgttgcgagacaaaatccttaagttttttatggatctcttataaacagaacacataaacatttatgaaaatataacaaaactttcaggcagaaaaaatatgagttcattcattaaacaagtatttatttattctctggtatgtgccaggcacagtctggccttctggagacatcactgcataaaacagtcaaaatacctgacatcgcggaacattaatt

SEQ ID NO: 24979 - DNA, 327 bp, Homo sapiens
  AL163213.1_130990
  Located on chromosome 21
  Distance between a terminus base of telomere on chromosomal short arm and 5'-terminus of this base sequence : 14859594
  Distance between 3'-terminus of neighbour sequence of sequence listing upward to telomere on chrosomal short arm and 5'-terminus of this base sequence : 164560
ttcagaatatcctaacatccatacctctaataaggaccaaattccagcacagtctagttagggagtcatcatgcattctcttctttcttctttcttctttcttcttccttcttccttcttccttcttccttcttccttcttccttcttccttcttcttcttcttcttcttcttcttcttctcctcctcctcctcctccttctccttctcctcctcctcctccttcttcttcttattttcttttctttttcttttttgacagaatctcacttttttcacccaggctaaagtggagtggcacgattttggctcacttcagtcttgaccg

SEQ ID NO: 24980 - DNA, 379 bp, Homo sapiens
  AP001669.1_166604
  Located on chromosome 21
  Distance between a terminus base of telomere on chromosomal short arm and 5'-terminus of this base sequence : 15234239
  Distance between 3'-terminus of neighbour sequence of sequence listing upward to telomere on chrosomal short arm and 5'-terminus of this base sequence : 374318
aaatcaacgctaagtgaatgatgtaactgttttgtatcttttcatccactcaaaaagaagaaagaaagaagaaagagagagagagaggaaggaagggaggaaggaaggaaggaaggaaggaaggaaggaaagaaggaaggaaggaaggaagcgaaggaaaagaaggaaaggaaggaaaggaaggaagattttatttcctccgattaaaagttgcattttcttttctgtctccttttttccttcctctcccccatctgcccactgttccctctttccttttctccatttgtatgacagtggcactgattcaaagaaggggtggagtccgaaattttgggtggtcttagtaaagctttagtctttggctaacctctcctta

SEQ ID NO: 24981 - DNA, 428 bp, Homo sapiens
  AP001669.1_294786
  Located on chromosome 21
  Distance between a terminus base of telomere on chromosomal short arm and 5'-terminus of this base sequence : 15362289
  Distance between 3'-terminus of neighbour sequence of sequence listing upward to telomere on chrosomal short arm and 5'-terminus of this base sequence : 127671
ttgtaatgccaagaggataaatgcctgaaatgatggataccacatttaccctgatgtgataattatgcattatatgcctgtatctcatatacctcatgaatatatatatctattatgtacccacaaaaatttaaaaaaaggaaataagaggcatccaaattggaaagaaaaacgtaaaactatctctgtttacagaagacacgtcatatatttagaaaatgctaaaactacacacacacacacacacacacacacacacacacacacacacacaaactcttagaactaatccagtaaagggcaggatacaaaatctactgttactttttaaagactttaaagcaattctctgttttgttttttcagttatcatcaatatgctacctttaaaaaaaaagttttacttacattatggatacctgttttcc

SEQ ID NO: 24982 - DNA, 416 bp, Homo sapiens
  AP001670.1_21231
  Located on chromosome 21
  Distance between a terminus base of telomere on chromosomal short arm and 5'-terminus of this base sequence : 15427821
  Distance between 3'-terminus of neighbour sequence of sequence listing upward to telomere on chrosomal short arm and 5'-terminus of this base sequence : 65104
aagcttcatattccatgtaatgaccatcacagtgtttctcgggagcagacacaggacaggtatccttcacaggaatattacggaaactatgctatgcttttcccactgtatctcatcaggatgtacaaacttagcaaagaaaacacacacacacacacacacacacacacacacacacacacacacaaaatattaagcctgagaagtataagtacaaggaaagtacaagaaaggaaatgaagccagagtttactacgataaagaactgggaatggtctgagacttcatcttatttgcaagccaacaagttagcctgccatagtttcatggatgctggggaaagacctgagactcccaggtcagaggcaaaggattttattactcacaaaacagtaagcaatatgagctttatggtc

SEQ ID NO: 24983 - DNA, 255 bp, Homo sapiens
  AP001670.1_73689
  Located on chromosome 21
  Distance between a terminus base of telomere on chromosomal short arm and 5'-terminus of this base sequence : 15480251
  Distance between 3'-terminus of neighbour sequence of sequence listing upward to telomere on chrosomal short arm and 5'-terminus of this base sequence : 52014
aagactatcttactcggactgaaacgcaagagtatctgcgaacactgattcagcttgcaaaatacatagaaaagtagcaagaaaaatgatgtaacatcccatgtagtcggcatactggcctagtttcaagaccgaaagcagtctgaaaatgtctgaaaaaagtcggaaaatgtgtgtgtgtgtgtgtgtgtgtgtgtgtgtgtgtgtgtgtgtgtgtatgtgcagccatgcctaacagctcatgtttagctttct

SEQ ID NO: 24984 - DNA, 273 bp, Homo sapiens
  AP001670.1_195005
  Located on chromosome 21
  Distance between a terminus base of telomere on chromosomal short arm and 5'-terminus of this base sequence : 15601537
  Distance between 3'-terminus of neighbour sequence of sequence listing upward to telomere on chrosomal short arm and 5'-terminus of this base sequence : 121031
actagattgtcttgaccagtgatactagaatatgaaactatttgagatttgtgttttgtaagacaacattctagaatcatctacatttgtgtaaataccatatttcattaagtgtgaagttataactctttaatcagaatgacagattggagacatacacaatttatgacgttatggcttgtgctttttgcttttttgtgacacacacacacacacacacacacacacacacttttatatgtttagtacctaaatacaggctcttatccatga

SEQ ID NO: 24985 - DNA, 184 bp, Homo sapiens
  D21S1256
  Located on chromosome 21
  Distance between a terminus base of telomere on chromosomal short arm and 5'-terminus of this base sequence : 15986921
  Distance between 3'-terminus of neighbour sequence of sequence listing upward to telomere on chrosomal short arm and 5'-terminus of this base sequence : 385111
agaagtaaaaagcctatggtcccatcataacaagaaatcctagatacacaacacacacacacacacacacacacacacacacacacacttctttaaagccatctaagaactgtggatataaagtacaataaaggagtctatagaagtctaaagatttttatgttccaatgtcaggtagaactag

SEQ ID NO: 24986 - DNA, 257 bp, Homo sapiens
  AL163217.1_103738
  Located on chromosome 21
  Distance between a terminus base of telomere on chromosomal short arm and 5'-terminus of this base sequence : 16188360
  Distance between 3'-terminus of neighbour sequence of sequence listing upward to telomere on chrosomal short arm and 5'-terminus of this base sequence : 201255
aatgccttaccttctaataccatcacattgagggttaggattttaacatgtggttttgaggggatacattcagtccatgttaggcaatatgtatataactctgtgtgtgtgtgtgtgtgtgtgtgtgtgtgtgtgtgtttgtgtgtgtgtgaatttgtgtataacctatcagtattagagtataggaattatttcagtcgagtttagtaaaagaggttgtggaatagtttgggaaatgttaacaattcattgaacag

SEQ ID NO: 24987 - DNA, 373 bp, Homo sapiens
  AL163217.1_323850
  Located on chromosome 21
  Distance between a terminus base of telomere on chromosomal short arm and 5'-terminus of this base sequence : 16408393
  Distance between 3'-terminus of neighbour sequence of sequence listing upward to telomere on chrosomal short arm and 5'-terminus of this base sequence : 219776
cacatcttcctttctgtagtgatcaaatggaattctgtttaattaattaatatctttaatattatttataaagtttaggaaaatattaataaaattattttaagattttgtattatattttaaaaatagctatttaaatagctcattcttcagtagtttcaggtatttgagattagaatgtgtgtgtgtgtgtgtgtgtgtgtgtgtgtgtgtgtgtgtctacagtgagggaggataaaacagaaggggagagagtaggggggagaacttaccacacattttattgtcttcgtcagaaccatctggacagtttacttctccatcacaaaataaatcagcttttatacacgttagagcatcagtacaaggactt

SEQ ID NO: 24988 - DNA, 157 bp, Homo sapiens
  AL163218.1_117459
  Located on chromosome 21
  Distance between a terminus base of telomere on chromosomal short arm and 5'-terminus of this base sequence : 16541096
  Distance between 3'-terminus of neighbour sequence of sequence listing upward to telomere on chrosomal short arm and 5'-terminus of this base sequence : 132330
ggcatgcgtatacctatgtaacaaacctgcaagttctgcacatgtatcccagaacttaaagtataataaaatatacatattttatatatatatatatatatatatatatatatatatatatatatatgatttagatggaaacatggattagtaaaca

SEQ ID NO: 24989 - DNA, 422 bp, Homo sapiens
  AL163218.1_308638
  Located on chromosome 21
  Distance between a terminus base of telomere on chromosomal short arm and 5'-terminus of this base sequence : 16731699
  Distance between 3'-terminus of neighbour sequence of sequence listing upward to telomere on chrosomal short arm and 5'-terminus of this base sequence : 190446
tctcaagatgaggatgctaaacatttccgaagtcacagaaagacttgctgactcaccccacctctcagcccttaactgctacactgttgatgggaatgtaaattggtacagccattatggaaaacagtaggcaggttcttaaagatattaaaaatataactattatataatcctacttctagatatatactcaaaggaaatgaaataattatcttgatatttgcaatctcatgttcactactgcattattcacaatagcgaagatatgaaaacgtgttgacagatgaatgaataaagaaaatgccacacacacacacacacacacacacacacacagaggaatatttttcagacttaaaaaagaaaatcctgccatttgcaactctgtgtatgaacctgtagcatgttaggctaagtgaaat

SEQ ID NO: 24990 - DNA, 167 bp, Homo sapiens
  D21S1899
  Located on chromosome 21
  Distance between a terminus base of telomere on chromosomal short arm and 5'-terminus of this base sequence : 16731938
  Distance between 3'-terminus of neighbour sequence of sequence listing upward to telomere on chrosomal short arm and 5'-terminus of this base sequence : -183
actgcattattcacaatagcgaagatatgaaaacgtgttgacagatgaatgaataaagaaaatgccacacacacacacacacacacacacacacacagaggaatatttttcagacttaaaaaagaaaatcctgccatttgcaactctgtgtatgaacctgtagcatg

SEQ ID NO: 24991 - DNA, 188 bp, Homo sapiens
  AP001674.1_219926
  Located on chromosome 21
  Distance between a terminus base of telomere on chromosomal short arm and 5'-terminus of this base sequence : 16990139
  Distance between 3'-terminus of neighbour sequence of sequence listing upward to telomere on chrosomal short arm and 5'-terminus of this base sequence : 258034
agtagcaaatatgtctgtgcctacaaacaccccattttcacttttgtcctatcccgctctaattaatttgatttgcatcataaattataactctgtgtgtgtgtgtgtgtgtgtgtgtgtatgagagaaagaaagagagagagaaccaagtagtaattaccaaaatgtccttcataggtacagcttag

SEQ ID NO: 24992 - DNA, 340 bp, Homo sapiens
  AP001674.1_238785
  Located on chromosome 21
  Distance between a terminus base of telomere on chromosomal short arm and 5'-terminus of this base sequence : 17008814
  Distance between 3'-terminus of neighbour sequence of sequence listing upward to telomere on chrosomal short arm and 5'-terminus of this base sequence : 18487
taactatcaggccaatgtttaaagaacaataattctcagagacaccaaaatattagatagcaaagcaggccaatggattttaattgttcccttgttattatatgaaatgctttaaaatacattattttatgtaatacttacgaaacccttagagttagtattccattgttgcatatgggcatagctaagctggtctataattagtgatactgtactgtatacttacaagttgttaaagtggtagatatcaaatggtctcaccacacacacacacacacacacacacacacacacacacaaatggtaactccatgaggtgaaggaaatgttaactagcttg

SEQ ID NO: 24993 - DNA, 414 bp, Homo sapiens
  AP001674.1_296879
  Located on chromosome 21
  Distance between a terminus base of telomere on chromosomal short arm and 5'-terminus of this base sequence : 17058854
  Distance between 3'-terminus of neighbour sequence of sequence listing upward to telomere on chrosomal short arm and 5'-terminus of this base sequence : 49700
ctcgtgatatccacctttgtatatcggtgctaagaacaaaacacctcttcctaaaagtgagcagcctaacccaccaaggtggtcaggagataaaagtgatttcactccagcatgaacttctttccttagaaagccattgtatttatataaggtacccagatgtgtacattgtttaatgtgacaattgcatgcacacttgttgtccaggaagtctgccactttgtatttgtttgtgtgtgtgtgtgtgtgtgtgtgtgtgtgtgtgttttaaatttctaacaaattattgttagtgatggcataagaacatatcattttgggactgacaccatttacttagtgctgtcggcttctgccttgggtttggtaacatttacttagcacttcaagcttctggcatgatatcgtataatt

SEQ ID NO: 24994 - DNA, 287 bp, Homo sapiens
  HUMUT7927
  Located on chromosome 21
  Distance between a terminus base of telomere on chromosomal short arm and 5'-terminus of this base sequence : 17218471
  Distance between 3'-terminus of neighbour sequence of sequence listing upward to telomere on chrosomal short arm and 5'-terminus of this base sequence : 159203
ctgtctgtctgtctgtctatctatctatatctatctatctatcatctatctatccatatctatctatctatctatctatctatctatctatctatctatctatcgtctatctatccagtctatctacctcctattagtctgtctctggagaacattgactaatacaacatctttaatatatcacagtttaatttcaagttatatcataccacttcatacattatataaaaccttacagtgtttctcccttctcagtgtttatggctagtaattttttactgggtgcc

SEQ ID NO: 24995 - DNA, 415 bp, Homo sapiens
  AP001675.1_122164
  Located on chromosome 21
  Distance between a terminus base of telomere on chromosomal short arm and 5'-terminus of this base sequence : 17223191
  Distance between 3'-terminus of neighbour sequence of sequence listing upward to telomere on chrosomal short arm and 5'-terminus of this base sequence : 4433
acatacaaggtcatgtttgctttgttcccttccattgtgaaccttgcttgaacttatgagtaaaattcaagtgtcctctcgtttttcaagtcttgggcatctgtatccacagagccataaaaatgtaattacctctgtattagtcagggttctccagagggacagagctaagaggatacacacacacacacacacacacacacacacacacacatatatgagtttattaaggaatattaacacacatgatcatgaggtgaggtctcacaataggccatctgcaagctgaagaacaaggaagccagtctgagtcctaaagctgaagaacttggaggctgatgtttgagggcaggaagcatccagcattggagaaagatgtggatgtaggctggaaagctaagccagtctaatcttt

SEQ ID NO: 24996 - DNA, 266 bp, Homo sapiens
  AP001675.1_125529
  Located on chromosome 21
  Distance between a terminus base of telomere on chromosomal short arm and 5'-terminus of this base sequence : 17226654
  Distance between 3'-terminus of neighbour sequence of sequence listing upward to telomere on chrosomal short arm and 5'-terminus of this base sequence : 3048
cttgctcactgcataaaataagtaatgctaattgtggaaattatagtaagaatgtgaacagaatgcagccagacagaaaaaagaaagaaagaaagaaagaaagagagaaagaaaaaagaaaagaaaagacagaaagaaagaaaaagaaagaaagaaaaagaaagaaagaaaacaatattgaagaatcacatggggcattgaaaaattaaataaaacatttaaaatatgaactggcctctttctcctcactgtaagaacctatggca

SEQ ID NO: 24997 - DNA, 383 bp, Homo sapiens
  AP001675.1_135409
  Located on chromosome 21
  Distance between a terminus base of telomere on chromosomal short arm and 5'-terminus of this base sequence : 17236373
  Distance between 3'-terminus of neighbour sequence of sequence listing upward to telomere on chrosomal short arm and 5'-terminus of this base sequence : 9453
ctgaggtcaggagtttgagaccagcctggctaacatggtgaaaccccatctctactgaaaatacaaaaaaattagctgggcgttgtggtgcatgcctgtagtcctagctacttgagaggctgaggcaggagaattgcttcaacctgggaggcggaggttgcagtgagctgagatctcaccattgcactccagcctgggcgacagagggagcctccatcaaaaaaaaaaatgcacacacaaacacacacacacacacacacacacacacacacacacacatatatatgtactataatcatgtatgtcaaggttacccaatattcacatgaattcccagtactttccgtgtccatttcctactataactatttcagaccgtctgc

SEQ ID NO: 24998 - DNA, 318 bp, Homo sapiens
  AP001675.1_195769
  Located on chromosome 21
  Distance between a terminus base of telomere on chromosomal short arm and 5'-terminus of this base sequence : 17296750
  Distance between 3'-terminus of neighbour sequence of sequence listing upward to telomere on chrosomal short arm and 5'-terminus of this base sequence : 59994
cactggttaccatcttcagaagacacatggatatgacaaggataaatatggattcatacacacacgcactgataaaacttcagagtttattgaacataataattcagcagcacaactctgtcaacaactacatccaaaaagacacaagtaattttgtccaggctatcaagacatgaagagaatgtaagaaaaaaaaaaggaaaaacagaagtttccaaccaaccacacacacacacacacacacacacacacacacacacacacacacacaaacattctaccatcaaaagctttgaactagaactaggcagcgatttc

SEQ ID NO: 24999 - DNA, 425 bp, Homo sapiens
  AP001675.1_224176
  Located on chromosome 21
  Distance between a terminus base of telomere on chromosomal short arm and 5'-terminus of this base sequence : 17325120
  Distance between 3'-terminus of neighbour sequence of sequence listing upward to telomere on chrosomal short arm and 5'-terminus of this base sequence : 28052
tgtaatcctagcactttggaaagccgaggcgggcagatcacgaggccaagagttcgagaccagcctggccaacatggtgaaacccctgctctactaaaaacacaaaaattagctgggtgtggtggtgggtgcctgtagtcccagctattcggaggctcaggcaggagaattgcttgaacccgggaggtggaggttgcagtgagccgaggtcacgccactgcactccagcctgggcgacagagcaagactccgtctcaaaaatacatacatacatacatacatacatacatacatacatacatacatacgaaagtgaatacatgaaaaaagtaaggcgaatatagaaagtggagtgagagaaaggctgggcaaattgcatcctatgtttcattagtaaatttaagacatagcaccagacggtacta

SEQ ID NO: 25000 - DNA, 200 bp, Homo sapiens
  AP001676.1_4471
  Located on chromosome 21
  Distance between a terminus base of telomere on chromosomal short arm and 5'-terminus of this base sequence : 17444631
  Distance between 3'-terminus of neighbour sequence of sequence listing upward to telomere on chrosomal short arm and 5'-terminus of this base sequence : 119086
tgtaggccttatcaaattgaagatatctgtatagacttgtggatacacacacacacacacacacacacacacacacacatatggttttaaatttgtgttttcctacatatacatatacatatacatatacatatagtccttactgtaccaggagagggtctgagagcagcaaaagtctaatagcactgagttcaccttct

SEQ ID NO: 25001 - DNA, 317 bp, Homo sapiens
  AP001676.1_101113
  Located on chromosome 21
  Distance between a terminus base of telomere on chromosomal short arm and 5'-terminus of this base sequence : 17541196
  Distance between 3'-terminus of neighbour sequence of sequence listing upward to telomere on chrosomal short arm and 5'-terminus of this base sequence : 96365
cttatttgatcatggtaaatgatctttttaatgtgctggatctttttaatgtgggttcggttttctaacattttgttgaggatttttgcatctacctttattagggatattggcctatagctgtgtgtgtgtgtgtgtgtgtgtgtgtgtgtgtgtgtgtgtgtgtgtattttgcctggtttgggtatcaaggtaatgctggcctcattaaatgagttcagaagagttccctcctcttcaaatttctggaagagtttgagaagaattagtgttagttgttctttaaatgattggtagaatttagcaatgaaaccatc

SEQ ID NO: 25002 - DNA, 267 bp, Homo sapiens
  AP001676.1_145474
  Located on chromosome 21
  Distance between a terminus base of telomere on chromosomal short arm and 5'-terminus of this base sequence : 17585616
  Distance between 3'-terminus of neighbour sequence of sequence listing upward to telomere on chrosomal short arm and 5'-terminus of this base sequence : 44103
tttactaagaactcgagaccagagaaaaagattgtgcgctgtctctctctctctctctctctcacacacacacacacacacacacacacacacattttcctatgcaaattatcatattcacaaaacctggataaaacaacttcaggatataattttttccctctaacttatgtaaatcttgaaatgcattgacatttgagagtatgaaagcaatagctgttttaaaagagagtgcagaagtctccctgtgattgaaactgtcctgtt

SEQ ID NO: 25003 - DNA, 197 bp, Homo sapiens
  D21S1905
  Located on chromosome 21
  Distance between a terminus base of telomere on chromosomal short arm and 5'-terminus of this base sequence : 17608800
  Distance between 3'-terminus of neighbour sequence of sequence listing upward to telomere on chrosomal short arm and 5'-terminus of this base sequence : 22917
gacaggtgtcattccattgcatgctcgctctctctctttctctatgtctctctctctctctctctctctctgtctctctctctttctcacacacacacacacacacacacacacacacacacacacacacacatattcagactgggatggtgtagacacgccagttcacctaacgcacacatctctggaattaggga

SEQ ID NO: 25004 - DNA, 410 bp, Homo sapiens
  AP001676.1_333643
  Located on chromosome 21
  Distance between a terminus base of telomere on chromosomal short arm and 5'-terminus of this base sequence : 17773663
  Distance between 3'-terminus of neighbour sequence of sequence listing upward to telomere on chrosomal short arm and 5'-terminus of this base sequence : 164666
gtcatgctgaccttagctattaagctgatgccctttggatttaggcggttgttgatcaaggggaactttaaaaaggcggtgcttgtccaagatggcgatgctcctgctctgtcaatcatcatcatcatcaccatttgttccttgaatgaataattctttcttatgtcatattgcctttgcaatttgtgtgtgtgtgtgtgtgtgtgtgtgtgtgtgtgtgtgtgtttctgcatagaatattcttctccttttgctcattttacatagttaactgctatttatttattttttatcaccttaattcttggtcaacatctataaactttgtgagaaaagggattgggtttgttttcactcatcattgcattcccactatcacatgaattttctggtacataaatgaatcgagc

SEQ ID NO: 25005 - DNA, 327 bp, Homo sapiens
  AP001677.1_32365
  Located on chromosome 21
  Distance between a terminus base of telomere on chromosomal short arm and 5'-terminus of this base sequence : 17811525
  Distance between 3'-terminus of neighbour sequence of sequence listing upward to telomere on chrosomal short arm and 5'-terminus of this base sequence : 37452
ggtaccatagaagtattgatggttaatgtaaatatagttaagcgcacacacacacacacacacacacacacacacacacacatacatatacgcacattatacttccattgatttcaagtatatagttagagaaattagctgcatggcttattgaaatttgttttttattgctttgcatcaattatcttcataacattagatgtgaattagtttgattagtttgatgaaatgttcagattgagacacctcaggcataaatcaaaatggatttaatttaatttccatttgtgatttgattagaatcatattgcagctaaacttatgcag

SEQ ID NO: 25006 - DNA, 389 bp, Homo sapiens
  AP001677.1_130013
  Located on chromosome 21
  Distance between a terminus base of telomere on chromosomal short arm and 5'-terminus of this base sequence : 17909146
  Distance between 3'-terminus of neighbour sequence of sequence listing upward to telomere on chrosomal short arm and 5'-terminus of this base sequence : 97294
caggaaatggataaggatcttcattgttgccactactattcaaattttactggaagttccggcgattaggcaataaataaataaataaataaataaataaataaatctaggtaagagaggatgtagcaaaattatctccattgagggagacatgatattctctgtaaacaaacatgaggaacacagaataaaaatactatagagctgataaggagttcagtaatgctgcaggataaaagatcaatatacagaaatcaattgtatttttatatgctagtaattaacaatccaaaaatgaacttaagagaacaatatcatttgtaacactatcaaaacaattaaaatatataagaatatttaaatagataagtgcaagaattgtacactga

SEQ ID NO: 25007 - DNA, 274 bp, Homo sapiens
  AP001677.1_249334
  Located on chromosome 21
  Distance between a terminus base of telomere on chromosomal short arm and 5'-terminus of this base sequence : 18028388
  Distance between 3'-terminus of neighbour sequence of sequence listing upward to telomere on chrosomal short arm and 5'-terminus of this base sequence : 118853
tagatgttagctcttgccaaatacttcttctgcatcatttgatgatcatatatatattacatatatattttttctacatcacttgatgagctaatatatatttataatatattatatagatagatagatagatagatagatagatagatagatagatagagtttttctttgttaacacttagatgtggtggattgaattgaattgattgatttgcaagtgatgaaccagcttgaatagctgggtatatcccacttggtcatgctttattcactt

SEQ ID NO: 25008 - DNA, 414 bp, Homo sapiens
  AP001678.1_116153
  Located on chromosome 21
  Distance between a terminus base of telomere on chromosomal short arm and 5'-terminus of this base sequence : 18234064
  Distance between 3'-terminus of neighbour sequence of sequence listing upward to telomere on chrosomal short arm and 5'-terminus of this base sequence : 205402
acatcaaagattctgcactgacttaaggcagaacacctctgccttggtgggggagaggcaggaaacgcctagccataggctttgcactgagttgagtaggaggaaaagagtgacttccctacaaggaggctccaaacagctgagaaagttccacacacaagtttggggatgcaagtgctgcctaagatgaaggctagacaaggagaattgaacaactcccctacccaaattatgagcctgccacaggaaacacagacacacacacacacacacacacacacacacacacacacacgaaaaaactacagaacattatctctcatgtagacagaaatctataaaatgatattagcaaatgtaatccaacaatatttaaaagaataatattccattatcaagttagcattatccagg

SEQ ID NO: 25009 - DNA, 201 bp, Homo sapiens
  AP001678.1_148796
  Located on chromosome 21
  Distance between a terminus base of telomere on chromosomal short arm and 5'-terminus of this base sequence : 18266910
  Distance between 3'-terminus of neighbour sequence of sequence listing upward to telomere on chrosomal short arm and 5'-terminus of this base sequence : 32432
atggtagaactattccggaaacttttcagaaaagacataatcaagagggtttacacacacacacacacacacacacacacacacacacacacacacagacatgaaacagaaaaactgcaaagactgaatttttttccccatggcaaaaatcagtttagtgatttttaaatggagattatacaaaggtcactaccttcaaac

SEQ ID NO: 25010 - DNA, 122 bp, Homo sapiens
  D21S1437
  Located on chromosome 21
  Distance between a terminus base of telomere on chromosomal short arm and 5'-terminus of this base sequence : 18310994
  Distance between 3'-terminus of neighbour sequence of sequence listing upward to telomere on chrosomal short arm and 5'-terminus of this base sequence : 43883
atgtacatgtgtctgggaaggagggaaggaaggacggaaggagggaaggaaggaaggaaggaaggaaggaaggaaggaaggaaggaaggaaggacaagtgttggcagtaaatatgtagagaa

SEQ ID NO: 25011 - DNA, 347 bp, Homo sapiens
  AP001678.1_262883
  Located on chromosome 21
  Distance between a terminus base of telomere on chromosomal short arm and 5'-terminus of this base sequence : 18380770
  Distance between 3'-terminus of neighbour sequence of sequence listing upward to telomere on chrosomal short arm and 5'-terminus of this base sequence : 69654
tggttgaaagattagtgagtaatacttgaaaatcatctgaaattccaaagagttcagactttggtccaaatatcttgggcaaagttaaaagattttagcagaaagtcaatattcattttagaaagaagtactacctaacctattgtttcttcttgtaatttttgtgtactctccagcccattgtaaaggaaaaataaaatgttactgcctagcatataataaatgaaaaataaagggtttgtaaagtgatctactctaaatttctttatcttttttaaatattttattttattttattttattttattttattttattttattttatgttccaggatacatgtacag

SEQ ID NO: 25012 - DNA, 192 bp, Homo sapiens
  AP001679.1_25055
  Located on chromosome 21
  Distance between a terminus base of telomere on chromosomal short arm and 5'-terminus of this base sequence : 18482158
  Distance between 3'-terminus of neighbour sequence of sequence listing upward to telomere on chrosomal short arm and 5'-terminus of this base sequence : 101041
tccgtgactaagatctctttgttttcttctacatcttcctccctatttccaaaatcaaaggaatgtgtgtgtgtgtgtgtgtgtgtgtgtgtgtgtgtgtgtatgtaagaagggagtgtaggagctatgagaaaatacagagttgctagataaatctttttttgataaatagcatcttccaaatttagtgat

SEQ ID NO: 25013 - DNA, 356 bp, Homo sapiens
  AP001679.1_80309
  Located on chromosome 21
  Distance between a terminus base of telomere on chromosomal short arm and 5'-terminus of this base sequence : 18537241
  Distance between 3'-terminus of neighbour sequence of sequence listing upward to telomere on chrosomal short arm and 5'-terminus of this base sequence : 54891
atccttatcttgttccagttcttaatgggaatgctttcagattttgcccattcagtatgatgttggctggtcattttatcatacagctcttattagtttgaggtatgttccttcaatgcctaatttgttgaggttttttattatgaagagatgttgaacttcactgaaaactttttctgcatctattgagaagattatatggtttttgttttttaacactgtttatgtggtgtctgtgtgtgtgtgtgtgtgtgtgtgtgtgtgtgaatgttgaaccaaccttgaatcccaggaataaaaccttgattgtggtgaattgaatgttgatgtgctgctgcattcagcttgctagtatt

SEQ ID NO: 25014 - DNA, 412 bp, Homo sapiens
  AP001679.1_337346
  Located on chromosome 21
  Distance between a terminus base of telomere on chromosomal short arm and 5'-terminus of this base sequence : 18794334
  Distance between 3'-terminus of neighbour sequence of sequence listing upward to telomere on chrosomal short arm and 5'-terminus of this base sequence : 256737
aggtaatgacaattctgacaagacaagaaattatgatatagttacatgaattatacagctaatagtcattttgtgctctttctttttaaccagggaaaactgtcccattttagtacacacacaaagagagagacacacagaaagagtgagagacagacagagagaagtacacacacatacacacacacacacacacacacacacacacacacggagtaaaatagtctgcccctactgtcaagttaaaaattatcaattatgaggaatttggcaagtgtggatactttgcagaacttgaaaacgtgtaataaactttaaaagtttgtctgtaataaatggtttcttgatctgtgctcccatcccatactcatcctctctttctctctctctcgtacacaaaccatagaattct

SEQ ID NO: 25015 - DNA, 150 bp, Homo sapiens
  D21S1902
  Located on chromosome 21
  Distance between a terminus base of telomere on chromosomal short arm and 5'-terminus of this base sequence : 18794427
  Distance between 3'-terminus of neighbour sequence of sequence listing upward to telomere on chrosomal short arm and 5'-terminus of this base sequence : -319
ggaaaactgtcccattttagtacacacacaaagagagagacacacagaaagagtgagagacagacagagagaagtacacacacatacacacacacacacacacacacacacacacacacggagtaaaatagtctgcccctactgtcaagt

SEQ ID NO: 25016 - DNA, 360 bp, Homo sapiens
  AP001680.1_113007
  Located on chromosome 21
  Distance between a terminus base of telomere on chromosomal short arm and 5'-terminus of this base sequence : 18909133
  Distance between 3'-terminus of neighbour sequence of sequence listing upward to telomere on chrosomal short arm and 5'-terminus of this base sequence : 114556
actgatggtcacaagatagtctactcaatttttatttctttattattattattattattattattattattattaagagaccaggtctcgctcggttgtccagattggagtgcagaggtgcaattacagctcactgcagctttgacctccttggctcaagtgatcctcccgcctcagcctcctgagtagctgggactacaggcacaaatccatgcccggctaatttttaatttttagtagagatgaggtctcgttatgttgcccaggctgatctggaactcctgagctcaagcaatcctcccatctcagcctcccaaagtgctgggttgacaggcatgagcctctgcactcagtccatgt

SEQ ID NO: 25017 - DNA, 353 bp, Homo sapiens
  AP001680.1_137091
  Located on chromosome 21
  Distance between a terminus base of telomere on chromosomal short arm and 5'-terminus of this base sequence : 18933113
  Distance between 3'-terminus of neighbour sequence of sequence listing upward to telomere on chrosomal short arm and 5'-terminus of this base sequence : 23620
attcacggttggaattgaggatggaatgattaataagtgaaaactaacactaaaaataaaagattttcccaaaatgtttgactctaaagcaaaagaaatatttggtaatggcaagtcaaaggtccacgcaaaagtaaaagggctgtgtgtgtgtgtgtgtgtgtgtgtgtgtgtgtgtatgagtgtgtgtgtgtatgcatgtgtatccgtgtgtgtgtgtatgcatgtatatgcatgtgtgtgtgcatggatgtatgtgttttatttgctttgttgatttgtttgttatgatcggagagaattcatatatttacacaatagaaacataagtattcaaggctataaattcatgg

SEQ ID NO: 25018 - DNA, 404 bp, Homo sapiens
  AP001680.1_139777
  Located on chromosome 21
  Distance between a terminus base of telomere on chromosomal short arm and 5'-terminus of this base sequence : 18935724
  Distance between 3'-terminus of neighbour sequence of sequence listing upward to telomere on chrosomal short arm and 5'-terminus of this base sequence : 2258
gctcagataggtcaagctacacacctgaaatcacagctagttatggctccaagtccatgccttaatcaatatctatgctgactctcagggttaataagctccaggattgttacaagttgatgggttacacctttcctttgctaccccttttaccattttcagtaaaaatatttaattaggataatctcagaatactaatgtaatgtacagcatcaaaatgtgtgtgtgtgtgtgtgtgtgtgtgtgtgtgtgtgtgtggtgtataataaactctccagaatgttttgccaaactgattccactaaatcaaatattaccaaatgtttaaaatggctaacattttaaatgttatatcttgtttctttttttttctttttttaaatcaatgagttgattatcatgag

SEQ ID NO: 25019 - DNA, 409 bp, Homo sapiens
  AP001680.1_159131
  Located on chromosome 21
  Distance between a terminus base of telomere on chromosomal short arm and 5'-terminus of this base sequence : 18954970
  Distance between 3'-terminus of neighbour sequence of sequence listing upward to telomere on chrosomal short arm and 5'-terminus of this base sequence : 18842
taggcagtgcaaatttaagtataagaaactggagagttgggctgggtgtggtggctcacgcctgtaatcccagcactttgggaggccatggcaggcagatcacgaggtcaggagatcaagaccatcctggccaacatggtgaaaacccgtctctactgaaatacaaaaaattagccaggcgtggtggcatgcgactatagtcccagctactcaggaggctgaggcaggggaatcactcgaacctgggaggcagagattgcagctacccaagatcgcaccactgcattccagcctgatgacagagcaagaccacatctgaaaaaaaaaaaagaaaagaaaagaaaagaaaagaaaagaaaagaaattggaaagttggagaaacaatctgaaattcttgattaactgacag

SEQ ID NO: 25020 - DNA, 452 bp, Homo sapiens
  AL110119.1_13683
  Located on chromosome 21
  Distance between a terminus base of telomere on chromosomal short arm and 5'-terminus of this base sequence : 18954971
  Distance between 3'-terminus of neighbour sequence of sequence listing upward to telomere on chrosomal short arm and 5'-terminus of this base sequence : -408
aggcagtgcaaatttaagtataagaaactggagagttgggctgggtgtggtggctcacgcctgtaatcccagcactttgggaggccatggcaggcagatcacgaggtcaggagatcaagaccatcctggccaacatggtgaaaacccgtctctactgaaatacaaaaaattagccaggcgtggtggcatgcgactatagtcccagctactcaggaggctgaggcaggggaatcactcgaacctgggaggcagagattgcagctacccaagatcgcaccactgcattccagcctgatgacagagcaagaccacatctgaaaaaaaaaaaagaaaagaaaagaaaagaaaagaaaagaaaagaaattggaaagttggagaaacaatctgaaattcttgattaactgacagacaagaataatcaggtataaaagtcaaattcctaaggaatggtt

SEQ ID NO: 25021 - DNA, 150 bp, Homo sapiens
  D21S1922
  Located on chromosome 21
  Distance between a terminus base of telomere on chromosomal short arm and 5'-terminus of this base sequence : 18962974
  Distance between 3'-terminus of neighbour sequence of sequence listing upward to telomere on chrosomal short arm and 5'-terminus of this base sequence : 7551
tgaaaatatataaacaaatcactggtatactgtgatgtgtgcataattgtgtgtgtgtgtgtgtgtgtgtgtgtgtaagccttcttgtatatccatcattaaatgttaacaaatattttgtctaatccacatattttgacaagatagcat

SEQ ID NO: 25022 - DNA, 218 bp, Homo sapiens
  AP001680.1_222541
  Located on chromosome 21
  Distance between a terminus base of telomere on chromosomal short arm and 5'-terminus of this base sequence : 19018608
  Distance between 3'-terminus of neighbour sequence of sequence listing upward to telomere on chrosomal short arm and 5'-terminus of this base sequence : 55484
gcttgttctactctatggttgaacccccagttgtattttttagttttattcattaagttatttagtgccgatatttcagttggtacttttatatgattatatatatatatatatatatatatatatatatatatggaagttctaactcatgtgatgatcattttcctaatttctttgtattgtctacgtgtgttttcttgtattgcactgcatatcct

SEQ ID NO: 25023 - DNA, 209 bp, Homo sapiens
  AP001680.1_236426
  Located on chromosome 21
  Distance between a terminus base of telomere on chromosomal short arm and 5'-terminus of this base sequence : 19032442
  Distance between 3'-terminus of neighbour sequence of sequence listing upward to telomere on chrosomal short arm and 5'-terminus of this base sequence : 13616
tgtcaatatttccacctgattaacagatgtgcatgtatgtgtgtgtgataggcacttggccactcccagtgtcaggttgaaaaattgcaggctgtgtgaagatgctatttgacacacagagtatacttttaactgtcttctgtgattttgtgtgtgtgtgtgtgtgtgtgtgtgtgtgtgtgtgtgtgtgctgaagtcattctttggta

SEQ ID NO: 25024 - DNA, 278 bp, Homo sapiens
  AP001680.1_270949
  Located on chromosome 21
  Distance between a terminus base of telomere on chromosomal short arm and 5'-terminus of this base sequence : 19066979
  Distance between 3'-terminus of neighbour sequence of sequence listing upward to telomere on chrosomal short arm and 5'-terminus of this base sequence : 34328
aatttgcaatgtcttgtatttaaagaaagaaaatcaattcaaattggatcccaaatactgaaatgaatttttggaaataagaagttcatgggtaggactagagttcagggcttcaggtccgcttctctgagattttgtgtgtgtgtgtgtgtgtgtgtgtgtgtgtgtgtctgtctgtctttcatgctgagattgtgtgtgtgtgtgtgtgtgtgtgtgtgtgtctttcatgagaagggttttttctaagtcaccttgtttgcacatagatgtacagt

SEQ ID NO: 25025 - DNA, 282 bp, Homo sapiens
  AP001680.1_311571
  Located on chromosome 21
  Distance between a terminus base of telomere on chromosomal short arm and 5'-terminus of this base sequence : 19107633
  Distance between 3'-terminus of neighbour sequence of sequence listing upward to telomere on chrosomal short arm and 5'-terminus of this base sequence : 40376
aattgcttgataatcctatgaaagttatgttagtcttttgtttgcatggatatagtaaacaccaaagtttttactatggaagtcaagtgtaaatagatagattatagatagatagatagatagatagatagatagatagataattgtagatatagctttagttatatgtatcatattcccagtatggtattctttaatgatattttttagaaacaacagagaaaatgacttgagagtaactgaacttcataaggtaatttcttccagaaaccagaatcataa

SEQ ID NO: 25026 - DNA, 193 bp, Homo sapiens
  D21S1884
  Located on chromosome 21
  Distance between a terminus base of telomere on chromosomal short arm and 5'-terminus of this base sequence : 19205992
  Distance between 3'-terminus of neighbour sequence of sequence listing upward to telomere on chrosomal short arm and 5'-terminus of this base sequence : 98077
gatgtgaatacaggcagatgttacatacgttatttctaacaatatgtacccactggataatagtttgtgtgtgtgtgtgtgtgtgtgtgtgtatgtgtacccacatagcatatctatgtgtgtgtgtgtgtgtgtgtgtgtgtgtgtataatgtttatataatactgaacgttatcaataattttttgcatca

SEQ ID NO: 25027 - DNA, 412 bp, Homo sapiens
  AP001681.1_75913
  Located on chromosome 21
  Distance between a terminus base of telomere on chromosomal short arm and 5'-terminus of this base sequence : 19210788
  Distance between 3'-terminus of neighbour sequence of sequence listing upward to telomere on chrosomal short arm and 5'-terminus of this base sequence : 4603
gaatggcttagtgctagttcatgtgataggattactgagacctctgcaccctcagcccagcaggacatagtttgttggattaaatgtacaatggattgctacaagaagaaccatctgagaaagccacagcacagaagctgtccacaaccaaaacactcattacagagccttgggcccctgaaagcacccagcaatgaatccaaacaaccatacacaacataaatcacagtcataccctcaaggaacaaaataattttttaaaagttacatccaaataaaaataagaagcaacacacacacacacacacacacacacacacacacacacacacacacaaaggattcaggatgtgaaagacaagatagctatattaaaaaaatagaacatctggaattgaaatttcactaaaga

SEQ ID NO: 25028 - DNA, 367 bp, Homo sapiens
  AP001681.1_201219
  Located on chromosome 21
  Distance between a terminus base of telomere on chromosomal short arm and 5'-terminus of this base sequence : 19338101
  Distance between 3'-terminus of neighbour sequence of sequence listing upward to telomere on chrosomal short arm and 5'-terminus of this base sequence : 126901
gtcctttctctggaatgaagaccttgccctgggaatcccagttctcactgggacaatgaatatcttagttcaagctgctgtactaaaatagcacagatagggtgggttaaacaacaaacatttatttctctaaatctaggggctataagttggagattaggatgctagcacggttgggtgactggtaagggccctctttttggttatgtactggcatggcctttacttggtgcgcacacacacatacacacacacacacacacacacacacacacacacacaaatctggtgtccctttctctttttataagggcagtaatcccatcacaggtgtttcaccctcataacgtcacttaaacctaattgc

SEQ ID NO: 25029 - DNA, 254 bp, Homo sapiens
  G08073
  Located on chromosome 21
  Distance between a terminus base of telomere on chromosomal short arm and 5'-terminus of this base sequence : 19725874
  Distance between 3'-terminus of neighbour sequence of sequence listing upward to telomere on chrosomal short arm and 5'-terminus of this base sequence : 387406
cacctttgttgccaagagtctagtgcatagtatatttgcaccaagatgattgaatctatctatctatctatctatctatctatctatctatctatctatatgcacacacacatatgtatagatacatacacatatacatatatatacatatatctatataagtatatatagatatgatgtaccttaattttttaccttacactttagagattagaaagaatatgttcaattgcctacaccttctgtgatttaaa

SEQ ID NO: 25030 - DNA, 384 bp, Homo sapiens
  AL163227.1_306516
  Located on chromosome 21
  Distance between a terminus base of telomere on chromosomal short arm and 5'-terminus of this base sequence : 19782497
  Distance between 3'-terminus of neighbour sequence of sequence listing upward to telomere on chrosomal short arm and 5'-terminus of this base sequence : 56369
aactgcagtctaggtaaatgagacacccttattgagagtcctgtgaaggggtcagagaaatataatatcctttatcacataggctatacatattaggtatatgtgtgtgtgtgtatatatatatatatatatatatatatatatatatatatatacacacacacatatatatacatacacagtcatgtactacataatgacattttgtcagtgacatattgcatatatgatgagagatattattatggtgctgccctatatactgtcatgtttatctttataacatatttttactgtactttttctatatttaatatacagataaaattgtgttatagttgcctacagtattcagtacagtaacaagctgaataggtttgtagc

SEQ ID NO: 25031 - DNA, 227 bp, Homo sapiens
  AP001683.1_7372
  Located on chromosome 21
  Distance between a terminus base of telomere on chromosomal short arm and 5'-terminus of this base sequence : 19822412
  Distance between 3'-terminus of neighbour sequence of sequence listing upward to telomere on chrosomal short arm and 5'-terminus of this base sequence : 39531
tcctgtattcctatcagtaaacatgattttctttggggtatgtttcaatttttgattattattattattattattattattatttgagttattttgagacagggttttcctctgctgtccaggctggagtgcagtggcacaatcatggctcactgcaaccttgacctcctgggttcaagggatcctccctcctcagcctcccaaatagctaggactacaggcaagta

SEQ ID NO: 25032 - DNA, 294 bp, Homo sapiens
  AP001683.1_70938
  Located on chromosome 21
  Distance between a terminus base of telomere on chromosomal short arm and 5'-terminus of this base sequence : 19885855
  Distance between 3'-terminus of neighbour sequence of sequence listing upward to telomere on chrosomal short arm and 5'-terminus of this base sequence : 63216
gaagcaagaaccatttgactatagttttgattagaaaagtcagcgtcctaaggttgtagtcactaggaatgggaacataagcctggacaaaggcacgaacagagctgccttcttaatgacttttctattttggttgctgggtttaactaaatatgagtttttaatgttttctggaattatatatatatatatatatatatatatatatatatatataatcttttgattctcgattctcatttgcttcacctcatatatgattttattcaatcactttcctggcatatccattac

SEQ ID NO: 25033 - DNA, 415 bp, Homo sapiens
  AP001684.1_92699
  Located on chromosome 21
  Distance between a terminus base of telomere on chromosomal short arm and 5'-terminus of this base sequence : 20246613
  Distance between 3'-terminus of neighbour sequence of sequence listing upward to telomere on chrosomal short arm and 5'-terminus of this base sequence : 360464
aagacctgtttgtcactcagtaagttttagagaattagaccatgtatagtacttcaatgggtctgcaatgacactgacataatgtgttgttaagggtaggaacaaaatagaactcttcagtggaaaatcctatgtagccttttatttagtggaaagggatctgcaagaaagccgtgtgtctgtgtgtgtgtgtgtgtgtgtgtgtgtgtgtgtgtgcgtgtatgtttgttagacaaagctcccagaatagacttaaaatgaagcttgtctttttgtgaggcctttgacaaagagttaagcaccattccaaaaacctcactctgccttattcctgtccaattctgtatctttatagtctattagtgttcacattttataattattcagacccataggaacgtgctactttcttaac

SEQ ID NO: 25034 - DNA, 225 bp, Homo sapiens
  AP001684.1_183112
  Located on chromosome 21
  Distance between a terminus base of telomere on chromosomal short arm and 5'-terminus of this base sequence : 20337156
  Distance between 3'-terminus of neighbour sequence of sequence listing upward to telomere on chrosomal short arm and 5'-terminus of this base sequence : 90128
gtttagaccactttctgcagaggaaaagcagtaattattctaaggttgtttgtgtgtgtgtgtgtgtgtgtgtgtgtgtgtgtgtgtgtgtgtaattttattattttttagaatagatcattgtaaaattgggaagatatagtcaaatcaatatgtttagacttttctgagaaccattctagctacactaattgtaaccacagatgttggttattgatggaagag

SEQ ID NO: 25035 - DNA, 393 bp, Homo sapiens
  AP001684.1_219202
  Located on chromosome 21
  Distance between a terminus base of telomere on chromosomal short arm and 5'-terminus of this base sequence : 20373053
  Distance between 3'-terminus of neighbour sequence of sequence listing upward to telomere on chrosomal short arm and 5'-terminus of this base sequence : 35672
atgctgaaccttgtattagacaatgaaagtcacatggaagaaaaccaaggcacacctgctaaccggcagcaccaactgctaaagatgtgaataaaaccaccttgaacctttcatcccagccaaactcctagctgaatttagccacatacctaccggtgtattagggttcttttagagggacagaacatcatatatataaaatctgtatatgatatacacatatatatataatttgtatataatacacacacacacacacacacacacacacacacatatatatatatataaatgggagtttgtaagtattaacttacacgatcacaaggtcccacaataggctgtgtgcaaactgaggagcaaggagagccagcacgagttccaaacctgaag

SEQ ID NO: 25036 - DNA, 213 bp, Homo sapiens
  AP001684.1_289204
  Located on chromosome 21
  Distance between a terminus base of telomere on chromosomal short arm and 5'-terminus of this base sequence : 20443235
  Distance between 3'-terminus of neighbour sequence of sequence listing upward to telomere on chrosomal short arm and 5'-terminus of this base sequence : 69789
ctgcagttaagctgtgatcatgccactacactccagctagggcaacagagtgacaccccatctcacacacacacacacacacacacacacacacacaaaaccttgggaaaagatatagacatttaaatgtctcttcatttttttctcacatgcacaaattaaaaaacgaatgtaacttatataaaaagaagaatgcaatcgaagattatagtt

SEQ ID NO: 25037 - DNA, 147 bp, Homo sapiens
  Z67271
  Located on chromosome 21
  Distance between a terminus base of telomere on chromosomal short arm and 5'-terminus of this base sequence : 20504933
  Distance between 3'-terminus of neighbour sequence of sequence listing upward to telomere on chrosomal short arm and 5'-terminus of this base sequence : 61485
tcatgattaaaaatggcaggaaagattaagacaaaacatgtagtacacacacacacacacacatacacactcatacacacactaatatgaagggaagggtacaagtaaagttgatgaaaatatagacagaatataccaccatcacaa

SEQ ID NO: 25038 - DNA, 417 bp, Homo sapiens
  AP001685.1_60608
  Located on chromosome 21
  Distance between a terminus base of telomere on chromosomal short arm and 5'-terminus of this base sequence : 20553409
  Distance between 3'-terminus of neighbour sequence of sequence listing upward to telomere on chrosomal short arm and 5'-terminus of this base sequence : 48329
tgttaactggaacagagttcaatatctatagaaaatgttagatggaaaccaaaacttgaacattgtttttaattaaaaaaggctcattagttttgagtttgtcagcacaataacctaaatatgtctgcaaaataacagagtcattatcattgaactatatgtagatctgaaaataagtatcagtacaacaggcttcccccctctacttttttccttcctgccctacccacgaatagagaacaacttctctttcacctgtgccaaggattaggagaaatggtaaattattagtttatatatatatatatatatatatatatatatatatatatatatccaggaattaaaaaattgcatgcaaatttaaaacaatgttctacagcagtaatttaactagcattagaaggttgaagacat

SEQ ID NO: 25039 - DNA, 163 bp, Homo sapiens
  chr21.fa.O7frz.21130662
  Located on chromosome 21
  Distance between a terminus base of telomere on chromosomal short arm and 5'-terminus of this base sequence : 20850539
  Distance between 3'-terminus of neighbour sequence of sequence listing upward to telomere on chrosomal short arm and 5'-terminus of this base sequence : 296713
ctgtagacaatgaactttccacttaattcataagccgattcctaataataaatctgtatctatgtctatatctatatgtatgtatgtctgtctgtctatatatctatctatctatctatctatctatctatcgatctatctatctacctatccaattggttct

SEQ ID NO: 25040 - DNA, 345 bp, Homo sapiens
  AP001686.1_96807
  Located on chromosome 21
  Distance between a terminus base of telomere on chromosomal short arm and 5'-terminus of this base sequence : 20928683
  Distance between 3'-terminus of neighbour sequence of sequence listing upward to telomere on chrosomal short arm and 5'-terminus of this base sequence : 77981
gtcaggagttctagaccttcctggccaacacggtgaaaccttgtctctactaaaaatacaaaaattagccgggtgtggtggctcatacctgtactcccagatacttgggggtggcttaggcaggagaatcgcttgaactcgggaggcggaacttgcagtgagccaagattgcaccactgcactccagcctgggcgacagagcaagactccatctcaaaacacacacacacacacacacacacacacacacacacacgaggtataaaaacatgaaaagcttattttataaaacataaaaatatgagttttcttctttaaagaaaaccaaatggctaactcagatag

SEQ ID NO: 25041 - DNA, 293 bp, Homo sapiens
  AP001686.1_147129
  Located on chromosome 21
  Distance between a terminus base of telomere on chromosomal short arm and 5'-terminus of this base sequence : 20979183
  Distance between 3'-terminus of neighbour sequence of sequence listing upward to telomere on chrosomal short arm and 5'-terminus of this base sequence : 50155
gaggaattgatcaagtcacttaaccactctgtgcttctgtacacacacacacacacacacacacacacacacacacacacacacacaaatcagaatagtgatactatccattttactgcgttattatgaggaatagataaagtgatagttgcaaagcccttagaacagtgcctggaatataccaagtaacacacaagtgttgctattgttattatctttatagtctgtaattcgatgttttctcagtcaggaattcaacgtggcttattgaaggtattgtcataattgtccag

SEQ ID NO: 25042 - DNA, 261 bp, Homo sapiens
  AP001686.1_234354
  Located on chromosome 21
  Distance between a terminus base of telomere on chromosomal short arm and 5'-terminus of this base sequence : 21066366
  Distance between 3'-terminus of neighbour sequence of sequence listing upward to telomere on chrosomal short arm and 5'-terminus of this base sequence : 86890
agttgaacatcaactttggaagttgttttattatggcttattcacaagcattttaatgtttttccccatatatctatatgcatgtgtgtgtgtgtgtgtgtgtgtgtgtgtgtgtgtgtgtgtttgatatatatcgtgctttattttaactcataagactttatatactggaaattgcttttttatgaagagtggtaaactcacacgcattagtcatatttgtgtaccttcaatagtgtatacgaagacagaagcattctt

SEQ ID NO: 25043 - DNA, 429 bp, Homo sapiens
  AP001687.1_77424
  Located on chromosome 21
  Distance between a terminus base of telomere on chromosomal short arm and 5'-terminus of this base sequence : 21248205
  Distance between 3'-terminus of neighbour sequence of sequence listing upward to telomere on chrosomal short arm and 5'-terminus of this base sequence : 181578
actatttgattggcacagaactacattgtcgttggtaactttcttattgcttgctgttttcagaagcaaaagaaactattttttttttcattttctgacccatacataaaggcaaatatttctccaagaagcctccattacataagtggaaaatagtatcgctagattacaatctggtctgggtgttaaggatgcatattgattccagacttggtcatttaggtctatttggtacacaaggcagaataaagggattattgcttgataggtaggtaggtaggtaggtaggtaggtagatagatagatagatagaagatagatagatagatagatagatagatagatagatagatagatgatagatgagacaagacaagacagactatgaataaattaatcatactgctgtttctaactcaaagattcagg

SEQ ID NO: 25044 - DNA, 331 bp, Homo sapiens
  AP001687.1_94016
  Located on chromosome 21
  Distance between a terminus base of telomere on chromosomal short arm and 5'-terminus of this base sequence : 21264999
  Distance between 3'-terminus of neighbour sequence of sequence listing upward to telomere on chrosomal short arm and 5'-terminus of this base sequence : 16365
aggaactgcatgagtacttgagcgaagcaacttctcagaggtaataaagctccattaaatcacttacccgagacttctgagagggcacttaacagggaatgagtctataacatgtatgtatgtatgtatgtatgtatgtatgtatctatctatctatctatctatctatctatctatctatctatcatctatctgtctgtctagctatccatccattcatcagctgtcatatttctaacgatctatcatgtatccatctgtcatctatctatcgatcgatctgttatctatctatgatatggattgtataattgctaggtaattcatccaa

SEQ ID NO: 25045 - DNA, 231 bp, Homo sapiens
  AC027226.2_78402
  Located on chromosome 21
  Distance between a terminus base of telomere on chromosomal short arm and 5'-terminus of this base sequence : 21290353
  Distance between 3'-terminus of neighbour sequence of sequence listing upward to telomere on chrosomal short arm and 5'-terminus of this base sequence : 25023
accaaatattaaatgcaacctattaccctaaataggcaacctaatattattattattattattaccatgattatattttagtttagcattccctggcctccttgctgtcaaccacagaaactaaatattaaactcaacctattaccctaaatggacagcctattatacctaaatacagcctaaattacctctacatgcttttgaagagtccataacgttgctagttgttat

SEQ ID NO: 25046 - DNA, 224 bp, Homo sapiens
  AP001687.1_216680
  Located on chromosome 21
  Distance between a terminus base of telomere on chromosomal short arm and 5'-terminus of this base sequence : 21387713
  Distance between 3'-terminus of neighbour sequence of sequence listing upward to telomere on chrosomal short arm and 5'-terminus of this base sequence : 97129
ttatctgccttaatgatggaatacaggaagatggggtagaaacaatatcaataacacttcatctctctctctctctctctctctctctctctccgtctctcctctctctctctctgtctctctctctctcacacacacacgcacacacacatctccattcacacttactttcataaatattttaaagtcaatcttgtctctggtcctggaatatgagacaaaca

SEQ ID NO: 25047 - DNA, 152 bp, Homo sapiens
  D21S1257
  Located on chromosome 21
  Distance between a terminus base of telomere on chromosomal short arm and 5'-terminus of this base sequence : 21392688
  Distance between 3'-terminus of neighbour sequence of sequence listing upward to telomere on chrosomal short arm and 5'-terminus of this base sequence : 4751
ttttattttagggtatatctgccataatgcatatattaaaatgttatagttgataggtcaaaaattgatctattcataatacgtgtgtgtgtgtgtgtgtgtgtgtgtgtgtgtgtgtatctcataggaaaaccggtgaatgaaactgtggc

SEQ ID NO: 25048 - DNA, 340 bp, Homo sapiens
  AP001688.1_6576
  Located on chromosome 21
  Distance between a terminus base of telomere on chromosomal short arm and 5'-terminus of this base sequence : 21516548
  Distance between 3'-terminus of neighbour sequence of sequence listing upward to telomere on chrosomal short arm and 5'-terminus of this base sequence : 123708
ctggaataaagattcatgtagcagcaccatggccaaattacacctgatacaatattttagtgagaaataaatcccatcactgcaggtatatatgtgtgtgtgtgtgtatgtgtgtgtgtgtgtatatatatatatatatatatatatatatatatatatatctccacttccttgatatctggcattacaaggtgctctgggcctatcttccacatttcatgcttcagttctagaattatcctttctccaaggagtcctggttcattttattgcagaatacttttagaagcaatatctggatactggatatgcttcttgctactgcagaactgttgcttct

SEQ ID NO: 25049 - DNA, 338 bp, Homo sapiens
  HUMUT1332
  Located on chromosome 21
  Distance between a terminus base of telomere on chromosomal short arm and 5'-terminus of this base sequence : 21525552
  Distance between 3'-terminus of neighbour sequence of sequence listing upward to telomere on chrosomal short arm and 5'-terminus of this base sequence : 8664
ttctggtgttaactacaggtgctacataacccagaaaatctctagaactcatttgccttgcagaacagaaaccctatactcattaagcaacaattttacattttccctcccacaagctcctgacaaccattattctattctttgcttcttcgagtttgactatttttgatagctcataaaaatggaatcatgcagtgcttgtagtggtttatttcacttggtataaggttctccaagttcaatggtgtcacaaaggataggattttaagtatctatctatctatatctatctatctatctatctatctatctatcgagagagcacattttctttaccc

SEQ ID NO: 25050 - DNA, 244 bp, Homo sapiens
  AP001688.1_208214
  Located on chromosome 21
  Distance between a terminus base of telomere on chromosomal short arm and 5'-terminus of this base sequence : 21718133
  Distance between 3'-terminus of neighbour sequence of sequence listing upward to telomere on chrosomal short arm and 5'-terminus of this base sequence : 192243
ccagtttcaggtacgtctttatagcaatctgagaacagactaatacacttatcaaaatgtcttatgataggactgactaagtaaatttagaatagttgttcaggaagatgataagtacaaaacaaaacagcttgattctcaagccatttctataatcacatgcatttttgcatttacacacacacacacacacacacacacacacaccactcatacaaatgtaatctgacttcgtagtgaccat

SEQ ID NO: 25051 - DNA, 265 bp, Homo sapiens
  D21S1892
  Located on chromosome 21
  Distance between a terminus base of telomere on chromosomal short arm and 5'-terminus of this base sequence : 21815685
  Distance between 3'-terminus of neighbour sequence of sequence listing upward to telomere on chrosomal short arm and 5'-terminus of this base sequence : 97308
ccagacgcttgggaggctgaggcaagagaattgcttgaacccaggaggcagaggttgcagtgagtggagatcgcaccactgcactccagcctgggtgacagaacgagactccgtctcaaaaaaaaataaaataaatctgaattatgtccaatcaaaatacacacacacacacacacacacacacacacacacacacacacactccctctctctctctctctctctcttccaaaaactcagttttaaagttggtgtcggctttacc

SEQ ID NO: 25052 - DNA, 178 bp, Homo sapiens
  HUMUT1333
  Located on chromosome 21
  Distance between a terminus base of telomere on chromosomal short arm and 5'-terminus of this base sequence : 21816273
  Distance between 3'-terminus of neighbour sequence of sequence listing upward to telomere on chrosomal short arm and 5'-terminus of this base sequence : 323
acacatctattacctcaacagtctatcccttccaaatgaacctgtacaagttaaaaacacaaaatggaaatatatacatatatatctatctatctatatatctatctatctatctctctctctctctctatatatatatatatatagaactccaactattccctttctgctgtgtact

SEQ ID NO: 25053 - DNA, 251 bp, Homo sapiens
  HUMUT761
  Located on chromosome 21
  Distance between a terminus base of telomere on chromosomal short arm and 5'-terminus of this base sequence : 21847961
  Distance between 3'-terminus of neighbour sequence of sequence listing upward to telomere on chrosomal short arm and 5'-terminus of this base sequence : 31510
atgaataggggatatgctgggcctagtgaggaagaatagggattatcccctggaggaacttgaggatgtggtatctatctatctatctatctatctatctatctatctatctatctgtctgtctatctatttaactatctatctagatacacatatgagatagaagagtatttttggactgaattctgtggtactagataagtatattgtaacataaagttgaattaaaaatagtttatcaatatgggaac

SEQ ID NO: 25054 - DNA, 328 bp, Homo sapiens
  AC027484.3_93518
  Located on chromosome 21
  Distance between a terminus base of telomere on chromosomal short arm and 5'-terminus of this base sequence : 21848014
  Distance between 3'-terminus of neighbour sequence of sequence listing upward to telomere on chrosomal short arm and 5'-terminus of this base sequence : -198
aggaacttgaggatgtggtatctatctatctatctatctatctatctatctatctatctatctgtctgtctatctatttaactatctatctagatacacatatgagatagaagagtatttttggactgaattctgtggtactagataagtatattgtaacataaagttgaattaaaaatagtttatcaatatgggaacatactcctttgacaaaagttttaacatattagtaaacatcctgggtaaaagtactcatgggctcctagaataccccttgaaaacttggaaaattaatgttgcacactagttgaagcagaataccatgagt

SEQ ID NO: 25055 - DNA, 257 bp, Homo sapiens
  AP001689.1_108364
  Located on chromosome 21
  Distance between a terminus base of telomere on chromosomal short arm and 5'-terminus of this base sequence : 21957358
  Distance between 3'-terminus of neighbour sequence of sequence listing upward to telomere on chrosomal short arm and 5'-terminus of this base sequence : 109016
agtgagtcctttggcattaatataaatatgccatttttatataatggaatcatttaatataatggaacaattttatccttagtttgtcaacatagttaattgtgtgtgtgtgtgtgtgtgtgtgtgtgtgtgtgtgtgtgtgtttcatattggatccccttttaattataaattgtacttgtctgctctatattgctctttcataatactgataaatttaacttattaaatattagtttaggacgttggcatctata

SEQ ID NO: 25056 - DNA, 139 bp, Homo sapiens
  D21S272
  Located on chromosome 21
  Distance between a terminus base of telomere on chromosomal short arm and 5'-terminus of this base sequence : 21957418
  Distance between 3'-terminus of neighbour sequence of sequence listing upward to telomere on chrosomal short arm and 5'-terminus of this base sequence : -197
aatggaacaattttatccttagtttgtcaacatagttaattgtgtgtgtgtgtgtgtgtgtgtgtgtgtgtgtgtgtgtgtgtttcatattggatccccttttaattataaattgtacttgtctgctctatattgctct

SEQ ID NO: 25057 - DNA, 220 bp, Homo sapiens
  chr21.fa.O7frz.22344740
  Located on chromosome 21
  Distance between a terminus base of telomere on chromosomal short arm and 5'-terminus of this base sequence : 22064606
  Distance between 3'-terminus of neighbour sequence of sequence listing upward to telomere on chrosomal short arm and 5'-terminus of this base sequence : 107049
aagccatactttaagcttgattgccattaatataatatttaaccacgaacaaactttaaaatgttcatggagagttgtcagcaagtctccagaagagggagttggggggaaagagagagagagagagagagagagagagagagagagaggagagagagaatgctaaaacagacaactcaactaaaaaaaaattaaagtatcagcacttagaaattgaaat

SEQ ID NO: 25058 - DNA, 211 bp, Homo sapiens
  D21S1914
  Located on chromosome 21
  Distance between a terminus base of telomere on chromosomal short arm and 5'-terminus of this base sequence : 22201229
  Distance between 3'-terminus of neighbour sequence of sequence listing upward to telomere on chrosomal short arm and 5'-terminus of this base sequence : 136403
ctgaaccagggcatgtaaacaaataaacaaaaagggtagttggaaggagccttacaaaagatttggataaaagaaaatatctctgcagaatttcatttgctgttctgctaaatttaaggccatctgtgtgtctctgtgtgtgtgtgtgtgtgtgtgtgtgtgtgtgtgtgtgtgtgtgtagtttcctcaaaatttgacagaaggcccaatg

SEQ ID NO: 25059 - DNA, 186 bp, Homo sapiens
  AP001690.1_13269
  Located on chromosome 21
  Distance between a terminus base of telomere on chromosomal short arm and 5'-terminus of this base sequence : 22201323
  Distance between 3'-terminus of neighbour sequence of sequence listing upward to telomere on chrosomal short arm and 5'-terminus of this base sequence : -117
atttgctgttctgctaaatttaaggccatctgtgtgtctctgtgtgtgtgtgtgtgtgtgtgtgtgtgtgtgtgtgtgtgtgtgtagtttcctcaaaatttgacagaaggcccaatgtaatcttataaattaagagctgtacaatattgagctcaacaaagtggctattgtgagcctgaacagaag

SEQ ID NO: 25060 - DNA, 203 bp, Homo sapiens
  AP001690.1_150502
  Located on chromosome 21
  Distance between a terminus base of telomere on chromosomal short arm and 5'-terminus of this base sequence : 22338460
  Distance between 3'-terminus of neighbour sequence of sequence listing upward to telomere on chrosomal short arm and 5'-terminus of this base sequence : 136951
gaaagttatttggcttaatgtcattaaaaaatatttccctgtgcttaactgtgttgcatacctatctcatcttttgagaatttggcatagaagccaaacatttttaaattaaaaactaaaatctaaaagatatgtatgtgtgtgtgtgtgtgtgtgtgtgtgtgtgtgtgtgtgtataattatagctgttcctatttcgtttg

SEQ ID NO: 25061 - DNA, 360 bp, Homo sapiens
  AP001690.1_246599
  Located on chromosome 21
  Distance between a terminus base of telomere on chromosomal short arm and 5'-terminus of this base sequence : 22434450
  Distance between 3'-terminus of neighbour sequence of sequence listing upward to telomere on chrosomal short arm and 5'-terminus of this base sequence : 95787
gaagtccggagttcaagaccagcctggccaacatggtgaaagcctatctctactaaaaacacaaaaattagccaggcatggtggcacgtgcctgaaatcccagctacttgggaggctgaggcaggagtattgcttgaatctgggaggcagaggttgcagtgagcagagactgtgccattgcactccagcctgggcaacaagagcaaaactctgtctcaaaaataaaataaaataaaataaaataaataaaataaaataaaataaaataaaataaaatatagtaaaaataatgaaacaaaggaacaaaaacaaaaagcatcaatgtcatcatacacatggttattcctttggcaactaaat

SEQ ID NO: 25062 - DNA, 438 bp, Homo sapiens
  AP001690.1_264071
  Located on chromosome 21
  Distance between a terminus base of telomere on chromosomal short arm and 5'-terminus of this base sequence : 22451857
  Distance between 3'-terminus of neighbour sequence of sequence listing upward to telomere on chrosomal short arm and 5'-terminus of this base sequence : 17047
aactacaaatgacaagtaagacctaattaaactaaagagcttctggctgagcatggtggttcacaccctgtaatcccagcacttcgggagtccaaggcgggcagatgacttgaggtcaggagtttgagaccagcctggccaacatggtgaaactctgtctctactgaaaaatacaaaaattatccaggcgtggtgatgtgcaactgcagtccagctacttgggagtctgaggcatgagaatctcctgaacgtgtgagccgagatcctgctattgcactccagcctgggggacagagtgagacttcatcacaaaacaaaacaaaacaaaacaaaacaaaacaaaacaaaaagctgcagttcagcaaaagaaactatcaaaagagtaaacaatccacagaatggggattcataaactatacatctgacaaaggtctgaat

SEQ ID NO: 25063 - DNA, 368 bp, Homo sapiens
  chr21.fa.O7frz.22858835
  Located on chromosome 21
  Distance between a terminus base of telomere on chromosomal short arm and 5'-terminus of this base sequence : 22578704
  Distance between 3'-terminus of neighbour sequence of sequence listing upward to telomere on chrosomal short arm and 5'-terminus of this base sequence : 126409
cctagattgccttaaacagattatttgtagaaatggttcacaaatctgctggagtgctcaatgtgagaagcatagtaaagataaatacataagtaaataaataagggagtgtgtgtgtgtgtgtgtgtgtagattataaactgactgtagaaatatgaacataaaagtaaccactggtgagggctagaggaaatggtgatcatggtattggaaattggatgaaaggaaatctttgctatacagttgcagaaactttggagaattgggccttacagctatgcagaaagcagaaatttttcacagtgaacttgtatatttagctaaagagatttccaagcaaagtgctgaatgtgtagactggtttattc

SEQ ID NO: 25064 - DNA, 309 bp, Homo sapiens
  chr21.fa.O7frz.22948916
  Located on chromosome 21
  Distance between a terminus base of telomere on chromosomal short arm and 5'-terminus of this base sequence : 22668842
  Distance between 3'-terminus of neighbour sequence of sequence listing upward to telomere on chrosomal short arm and 5'-terminus of this base sequence : 89770
ccagagatttggatgtaaagtaaggaatctagggttgcaaatatctcaacttctctctctctctctgtctctctctatatatatcacacacggtattgagttaggcattaacataaataagttcttccagtgttttctttttaacagtaatagaaaataatctaacaatattaatatgttgcaaaaaactccacagggccatgaggaccatatacttttaatatttgtggcaagacaacaaatattataattctgtgataatcaaaacttcagaaatacatttcactttacctgccatatagatgaata

SEQ ID NO: 25065 - DNA, 398 bp, Homo sapiens
  chr21.fa.O7frz.23023149
  Located on chromosome 21
  Distance between a terminus base of telomere on chromosomal short arm and 5'-terminus of this base sequence : 22742811
  Distance between 3'-terminus of neighbour sequence of sequence listing upward to telomere on chrosomal short arm and 5'-terminus of this base sequence : 73660
gattagttactgcatatccttgacaatattttggtatagtcggtctctttaattttagatggtctggtaagtgtagtggcatggcactgtagttttaacttacatttccctgataatgagttcttttcatgtatttattagttacatgtgtatattcttttatgaaatatctgctcaaataatttgctcatttgtaatgggttatttgacttttaaatattgaggtgtagggttttgttgtatgtggttgtttgtctcatttgacagattccaactttttaaaaagtttttgaatgttgcacctgctgggtaagagtgtgtgtgtgtgtgtgtgtgtgtgtgtgtgtgtgtatgtgtgcgttctatttataatacttgagtttaatagaacgtcttga

SEQ ID NO: 25066 - DNA, 380 bp, Homo sapiens
  chr21.fa.O7frz.23228619
  Located on chromosome 21
  Distance between a terminus base of telomere on chromosomal short arm and 5'-terminus of this base sequence : 22948280
  Distance between 3'-terminus of neighbour sequence of sequence listing upward to telomere on chrosomal short arm and 5'-terminus of this base sequence : 205071
aaattgtttcatgattgaagttacctgtcattggcggggcgcggtggctcacgcctgtaatcccagcactttgggagaccacggcaggcggatcacgaagtcaggagatcaaggccatcctggctaacacggtgaaaccccatctctactaaaaaaatacaaaaaaattagctgggcgtggtggcgggcacctgtagtcccagctactctggaggctgaggcaggagaatggcgtgaaccccggaggcggagcttgcagtgagccgagatcgcaccgctgcactccagcctgggcgacagagcgagactgtgtctcaaataaataaataaataaataaataaataaataaataaaaataagttacctgtcatctgaatgt

SEQ ID NO: 25067 - DNA, 233 bp, Homo sapiens
  AP001692.1_279462
  Located on chromosome 21
  Distance between a terminus base of telomere on chromosomal short arm and 5'-terminus of this base sequence : 23145480
  Distance between 3'-terminus of neighbour sequence of sequence listing upward to telomere on chrosomal short arm and 5'-terminus of this base sequence : 196820
tagaatggatcctcaattaagaaccacaaagtaccatattatttcactcaatttatgagagcgaaaacacatacagacacacacacacacacacacacacacacacacataaatgcacatatcaaaggctgattaaaaacaattctggccgggcatggtggttcacgcctgtaatcccagcactttgggaggctgaggcgggtggatcacctgtgttcaggagttcgagagca

SEQ ID NO: 25068 - DNA, 293 bp, Homo sapiens
  chr21.fa.O7frz.23580503
  Located on chromosome 21
  Distance between a terminus base of telomere on chromosomal short arm and 5'-terminus of this base sequence : 23300245
  Distance between 3'-terminus of neighbour sequence of sequence listing upward to telomere on chrosomal short arm and 5'-terminus of this base sequence : 154532
tcactattttgtaggttctttgaggagaaaaaatatatttgattttattccagagtttaaagaggaggaatttcttttatatatatgtgtgtgtgtgtgtgtgtgtgtgtgtgtgtgtgtgtatatatatatacgtgtgtgtatatatatatatacgtgtgtatatatatatacgtgtgtatatatacatatatacgtgtatatatatgtgtgtgtgtatatatatacgtatgtgtatatatatacatatatatgtatatattccacctctatctgcaaagtttcttagcata

SEQ ID NO: 25069 - DNA, 314 bp, Homo sapiens
  AP001693.1_138625
  Located on chromosome 21
  Distance between a terminus base of telomere on chromosomal short arm and 5'-terminus of this base sequence : 23343655
  Distance between 3'-terminus of neighbour sequence of sequence listing upward to telomere on chrosomal short arm and 5'-terminus of this base sequence : 43117
gatttgataacagatttctggaagttggactttggactacagcctcaacaaatgatattatctcatttatttatttatttatttatttatttattttttgagacggagttttggtctgtcacccaggctggagtgcaacggcgtgatctcggctcactgcagcctccaccttccaagttcaagctattctgcttcagcctcccaagtagctgggactacaggtgcatgccaccactcccggctagtttttgtatttttagtagagacggggtttcaccatgttggccaggctagtctagaactcctgacctcaa

SEQ ID NO: 25070 - DNA, 418 bp, Homo sapiens
  AP001693.1_322530
  Located on chromosome 21
  Distance between a terminus base of telomere on chromosomal short arm and 5'-terminus of this base sequence : 23527348
  Distance between 3'-terminus of neighbour sequence of sequence listing upward to telomere on chrosomal short arm and 5'-terminus of this base sequence : 183379
aaatcaaatgatctaccatagcagatctccccaaagacactctagctccaaactaactataatcaatcccgtggtgacgacccaaagaaccagggttcctgggttttctctcacgcccagcccacctaggcttctgactgcctatctcctcatcttagagggattcctcctgaccagtcattacaaaaattcttggagcatgagcaagactgagtctgtgtttggattggaggaaggggtaagtaacaaggtatatatatgtatatgtgtgtgtgtgtgtgtgtgtgtgtgtgtgtgtgtgtgcgcgcgcgtttgtgtttaagttacaaactaaggatggttttaaaaaattgcaaaatgttaagagatttatctaggatctgacccacttccccagaaatttacggaattcaagacc

SEQ ID NO: 25071 - DNA, 180 bp, Homo sapiens
  AP001694.1_22179
  Located on chromosome 21
  Distance between a terminus base of telomere on chromosomal short arm and 5'-terminus of this base sequence : 23566189
  Distance between 3'-terminus of neighbour sequence of sequence listing upward to telomere on chrosomal short arm and 5'-terminus of this base sequence : 38423
actcctgaaatgtggtatagtgagggggaaaagcctaggtttgatcccagctctcgcctttgtccatactctttctctctctctctctctctctctctctctctctctgatgtacacttaggatatttaaagtattttgctgcagtgagcatctgtctatgtaatatctgtgcactggtg

SEQ ID NO: 25072 - DNA, 223 bp, Homo sapiens
  AP001694.1_237181
  Located on chromosome 21
  Distance between a terminus base of telomere on chromosomal short arm and 5'-terminus of this base sequence : 23781112
  Distance between 3'-terminus of neighbour sequence of sequence listing upward to telomere on chrosomal short arm and 5'-terminus of this base sequence : 214743
taattgaaccaacgctaacattcaccaacctccacatttctttctacaaaaatcactgggcacagtggcccacacctgtaatcccagcacttaagggaggcaagccaggagttcaagatgagcttgggcaacaaattgagaccctgttgctaaaataaataaataaataaataaataaagttagctgggcatggtggtgtgagcctatagagtaggctacttg

SEQ ID NO: 25073 - DNA, 168 bp, Homo sapiens
  AP001694.1_272550
  Located on chromosome 21
  Distance between a terminus base of telomere on chromosomal short arm and 5'-terminus of this base sequence : 23816554
  Distance between 3'-terminus of neighbour sequence of sequence listing upward to telomere on chrosomal short arm and 5'-terminus of this base sequence : 35219
gaagtttcatgtgaaaggtcacatttctagctcgtgctgtgttgtcagcatactcctccagccttcttctctctctctctgtgtgtgtgtgtgtgtgtgtgtgtgtgtgtgtgtgtgtgtgtgtgtgtgttgttttgggaatgtgtatagcatcttatcaggagctgt

SEQ ID NO: 25074 - DNA, 421 bp, Homo sapiens
  AP001695.1_20238
  Located on chromosome 21
  Distance between a terminus base of telomere on chromosomal short arm and 5'-terminus of this base sequence : 23903085
  Distance between 3'-terminus of neighbour sequence of sequence listing upward to telomere on chrosomal short arm and 5'-terminus of this base sequence : 86363
accacttctgtagctttgacactagcagctcagatagtgtacagggttcgttattgcaaacttctctttctatagagaacagtcatttaaaaatggaagcacccaggattccaaatgaaaggtttttaaaaaagattatctttcagaatgtggcatctggtatatttagaatgatatatatgtcattacttaaaaaaacccaactaatgggtggattgagagcatattacatacatacacacacacacacacacacacacacacacacacattaagagcacatacgtaatatgttctttatttttattatactttaagtttgagggtacatgtgcacaacgtgcaggtctgttacatatgtatacatgtgccatgttggtgtgctgcaccccctaatatgttcttaatccaacctaatggc

SEQ ID NO: 25075 - DNA, 366 bp, Homo sapiens
  AP001695.1_20790
  Located on chromosome 21
  Distance between a terminus base of telomere on chromosomal short arm and 5'-terminus of this base sequence : 23903811
  Distance between 3'-terminus of neighbour sequence of sequence listing upward to telomere on chrosomal short arm and 5'-terminus of this base sequence : 305
gttattacctatgccacttcaactgaagtcacatgtgaaaacaggcttaagatagctgtaaaaaacaaacaaacaaacaaacaaaccatgttttctagaagattttagcttcagttcattaagactgataaattatttcattttgtaccttctacaactttttggagaacttctttacacttatttaatacatagtattttaaaggttccttactgatgtctattctccaagtatacctgaaaagtatatttgtttgctaaagaaacttgatacagtgaaaaattaattggagatctctgttctcaattcatggtgtagactaaaaactccacctccactatcttcataaattcttgctcaacact

SEQ ID NO: 25076 - DNA, 441 bp, Homo sapiens
  AP001695.1_81023
  Located on chromosome 21
  Distance between a terminus base of telomere on chromosomal short arm and 5'-terminus of this base sequence : 23963766
  Distance between 3'-terminus of neighbour sequence of sequence listing upward to telomere on chrosomal short arm and 5'-terminus of this base sequence : 59589
ctcaaggaatctgactgtacttaatcagacctatggcttggctaaaaacgtgtgcccggttgggtgtggtggctcaaaccagtaacccagcactttgggaggccaaggtgggtgaatcacctgaggtcagaagttcgagaccagtctggccaacgtggtgaaacccatctctaccaaaaatacaaaaattagccaggtgtggttgcacacacctgtagtcccagctacttgggaagctgaggcaggagaattgagaattgcttgaacctgggagacggaggttgcagtgagccaagatcgtgccactgaatcccagcctgggtgactgagactccatgtcaacaaaacaaaacaaaacaaaacaaaacaaaacaaaacaaacaaacaaaaaggtgcacccagctggtgcagtggctcacacctgtaatgctagcactttag

SEQ ID NO: 25077 - DNA, 182 bp, Homo sapiens
  D21S1253
  Located on chromosome 21
  Distance between a terminus base of telomere on chromosomal short arm and 5'-terminus of this base sequence : 24013248
  Distance between 3'-terminus of neighbour sequence of sequence listing upward to telomere on chrosomal short arm and 5'-terminus of this base sequence : 49041
gaagaatctcccgaaccagggaggcggaggttgcagtgagccaagatcacaccactgcactccagcatgggtgacagagcgagactctgtctcaaaaaacaaacaaacaaacaaacacacacacacacacacacacacacacagaatagtgtttaacccaggctctgaataacactggtctt

SEQ ID NO: 25078 - DNA, 383 bp, Homo sapiens
  AP001695.1_206771
  Located on chromosome 21
  Distance between a terminus base of telomere on chromosomal short arm and 5'-terminus of this base sequence : 24089700
  Distance between 3'-terminus of neighbour sequence of sequence listing upward to telomere on chrosomal short arm and 5'-terminus of this base sequence : 76270
cctgtagtcctagctacttaggaggctgaggcgggaggatcgcttgagacaaggaggttaaggctacagtaagccatgatgactccatggcactccatcctgggtgacagagagatagcctgtctcagaaaacaaaacaaaacaaaacaaaacaaaacaaaacaaaatcctcctgcaaatattctgttggtggatagttttcaatgtatacaatacagtcagtacctgttactcaatatttatccattgcaaacacaacacagaaacctaaggaactcaaaaagcaaactgacatttgtcaggaactgctcccttgttggtcaaagaagaggaaaaggagggctttcttcgatattattgtctactttcttggtaagcaataa

SEQ ID NO: 25079 - DNA, 319 bp, Homo sapiens
  AP001695.1_218695
  Located on chromosome 21
  Distance between a terminus base of telomere on chromosomal short arm and 5'-terminus of this base sequence : 24101584
  Distance between 3'-terminus of neighbour sequence of sequence listing upward to telomere on chrosomal short arm and 5'-terminus of this base sequence : 11501
tactttgctgaaatggcatatttgggggtagcatattctgatccccttcatacccttccagactgtgtctctatccagctcctcactggcttaatttttcttcatagcactgaccaccaagtggcacagagtatactgattgacatctagatagacagatagatagacagatagatagacagacagacagacagattgactgatttgctctctgccccacccaacaaagtacaagctctgtgagatcaggaagctggcctctttcatggttgtatcccaatgcttggcatagtgttggtgttcaattaatgcaccaaat

SEQ ID NO: 25080 - DNA, 393 bp, Homo sapiens
  chr21.fa.O7frz.24520285
  Located on chromosome 21
  Distance between a terminus base of telomere on chromosomal short arm and 5'-terminus of this base sequence : 24239833
  Distance between 3'-terminus of neighbour sequence of sequence listing upward to telomere on chrosomal short arm and 5'-terminus of this base sequence : 137930
ataaatttaggcttgaatcacttctctttttttgaacgaaagataaaactgtaaagaaatatagagatacatggaaggatgatgttaaatcaatacaaaatgatcagtgagttaaaagttacaggttctaggaaacatggctggtgaatacaataataatttattaattttaatgtcagcttcaaatttttggttctttggaaaattgtttaggcccccaaatatataggtctatgtatgtatgtatgtatgtatgtatgtatgtatgtatgtatgcatgcatgtatgcatgcatgcatgtatgtatgtatgtatgtatgtatgtatgtatctatctatctatctatctatctatctatctatctatctatctatctatagctgcattgatgc

SEQ ID NO: 25081 - DNA, 320 bp, Homo sapiens
  AP001696.1_141909
  Located on chromosome 21
  Distance between a terminus base of telomere on chromosomal short arm and 5'-terminus of this base sequence : 24363674
  Distance between 3'-terminus of neighbour sequence of sequence listing upward to telomere on chrosomal short arm and 5'-terminus of this base sequence : 123448
gattgaacagtttcaagcagataattaatctcccagtggccatacttgctcctttccattcttttatacttagagcaacccagctttctttactaaagtctcacctcctcgagagcaggaactttttctcttttggctcctgttatcttcccagcacctagaaaagtgcctggcatgcagtaggtacacacacacacacacacacacacacacacacacacacacaaaagttcaatgaaagaacccactaatctgtaagtttattgccaacccagcttcttggtttatcaattattgtatttcttgaccataatgctctg

SEQ ID NO: 25082 - DNA, 278 bp, Homo sapiens
  AP001696.1_155847
  Located on chromosome 21
  Distance between a terminus base of telomere on chromosomal short arm and 5'-terminus of this base sequence : 24377699
  Distance between 3'-terminus of neighbour sequence of sequence listing upward to telomere on chrosomal short arm and 5'-terminus of this base sequence : 13705
aacaaaggaagtatcaagtgaaaggcacattgtaaacatccacgacccccttccctggagccctgtgagggcagggctagaatttatagacacactccagagagagagagagagagagagagagagagagagagagagagagacctcaagagcaaatcagaggaaatcacaacaacgtcttcctgggagatacaaattttgtacatgtcagtgtatagatgatatttatcatttataatctttggatgagatgagacccctgagcgaaacaacgtctt

SEQ ID NO: 25083 - DNA, 366 bp, Homo sapiens
  AP001696.1_180478
  Located on chromosome 21
  Distance between a terminus base of telomere on chromosomal short arm and 5'-terminus of this base sequence : 24402242
  Distance between 3'-terminus of neighbour sequence of sequence listing upward to telomere on chrosomal short arm and 5'-terminus of this base sequence : 24265
ttagagctagccttatgagtgaactgcctgtaacattttgggaggaggtggtaaaggagtaagaaaccaacatgtcctgcatacttactatctagcactacacagaacttttcctttcatcatcataacaagagtatgagtgtattagtcagagttcttcagaaaatatatccaatagggtatatatgtgtgtgtgtgtgtgtgtgtgtgtgtgtgtgtatgtgtgtgtttgtgtgtatagagagagagactcatttttaaagaattagcttatgtgaacttgtgggttggcaagtccctattctgtaaggcaggccagtagtctgaaaactcaggcagagtttctatgttggagtcttgaagcag

SEQ ID NO: 25084 - DNA, 284 bp, Homo sapiens
  AP001696.1_181056
  Located on chromosome 21
  Distance between a terminus base of telomere on chromosomal short arm and 5'-terminus of this base sequence : 24402857
  Distance between 3'-terminus of neighbour sequence of sequence listing upward to telomere on chrosomal short arm and 5'-terminus of this base sequence : 249
accagatcatactaagtggcttacaatttgcaagtgaggaaattgggctcaaagaaattatgtaacttcaacaaggtcttgtaagtggttgagctgagattcaaatccaattctgactaacttcaaagtccacatgtggccactgcacgcacacacacacacacacacacacacacacacactaacatctcatatcctttctagacaaatccctggaaaaatttatgtcgtagaagaggaaaactaaccaagaccatctttcattatcattggtattgaaagcg

SEQ ID NO: 25085 - DNA, 211 bp, Homo sapiens
  D21S1896
  Located on chromosome 21
  Distance between a terminus base of telomere on chromosomal short arm and 5'-terminus of this base sequence : 24402944
  Distance between 3'-terminus of neighbour sequence of sequence listing upward to telomere on chrosomal short arm and 5'-terminus of this base sequence : -197
gttgagctgagattcaaatccaattctgactaacttcaaagtccacatgtggccactgcacgcacacacacacacacacacacacacacacacactaacatctcatatcctttctagacaaatccctggaaaaatttatgtcgtagaagaggaaaactaaccaagaccatctttcattatcattggtattgaaagcggttatgcaccacag

SEQ ID NO: 25086 - DNA, 364 bp, Homo sapiens
  AP001696.1_291912
  Located on chromosome 21
  Distance between a terminus base of telomere on chromosomal short arm and 5'-terminus of this base sequence : 24513623
  Distance between 3'-terminus of neighbour sequence of sequence listing upward to telomere on chrosomal short arm and 5'-terminus of this base sequence : 110468
ttgtctgacctacatattcctacatatattcaaaggttactcgttccccactagccacactgaacagtagggactttctcaactggatcatttcctttcttgtatctttgactttgtatgctagagtctgtcttaaaaccatgtccctttcttcactatttatgtaaatatctacttttccttcaaaactctgatcagattccatgttgatgatctgttccctaaacatctcctcctaaacacacacacacacacacacacacacacacacagagacatacacaaacacacacacacagagacatacacaaacacacacacacacacacacacacacacacggacagacttagctttccagtcc

SEQ ID NO: 25087 - DNA, 269 bp, Homo sapiens
  D21S260
  Located on chromosome 21
  Distance between a terminus base of telomere on chromosomal short arm and 5'-terminus of this base sequence : 24550340
  Distance between 3'-terminus of neighbour sequence of sequence listing upward to telomere on chrosomal short arm and 5'-terminus of this base sequence : 36353
agagcccagaatattgacccctgcctgtcaggaaacattagaaacattatgtggttgctttacacttgatttatgcactagttgggcttgtagactctttccaaaagtctgaatttttccaaaaattcagtgatgggaagaaggggtggtgtgtgtgagtgtgtgtgtgtgtgtgtgtgtgtgtgacctaaaacctctaaataaatgcatgggaaacttctcgcatctggttgtattctctctcttcacagatggaagcatgaacagct

SEQ ID NO: 25088 - DNA, 449 bp, Homo sapiens
  AP001697.1_19105
  Located on chromosome 21
  Distance between a terminus base of telomere on chromosomal short arm and 5'-terminus of this base sequence : 24579808
  Distance between 3'-terminus of neighbour sequence of sequence listing upward to telomere on chrosomal short arm and 5'-terminus of this base sequence : 29199
gttcatagaaagttactggaccagttaaattaacaattcttatcttgtgattttagtctagcccaaaggaagcagctttattttgcatgggtgcagtcaacagaaaagctagacttttgtgtttggtaatttccctgcagtgtgttttatctgagattgagggataaaaagagttgccttttggaaaaacaaagggaaaaaaaagtctcccattatacaatagatactgaatcatccctttcattctacacacacacacacacacacacacacacacacacacacacacacacacacatacagccccctcagaataaaattaataacggaagtaatcaataaaatcataaatatggaaattgagtcatgtttaacataagaacataagaaaatgcttgctacacatacttattttacatattagagggatgccatagatttgtaaagca

SEQ ID NO: 25089 - DNA, 255 bp, Homo sapiens
  D21S269
  Located on chromosome 21
  Distance between a terminus base of telomere on chromosomal short arm and 5'-terminus of this base sequence : 24580007
  Distance between 3'-terminus of neighbour sequence of sequence listing upward to telomere on chrosomal short arm and 5'-terminus of this base sequence : -250
aaaaagtctcccattatacaatagatactgaatcatccctttcattctacacacacacacacacacacacacacacacacacacacacacacacacacatacagccccctcagaataaaattaataacggaagtaatcaataaaatcataaatatggaaattgagtcatgtttaacataagaacataagaaaatgcttgctacacatacttattttacatattagagggatgccatagatttgtaaagcaaaggg

SEQ ID NO: 25090 - DNA, 313 bp, Homo sapiens
  AP001697.1_107929
  Located on chromosome 21
  Distance between a terminus base of telomere on chromosomal short arm and 5'-terminus of this base sequence : 24668775
  Distance between 3'-terminus of neighbour sequence of sequence listing upward to telomere on chrosomal short arm and 5'-terminus of this base sequence : 88513
aacgtttcctaagtcattctacacaataaattaatactacacaattaatacctgcacatatagtccagaaggaaatgaaatggacaggtgcctgtgtgcgcgcctgtgtgtgtgtgtgtgtgtgtgtgtgtgtgtgtgtatgtgtgtgtgtgtgtgtgtaggtggggtaaggggataggaaattacagctctgagggtgaaactaatttagttctattttcagaagcctcaaatctccactcccacttctcttgcagtatgcaggaaggaggctggatcccatcaatacctaaggaaagctcactatcacttg

SEQ ID NO: 25091 - DNA, 404 bp, Homo sapiens
  AP001697.1_111867
  Located on chromosome 21
  Distance between a terminus base of telomere on chromosomal short arm and 5'-terminus of this base sequence : 24672531
  Distance between 3'-terminus of neighbour sequence of sequence listing upward to telomere on chrosomal short arm and 5'-terminus of this base sequence : 3443
cttatgctttgcaacgtatttatcaaaaaatacctgacaactgcacttccgtttggatgttgcaagaataaaattaagataatattcatgaagtcttctgaggcccttattatagatattttagataaatgtttcattgttattagaagctaaagcaatctattaagtgcccatggcatttattttttaatcgtgaaaacttggaagttatttggtttctgttgtaattttaatagttacatttgtaacacaaaagataaagaaaatttatttgttaatgtttgcttgtgtgtgtgtgtgtgtgtgtgtgtgtgtgtgtgtgtgtgtgtgtaggatgacttatgccccgcaaagatattcagctcttagaccctgtatccctgtgtaagttaccttatggcaat

SEQ ID NO: 25092 - DNA, 325 bp, Homo sapiens
  AP001697.1_156466
  Located on chromosome 21
  Distance between a terminus base of telomere on chromosomal short arm and 5'-terminus of this base sequence : 24717356
  Distance between 3'-terminus of neighbour sequence of sequence listing upward to telomere on chrosomal short arm and 5'-terminus of this base sequence : 44421
gtttacattaccgttttgtcaaaggtctttttctggtcgctatctctctctctttctctgacacacacacacacacacacacacacacacacacacatacccacacacatacacacacacattctcgtagcctcacatgcatacatttatagttcaccttctcttctctctaccatgttctctttaccaggctaagccagcaatggaaaaataataggaacgagtggcccttcagcaagaacccatgaagaccagcctatgttttccattttgggccaggaagtagcaggagacttacatcctgtgctgttaatatcagatcctc

SEQ ID NO: 25093 - DNA, 425 bp, Homo sapiens
  AP001697.1_167148
  Located on chromosome 21
  Distance between a terminus base of telomere on chromosomal short arm and 5'-terminus of this base sequence : 24727851
  Distance between 3'-terminus of neighbour sequence of sequence listing upward to telomere on chrosomal short arm and 5'-terminus of this base sequence : 10170
catggaactcattacagaactttcatatctagaggaccatcttttggacaaagttgcgcaaagctctgaccagagctttcaaaattccatgtatatgtactgtattagtcagcattctaacacattcttgagattttcttcctctagaaccactctcagtaccaaattctgtattagtcagggttctccaggaaagacagagccaatagaatatgtgtgtttatgctgtgtatgtatgtgtgtgtatacacacacacacacacacacacacacacacacagtagtccttccttatctgcaggggaaacattccaagacccccagtagatgcctgaaaaagcaaatagtaccaaaccctatatctcacgtggatgaatttctttgtctttctttacatctccacagatagaaggttgattctgact

SEQ ID NO: 25094 - DNA, 417 bp, Homo sapiens
  chr21.fa.O7frz.25099652
  Located on chromosome 21
  Distance between a terminus base of telomere on chromosomal short arm and 5'-terminus of this base sequence : 24819342
  Distance between 3'-terminus of neighbour sequence of sequence listing upward to telomere on chrosomal short arm and 5'-terminus of this base sequence : 91066
ctcactccattgatttaaatgttaatctcatgtaaaatatcctcccagaaacactcagaataatgtttgagcccagatctgggcaccctgtgacccaatcaagttcatagataaaattaaccatcactatgtgcttttgcgtgtgtgtgtgcgtgtgtgtgtgtgtgtgtgtgtgagtgacagggtcttgctctgtcacccagactggagtgcagtggtgtgaacatggctcactgcagcctcaaccttctgggctcaaacaatacttctaccttagcctcctgagttgctgggaccacaggtgtcagacttcataccccaccagctttttataatatcaaagaatcaaagaatgttaaaatataagcaatttcagatacattagaatacaggtatatgatttagtgctatgttgca

SEQ ID NO: 25095 - DNA, 353 bp, Homo sapiens
  AP001698.1_72207
  Located on chromosome 21
  Distance between a terminus base of telomere on chromosomal short arm and 5'-terminus of this base sequence : 24971942
  Distance between 3'-terminus of neighbour sequence of sequence listing upward to telomere on chrosomal short arm and 5'-terminus of this base sequence : 152183
aattgaatgataagttcagcctatattatatttcaaccttcatcaggtcttcacatcctttctgtgaggttatctgatgatgagtgtaatggataagtctaaaattgttaggaaattgaggcttagcacatttttaatttcacttttattatggcccgtgttgaaatgcaaaatttctgtaggtttgatgtttgctaaaggcactgggaaaaacacacacacacacacacacacacacacacacacacacatattccttatatgactaattcaaacacctttattttaaaactctaagtcagcaacaataagaattttaggtggacccagttacagttctcataatgcttggt

SEQ ID NO: 25096 - DNA, 466 bp, Homo sapiens
  AP001698.1_199218
  Located on chromosome 21
  Distance between a terminus base of telomere on chromosomal short arm and 5'-terminus of this base sequence : 25098867
  Distance between 3'-terminus of neighbour sequence of sequence listing upward to telomere on chrosomal short arm and 5'-terminus of this base sequence : 126572
aacagaggaaattgactttagtgatatatttcatttaaggaatagataaaaaatattttcattgctatatgtaactaatataaaaatgatcaatgagactgatatggtttagctgtgtccccacccaaatcccaatttgaattttaactcccacaattcccatgtgtcataggggggaaccagtaggaggtaactgaatcatgggggcaggtctttcttgtgctattctcatgatagtgaatatgtctcatgagatctgatggttttgaaaagaggagttaccctgcataagttctctctctctctctctctctctctctctctctctctttgcctgctgccatccatgtagtatatgacttgctcctcccttgccttctgccatgactgtgaggcttccccgcccatgtggaactgtaagtccatcaaacctctttcttttgtaaattgtccagtctcaggtatg

SEQ ID NO: 25097 - DNA, 446 bp, Homo sapiens
  chr21.fa.O7frz.25508961
  Located on chromosome 21
  Distance between a terminus base of telomere on chromosomal short arm and 5'-terminus of this base sequence : 25228394
  Distance between 3'-terminus of neighbour sequence of sequence listing upward to telomere on chrosomal short arm and 5'-terminus of this base sequence : 129061
acactttcagataaacatgcagaaacacacccaccatttggatgtcttccctaggaattgcctgtacataaaccttgacctctctgcttggatagctgactttttatcttgttgattcataggagttatttacatactttggataagaattcttgcagattatgttatttttcccagagcttggttttttattttcacatacatactgcctgttttaatgagaagaaattttaaaagtatctactttttatccttatctttcctgttttagctatttatatcttgtttaataaacatttcttttccctgaggcaacagagacattcagacacatttaaaaatttttacattttcagtattcacttttaggtccaacgtaccttgaattcatttgtgtgtgtgtgtgtgtgtgtgtgtgtgtgtatcctgtaggtatggatctaact

SEQ ID NO: 25098 - DNA, 315 bp, Homo sapiens
  AP001699.1_132034
  Located on chromosome 21
  Distance between a terminus base of telomere on chromosomal short arm and 5'-terminus of this base sequence : 25370812
  Distance between 3'-terminus of neighbour sequence of sequence listing upward to telomere on chrosomal short arm and 5'-terminus of this base sequence : 141972
tcattcctttacctttctgtagagaggtggctgtcagtttccactttctgaagttttcaaatgttctttctctctttctctttccctctttcgatacaaaaggaagtattggaagaaatgtcctcaaaaatgttttgagttcacagcaactttatcaaacacaaaaataaataaataaataaataaataaataactggaaatattgttatgaggtcaattttccatttatcaaaatttcctttcttgacaaacacaattcactggtcattttaagttttaaggaaagtgctgtatttaatggctcatgcatattt

SEQ ID NO: 25099 - DNA, 242 bp, Homo sapiens
  D21S1442
  Located on chromosome 21
  Distance between a terminus base of telomere on chromosomal short arm and 5'-terminus of this base sequence : 25397286
  Distance between 3'-terminus of neighbour sequence of sequence listing upward to telomere on chrosomal short arm and 5'-terminus of this base sequence : 26159
ctcctccccactgcagacggcatgaacttccggtggctccaccttgttctcccagtgcacagactgtacagaggttctccgggcacccctttatacttggctgtgatagatagatagatagatagatagatagatagatagatagatgatagatagatagatagatagacagacagatagatagagggatagatggatggtagagtactattataaggaattggctcatgtgattctggaga

SEQ ID NO: 25100 - DNA, 304 bp, Homo sapiens
  AP001699.1_159839
  Located on chromosome 21
  Distance between a terminus base of telomere on chromosomal short arm and 5'-terminus of this base sequence : 25398583
  Distance between 3'-terminus of neighbour sequence of sequence listing upward to telomere on chrosomal short arm and 5'-terminus of this base sequence : 1055
ctactcaaatgtaaccacctcaacgtgatcttttatgaccatctacccaacttccatcaccatcactccctccctggctttatatttattcagagcacttaataatgcttgactgtttatcacacatttatcagttattatcaaggtcaactgccaaaatctaagcacaaaaacaaaatctgtcactgttatcaatgctgtgtgtgtgtgtgtgtgtgtgtgtgtgtgtgtgtattttaactcaatgctttattttccttccctttatctggtctatattgaaacgactccagttatcttcata

SEQ ID NO: 25101 - DNA, 143 bp, Homo sapiens
  D21S1258
  Located on chromosome 21
  Distance between a terminus base of telomere on chromosomal short arm and 5'-terminus of this base sequence : 25398726
  Distance between 3'-terminus of neighbour sequence of sequence listing upward to telomere on chrosomal short arm and 5'-terminus of this base sequence : -161
aggtcaactgccaaaatctaagcacaaaaacaaaatctgtcactgttatcaatgctgtgtgtgtgtgtgtgtgtgtgtgtgtgtgtgtgtattttaactcaatgctttattttccttccctttatctggtctatattgaaacg

SEQ ID NO: 25102 - DNA, 237 bp, Homo sapiens
  AP001699.1_216155
  Located on chromosome 21
  Distance between a terminus base of telomere on chromosomal short arm and 5'-terminus of this base sequence : 25455073
  Distance between 3'-terminus of neighbour sequence of sequence listing upward to telomere on chrosomal short arm and 5'-terminus of this base sequence : 56204
ggtgacagagtaagactccataatacacacacacacacacacacacacacacacacacacacacacaactaggaataggaatatgacaagattgtgttgtttttcacatgagagatttaaatcaaagtaatgaaagtattaagaaatgctttattttgtgtgtgtgacaatattcaggaaatacaacaaattttactaattaaaataactttgaagtatgaaagcaaattttgcaaa

SEQ ID NO: 25103 - DNA, 174 bp, Homo sapiens
  D21S1915
  Located on chromosome 21
  Distance between a terminus base of telomere on chromosomal short arm and 5'-terminus of this base sequence : 25698825
  Distance between 3'-terminus of neighbour sequence of sequence listing upward to telomere on chrosomal short arm and 5'-terminus of this base sequence : 243515
tgcaggattgtgccaggtctcaggtaaaaattttgtgtgtgtgtgtgtgtgtgtgtgtgtatgtgtgcatattcatgtgtgcatatctatgagcatgtgtgtatgtgtttactatgtttgataatgaaccattatgcaagagacattaattttgttgctttggctcacttcata

SEQ ID NO: 25104 - DNA, 243 bp, Homo sapiens
  AP001700.1_134579
  Located on chromosome 21
  Distance between a terminus base of telomere on chromosomal short arm and 5'-terminus of this base sequence : 25712448
  Distance between 3'-terminus of neighbour sequence of sequence listing upward to telomere on chrosomal short arm and 5'-terminus of this base sequence : 13449
tttacaatctaggtgaaggcactcaagagatatttaaacatttcccctctaagacatcagtttaaagaaagacagaaagaaagaaagaaagaaagaaagaaagaaagaaagaaagaaagaaagaaagaaagaaagaaaaccctttgctagcacaaaacagtccccaaaaccttactgttggggttgagaaactgatacctcctatggcactttggaatgctgagtactttgaatcaaaggagt

SEQ ID NO: 25105 - DNA, 201 bp, Homo sapiens
  AP001700.1_158176
  Located on chromosome 21
  Distance between a terminus base of telomere on chromosomal short arm and 5'-terminus of this base sequence : 25735990
  Distance between 3'-terminus of neighbour sequence of sequence listing upward to telomere on chrosomal short arm and 5'-terminus of this base sequence : 23299
cgacattggagattacaatttaacataatatttggcagggacagaaatccaaaccataacagtggctcatcactaactgttcatattctatgtttatttttactctttctcctagtcactgaaatgcaacacacacacacacacacacacacacacacacacaaacacaatctttaaaatcagcttcaaatcagaactcta

SEQ ID NO: 25106 - DNA, 308 bp, Homo sapiens
  AP001700.1_166837
  Located on chromosome 21
  Distance between a terminus base of telomere on chromosomal short arm and 5'-terminus of this base sequence : 25744645
  Distance between 3'-terminus of neighbour sequence of sequence listing upward to telomere on chrosomal short arm and 5'-terminus of this base sequence : 8454
taatggatgctggtcttaacacctaggtgatggaatgaactgtgcggcaaatcaccaaggcacacctacacctatgtaacaaacctgcacatcctgcacatgcacccctgaacttaaaataatagttgaaaaagtatatatatatatatatatatatatatatatatggaatagtcattattatattgattatatattatattgtcctaatcaaatataggtagagatacagatagtacaggcttaaaacagcacaaatatatttcttgaattttcctaaaatatcaaatttcctgtccatagtatta

SEQ ID NO: 25107 - DNA, 427 bp, Homo sapiens
  AP001700.1_183713
  Located on chromosome 21
  Distance between a terminus base of telomere on chromosomal short arm and 5'-terminus of this base sequence : 25761363
  Distance between 3'-terminus of neighbour sequence of sequence listing upward to telomere on chrosomal short arm and 5'-terminus of this base sequence : 16410
agctgaactattgattcacctaacatcttagacggatctcaagcaactacactgactgaaaagttagctttaaaaagttacatagggtgtaattccatttctgtaacagtgttgaaataacaaaatgatagaaatggaagacagattagtggttgttagaagttagaaggttggggtggtagggatgtgaatgtgactacataaaagtcagtacaggttaaaagggtcccatatctttattgtgggagtaatcacacggatctacaaatgtgattaaagcacataaggctaaacacacacacacacacacacacacacacacacacacacaaatgaatgcatgcaaacccagtgatatctgaataagatctatgactgtcagtttcttgattgtaatattgtactcaacataggatatgaccattgt

SEQ ID NO: 25108 - DNA, 221 bp, Homo sapiens
  AP001700.1_313709
  Located on chromosome 21
  Distance between a terminus base of telomere on chromosomal short arm and 5'-terminus of this base sequence : 25891496
  Distance between 3'-terminus of neighbour sequence of sequence listing upward to telomere on chrosomal short arm and 5'-terminus of this base sequence : 129706
gatgtaattgtcaactccgaaggaggtcatttcactagcacatcctatggagtggctgagctgttagcagcagaaggctatcctaatgacaaacatacaaccaaaagccccagacaagcaaactgttgcacacagggctgtgtgtgtgtgtgtgtgtgtgtgtgtgtgtgtgtgtgtgtttgtgtatgcttgcatatatgtttcaactgaaatccacttgt

SEQ ID NO: 25109 - DNA, 328 bp, Homo sapiens
  AP001700.1_331397
  Located on chromosome 21
  Distance between a terminus base of telomere on chromosomal short arm and 5'-terminus of this base sequence : 25909138
  Distance between 3'-terminus of neighbour sequence of sequence listing upward to telomere on chrosomal short arm and 5'-terminus of this base sequence : 17421
tagtattggtgccgagatagacaagtagataaggtgaatagaatatagaagccaatgatggatccctgcatatatttatacttaatatatgacttgcctgggaagaaagactcaacaaatgctgcaggaacgattaatcattcacaataaaataaataaaatttgatctctgcataacttgcctacacacacacacacacacacacacacacacacacacgcaaaatcctcagaacacacagattagattcccggcagattatagacataaaagataaaaactaacgtcttacaagaaaacataagcaatgtatttgatctgaatgta

SEQ ID NO: 25110 - DNA, 383 bp, Homo sapiens
  chr21.fa.O7frz.26381258
  Located on chromosome 21
  Distance between a terminus base of telomere on chromosomal short arm and 5'-terminus of this base sequence : 26100897
  Distance between 3'-terminus of neighbour sequence of sequence listing upward to telomere on chrosomal short arm and 5'-terminus of this base sequence : 191431
ctataattgctagatgaggtcaattgatgttgggctctgcctatcatatctaacaggtgaggaaaaggcaagacagctgttgatgggtgaaccaaagaaagtgagattgatcaagggaggtccacactcccagcttcagtactgaaggcgagcacgcgcgcgcgcgcgtgtgtgtgtgtgtgtgtgtgtgtgtgtgcgtgctcaggagggatgcccaaagggcaaacagacttgagtagaaaaacagaaaaactacaattgctgtcagatgtgcagggcctgagaaagaagcaagggagaggccagaaaagggagcatctttgactctaagggtaaggaatgaagacaagaaaggattcacagtagaaacgtagtcagcttca

SEQ ID NO: 25111 - DNA, 386 bp, Homo sapiens
  chr21.fa.O7frz.26711444
  Located on chromosome 21
  Distance between a terminus base of telomere on chromosomal short arm and 5'-terminus of this base sequence : 26431019
  Distance between 3'-terminus of neighbour sequence of sequence listing upward to telomere on chrosomal short arm and 5'-terminus of this base sequence : 329739
agaattacctttgtctttggacttaggcagcgttcttccctgggtctgcagcctgccagcttaccctgaagattttagacttaccaagctttcacaatcacatgaaaaaaattccttgaataaatccttccccctctctctctctctctatatatatatatatatatatttacacatgtacagttggttctatctgtctggagaaccctgactaaggcaggcatataaagtttatttggtggttcttcatttagacagcttttgtgattgactatgaaagagttctccccaaaaccttgcaaagcagtagtgtagacttttcacagctgtggtattccccatttgtcactgcaaagagccatctgtttctagctttctggcttaaa

SEQ ID NO: 25112 - DNA, 176 bp, Homo sapiens
  AL163247.1_296834
  Located on chromosome 21
  Distance between a terminus base of telomere on chromosomal short arm and 5'-terminus of this base sequence : 26552651
  Distance between 3'-terminus of neighbour sequence of sequence listing upward to telomere on chrosomal short arm and 5'-terminus of this base sequence : 121246
cctagcattagtcaccttctgacatctctctctctctctctctctctctctctctctctctctctttctgtaatttattcatttaggattgctctttctttctagtatgtaagccccaaggagcaaggagattttccattcactactgtttttctagttccaagaactgaagctag

SEQ ID NO: 25113 - DNA, 207 bp, Homo sapiens
  Z67768
  Located on chromosome 21
  Distance between a terminus base of telomere on chromosomal short arm and 5'-terminus of this base sequence : 26882094
  Distance between 3'-terminus of neighbour sequence of sequence listing upward to telomere on chrosomal short arm and 5'-terminus of this base sequence : 329267
tccgaagttagacattgtgtaggtgtgtgtgtgtgtgtgtgtgtgtgtgtgtgtgtttatgtgtataaaatacataaaatataagtaagttaatttctctttagacttaccaagcaggctgaatggaattttttcttgcatgttctacaggcttttttgggaagggaatagttgaaaccgtgaatgactgagaaacagatcatgcaa

SEQ ID NO: 25114 - DNA, 234 bp, Homo sapiens
  AF124730.1_77743
  Located on chromosome 21
  Distance between a terminus base of telomere on chromosomal short arm and 5'-terminus of this base sequence : 27130471
  Distance between 3'-terminus of neighbour sequence of sequence listing upward to telomere on chrosomal short arm and 5'-terminus of this base sequence : 248170
ccatgttggaacagagtattcttaaacagaacccttaaaaccatatttttcacctctctgtttttatctatctatctatctatctatctatctatctatctatctatctatctattgagacagggtcttgctctgtcacccaggctggagtgcagtcgtgtgatcacggttctctgcagcctcgatctcctgggctctagctatcctcccaactagctcagattacaggaatgc

SEQ ID NO: 25115 - DNA, 391 bp, Homo sapiens
  AP001705.1_1390
  Located on chromosome 21
  Distance between a terminus base of telomere on chromosomal short arm and 5'-terminus of this base sequence : 27274092
  Distance between 3'-terminus of neighbour sequence of sequence listing upward to telomere on chrosomal short arm and 5'-terminus of this base sequence : 143387
tttgacttagctgagattatccagcttgtgtgtatcagcaatttattcctttttattgctgagtaatattctgtagtatggatgtaccttgtgtgtgtgtgtgtgtgtgtgtgtgtgtgtgtgtgtgtgtgtgtagctttttacctattgaaggaaatcaggctaattctggtttttggctatcacaaataaaattgctgtaaacatttgtgtactggtttttgtgtgaacataaatttgcatttctctgggataaaagaccaggagtgcagttgctgggttatatggtagttgcatgtttagttttataagaaagtttttttcaaagtgtctgtaccattttacattcccactagcaatatgtgagtgatttagtttatcggcattctca

SEQ ID NO: 25116 - DNA, 286 bp, Homo sapiens
  AP001705.1_107922
  Located on chromosome 21
  Distance between a terminus base of telomere on chromosomal short arm and 5'-terminus of this base sequence : 27380594
  Distance between 3'-terminus of neighbour sequence of sequence listing upward to telomere on chrosomal short arm and 5'-terminus of this base sequence : 106111
aggaatcagtcacttagcgatatcaggtaaattcctgtgcaaggaaataatatctcagtactcccaattcactaagccaaaaaggaaaagttaagttgagtcatgcagaacacacacacacacacacacacacacacacacacacacacacacacaaacaacaacaacaacaacaacaatagcaaactacctttgcttgagttcctaaacaaatagttatagggtagaaggccacatgtctcttcagggggcttctctcactctgacaatgtaagtgaacagctta

SEQ ID NO: 25117 - DNA, 298 bp, Homo sapiens
  AP001705.1_123233
  Located on chromosome 21
  Distance between a terminus base of telomere on chromosomal short arm and 5'-terminus of this base sequence : 27395799
  Distance between 3'-terminus of neighbour sequence of sequence listing upward to telomere on chrosomal short arm and 5'-terminus of this base sequence : 14919
taggagtcagacaggagctataagttcatgtactgttgatactgagttcccacacacatgcacactcacatgtatgacacacgtgtacacacacatacatgtgcacacacacaccaacccacaaaagccaatccaagagaacattcagactcggaaagagctgttttgttatctttcaacttctcgtgagaagcagttttccctttaggtttttcaattaattaattaattaattaattaactttttgaggcagggtctctctctgttgtccaggctggagtgcaatggagctatcgt

SEQ ID NO: 25118 - DNA, 215 bp, Homo sapiens
  D21S1901
  Located on chromosome 21
  Distance between a terminus base of telomere on chromosomal short arm and 5'-terminus of this base sequence : 27423935
  Distance between 3'-terminus of neighbour sequence of sequence listing upward to telomere on chrosomal short arm and 5'-terminus of this base sequence : 27838
agagaatctttagggacaactgttggttggggataaacaaggggatgcttcctccctttcctcaagtcactagtgaggttgtaatagggttgtccagagaaacaaccagtaggatatatagacacgcgcgcgcgcgcacacacacacacacacacacacacacaccacagaaagagagattggctcacacaattgtagaggttggcaagtccaaa

SEQ ID NO: 25119 - DNA, 215 bp, Homo sapiens
  HUMUT1229
  Located on chromosome 21
  Distance between a terminus base of telomere on chromosomal short arm and 5'-terminus of this base sequence : 27644995
  Distance between 3'-terminus of neighbour sequence of sequence listing upward to telomere on chrosomal short arm and 5'-terminus of this base sequence : 220845
gctcatggaatgctaaacacttgtaacttgcaggctgacatatctatatctatatcaatatctatctatctatctatctatctatctatctatctatctatatatatatattttgagatggagtcttgctctgttgcccaggctggagggcagtggtgcaatcttggctcattgcaacctccgcctcccaggttcaagcaattctcctgcctcag

SEQ ID NO: 25120 - DNA, 417 bp, Homo sapiens
  AP001706.1_49921
  Located on chromosome 21
  Distance between a terminus base of telomere on chromosomal short arm and 5'-terminus of this base sequence : 27661402
  Distance between 3'-terminus of neighbour sequence of sequence listing upward to telomere on chrosomal short arm and 5'-terminus of this base sequence : 16192
tcctcattgactcaaaagttagacgtatttttaaacttcaaaagtttaaagattttgtaatttttttctaatgaaaaacaaagtagctcaagtatgttactgaaaataaaaagaaaacttgtgaaatttttcttttttgaaaataaagaaaaaaggagaaaaaaatcatctacaattctagtacctagagagttactgatatcaagatttgggtgtattttcttccaatccttttttgctatgtgtatttataaatatgtgtgtgtgtatacgtatataagtatatgtatacatacatacacacacacacacacacacacacacacacacacacacacatatatataggtcctggaatcatactgcatataaaatgttgtattttgtgtttttttcttaatggcattttccatgtta

SEQ ID NO: 25121 - DNA, 211 bp, Homo sapiens
  AP001706.1_105715
  Located on chromosome 21
  Distance between a terminus base of telomere on chromosomal short arm and 5'-terminus of this base sequence : 27717335
  Distance between 3'-terminus of neighbour sequence of sequence listing upward to telomere on chrosomal short arm and 5'-terminus of this base sequence : 55516
ttgaagtagacttgcctttgagtcagaagtccctactcctcttctctttcattttggttcaagttaatttctcctcagctgaaatttgtatgtatgtgtgtgtgtgtgtgtgtttgtgtgtgtgtgttctcctcagctgaaattcatgtgtgtgtgtgtgtgtgtgtgtgtgtgtgtgtgtgtgtatgtattccatgtaatggaaagacaa

SEQ ID NO: 25122 - DNA, 367 bp, Homo sapiens
  AP001706.1_226141
  Located on chromosome 21
  Distance between a terminus base of telomere on chromosomal short arm and 5'-terminus of this base sequence : 27837670
  Distance between 3'-terminus of neighbour sequence of sequence listing upward to telomere on chrosomal short arm and 5'-terminus of this base sequence : 120124
acaacctcaaaggactaggaagaacatcaatgagggagaagcctgcactccttgcctccttgtctccattttatagcccctccctccctccctccctcctttcttttttctttctttctttctttcttcctttctttctttctctctctctctctctctctctctctctctctctctccttccttccttccttctttctttccttccttccttccttcctatttttgagacagagtttctcctctgtcactaaggctggagtgcagtggcatgatcacagctcactgcagccttgacctcctgggttcaagagatcctcacccctaggcctcctcagtagctgggactacagatgtatgccaccatg

SEQ ID NO: 25123 - DNA, 212 bp, Homo sapiens
  chr21.fa.O7frz.28208565
  Located on chromosome 21
  Distance between a terminus base of telomere on chromosomal short arm and 5'-terminus of this base sequence : 27928026
  Distance between 3'-terminus of neighbour sequence of sequence listing upward to telomere on chrosomal short arm and 5'-terminus of this base sequence : 89989
gtattttgctcctgtaggaaacaatatatttcaatacggaagtattcacattcatatatatatatatatatacacgtacacatataaacacgcatatatgtaaagagagacacagacagagggaagtggactcctcaaacacaatgctttaatatttatccttaagactagcattgtttttgacatgaccctatgattaatcaaatgctcga

SEQ ID NO: 25124 - DNA, 332 bp, Homo sapiens
  chr21.fa.O7frz.28337365
  Located on chromosome 21
  Distance between a terminus base of telomere on chromosomal short arm and 5'-terminus of this base sequence : 28056647
  Distance between 3'-terminus of neighbour sequence of sequence listing upward to telomere on chrosomal short arm and 5'-terminus of this base sequence : 128409
ccttgatcagtattggtacattactttctaaatacattcaacatttctaagcttgttttgaataaggctgtgcaaaaataaggtagataaaatggctgaaacttcaattaagggaatagatgtactatatatggccatagagagaaagagaagctgcttgccttaagctctacagagggctcaacaagcttacacacacacacacacacacacactcccattacactataaagaaaaataatctgcatctgatatatggtatagttgtatgataatcttggcagaaatctggacttaatgctcataagtagtaacatgctagcacttcatta

SEQ ID NO: 25125 - DNA, 286 bp, Homo sapiens
  chr21.fa.O7frz.28440362
  Located on chromosome 21
  Distance between a terminus base of telomere on chromosomal short arm and 5'-terminus of this base sequence : 28159607
  Distance between 3'-terminus of neighbour sequence of sequence listing upward to telomere on chrosomal short arm and 5'-terminus of this base sequence : 102628
aggtaatagatgtcaggcactaaaagcagtaaatcatctagaggttaagaggggaatgagaagggagtcaaaatgtagcaaagatggatgaggaggtcactttagtgttcagggagaaaaaatgctgtgaccagtgaatcacagggaagacttgagacatatattatacacatattaatcacagagaatatatatatatatagtctccctaattctaattcaaggtacatatatatatatatatatatatatatagtctccctaattgtaattcaaggtacgtatg

SEQ ID NO: 25126 - DNA, 190 bp, Homo sapiens
  G12411
  Located on chromosome 21
  Distance between a terminus base of telomere on chromosomal short arm and 5'-terminus of this base sequence : 28284058
  Distance between 3'-terminus of neighbour sequence of sequence listing upward to telomere on chrosomal short arm and 5'-terminus of this base sequence : 124165
cccactgtattattcagggctacatagagaaacagaaccaataaaatagatagatagatgatagatgatagatgatagatagatagatagatagatagatagatagatagatagacagactatatataatatatatttatctcactgtatatatgtgtgtgtatatatatgcatgtgtgtgtgtgtgtgt

SEQ ID NO: 25127 - DNA, 261 bp, Homo sapiens
  AP001708.1_126507
  Located on chromosome 21
  Distance between a terminus base of telomere on chromosomal short arm and 5'-terminus of this base sequence : 28415936
  Distance between 3'-terminus of neighbour sequence of sequence listing upward to telomere on chrosomal short arm and 5'-terminus of this base sequence : 131688
gtcacctaaacgatgtataatgaagaaagaaattagacaaataaaagaaagttggggagtctaagggtaatcctgacaactagtatctcatgaaaaaaagagacaagaaactcaaggagtttcatgaagtggaaaggtttttgtgcttcttccatatacattgtgtgtgtgtgtgtgtgtgtgtgtgtgtgtgtgtgtgttttcagatacatataaatataatacaaatggaatattcagtgtcgaattgcatgtttaaat

SEQ ID NO: 25128 - DNA, 363 bp, Homo sapiens
  chr21.fa.O7frz.28782872
  Located on chromosome 21
  Distance between a terminus base of telomere on chromosomal short arm and 5'-terminus of this base sequence : 28502134
  Distance between 3'-terminus of neighbour sequence of sequence listing upward to telomere on chrosomal short arm and 5'-terminus of this base sequence : 85937
ttaaagtgtcaatcgtcttcattcctatccatattctaaattttatttctgacatttcagtcatttcagcctgaatcatttcttgggaactggtgcagctgtttggaagtaagaaggcactcttgctttcttgagttgccagagttcttgcactgtttctcatctgtgtgggctgatgtttcttcaatccttgaagttgctgtcctttgaatgtgtgtgtgtgtgtgtgtgtgtgtgtgtgtgtgtgtgtgtgtgtgtgtgtgtgtgttgcttttaccttctttggtattcttgggggttttgtgatggtataaggtgtgttcaatcaactgactttgtttctgttagatttctgtggaatca

SEQ ID NO: 25129 - DNA, 201 bp, Homo sapiens
  chr21.fa.O7frz.28947904
  Located on chromosome 21
  Distance between a terminus base of telomere on chromosomal short arm and 5'-terminus of this base sequence : 28667240
  Distance between 3'-terminus of neighbour sequence of sequence listing upward to telomere on chrosomal short arm and 5'-terminus of this base sequence : 164743
tttctatttcaagtggaatgttaggcaaagtctcctaaggagttcatattaaccagaatcccaaaaaaagtgacagaactgtctatgagaatgtttgagaaaaggccgacggaattagaattagaatcattgtgttcgtgtgtgtgtgtgtgtgtgtgtgtgtgtagccaaggcgggtggattataaggtcaggagttcga

SEQ ID NO: 25130 - DNA, 175 bp, Homo sapiens
  D21S263
  Located on chromosome 21
  Distance between a terminus base of telomere on chromosomal short arm and 5'-terminus of this base sequence : 28799230
  Distance between 3'-terminus of neighbour sequence of sequence listing upward to telomere on chrosomal short arm and 5'-terminus of this base sequence : 131789
ttggctttggaaccagaaagaaaaaaattgacttcgaaaaaatgtcttctcacaaacttgaaatatgaaaaagtcatcagtttcacacacacacacacgcgcgcgcgcacacacacacacacacaccatgttaaatgttgtttcaggaaatacagaaagaggacccttgctgatg

SEQ ID NO: 25131 - DNA, 259 bp, Homo sapiens
  AP001709.1_187188
  Located on chromosome 21
  Distance between a terminus base of telomere on chromosomal short arm and 5'-terminus of this base sequence : 28815715
  Distance between 3'-terminus of neighbour sequence of sequence listing upward to telomere on chrosomal short arm and 5'-terminus of this base sequence : 16310
catcaggtaggatttatcctacatgaaatctaacaaaaagattccagaattaaaattggttaaacacacacacacacacacacacacacacacacacacacacaattggattaatcacctaaacatattgtactcaaatgagttcagataaaatcctctgatgacataaaccacttacattgaaagagactataagaaactgttattggcttggcagatggagggagcagatatactaagattgaactccaaaatctga

SEQ ID NO: 25132 - DNA, 216 bp, Homo sapiens
  D21S1908
  Located on chromosome 21
  Distance between a terminus base of telomere on chromosomal short arm and 5'-terminus of this base sequence : 28820368
  Distance between 3'-terminus of neighbour sequence of sequence listing upward to telomere on chrosomal short arm and 5'-terminus of this base sequence : 4394
aggcacctggaactcctcttccccagtcttttccaaaatgcctttcacagaatgatagtctcactagaagctccagataaatgggttccatagttctaatgtgtgtgtgtatatatatatatacacattagatatacacatatatagatatatacatacacacacacacacacacacacacacacacactgaatagtatgtccagccagagattca

SEQ ID NO: 25133 - DNA, 227 bp, Homo sapiens
  AP001709.1_279118
  Located on chromosome 21
  Distance between a terminus base of telomere on chromosomal short arm and 5'-terminus of this base sequence : 28907612
  Distance between 3'-terminus of neighbour sequence of sequence listing upward to telomere on chrosomal short arm and 5'-terminus of this base sequence : 87028
gactccttcagccaaataagtctgcaattatttgtggctatagcaacattatttggtgtttcagatgggaggaggaaggaataagaagaaatacatacacacacacacacacacacacacacacacacacacacacacacacacaccagaaagcaagatagttgaagataataatactcaaatattagcatgcctaagcatcatctacttcacaggtcagtaatgag

SEQ ID NO: 25134 - DNA, 153 bp, Homo sapiens
  Z66950
  Located on chromosome 21
  Distance between a terminus base of telomere on chromosomal short arm and 5'-terminus of this base sequence : 28908046
  Distance between 3'-terminus of neighbour sequence of sequence listing upward to telomere on chrosomal short arm and 5'-terminus of this base sequence : 207
tgtctgttccaacccagggatgaaacaacaaagtcaatggaaggggtgagagagtgtgtgtgtgtgtgtgtgtgtgtttgtgcaagtgtacacaagcactcagcctttgaaacagacttaatcaactaccacagaatggtggaacactgggtt

SEQ ID NO: 25135 - DNA, 119 bp, Homo sapiens
  D21S1913
  Located on chromosome 21
  Distance between a terminus base of telomere on chromosomal short arm and 5'-terminus of this base sequence : 29005570
  Distance between 3'-terminus of neighbour sequence of sequence listing upward to telomere on chrosomal short arm and 5'-terminus of this base sequence : 97371
ctcatttctaaaggtgaacgctggtatcgtgtgtgtgtgtgtgtgtgtgtgtgtgtgtgtgtgtgtgtgtgtgtaaaacaactgattgaataagtttaacaacccagcaagcacatata

SEQ ID NO: 25136 - DNA, 344 bp, Homo sapiens
  AP001710.1_56253
  Located on chromosome 21
  Distance between a terminus base of telomere on chromosomal short arm and 5'-terminus of this base sequence : 29023768
  Distance between 3'-terminus of neighbour sequence of sequence listing upward to telomere on chrosomal short arm and 5'-terminus of this base sequence : 18079
aggtaacatatttgcagatttcaggaattaggatgtggacatttgggggccattgttctacctaccaccactcccccaccacaaacacacacacacacacacacacacacacacacaaacacacaaatgactatgtggcaatgtcagacatttgtgaagctccccagtgctgatagaggatttttagaatttttcacattgctcccatcagagagataaaaacagagcaaaggaaagatgccactacccccaccttccaggggagagcgggtacatgtcttctcctctgtggccagcctctcccttgacttcttacactgcggctgcaactacaaagttcatcg

SEQ ID NO: 25137 - DNA, 284 bp, Homo sapiens
  AP001710.1_68520
  Located on chromosome 21
  Distance between a terminus base of telomere on chromosomal short arm and 5'-terminus of this base sequence : 29036031
  Distance between 3'-terminus of neighbour sequence of sequence listing upward to telomere on chrosomal short arm and 5'-terminus of this base sequence : 11919
catctgagctgacttattgaaataataacaggagaaggaaataaaaaaaagggaaaggaaaggaggaaaggccagagaggagggaggaagagagagagagagagagagagagagagagagagagagagagagagagagagagaatgaaaataagaacgataattttgggacccagcaatatgcttgagtttgcgtttgactctaaaaacattcatagtgaaacagcggcctcctctggtcacaggcaggaaattcaagaacttctgtttcttaccaaagtcaat

SEQ ID NO: 25138 - DNA, 383 bp, Homo sapiens
  AP001710.1_238612
  Located on chromosome 21
  Distance between a terminus base of telomere on chromosomal short arm and 5'-terminus of this base sequence : 29205943
  Distance between 3'-terminus of neighbour sequence of sequence listing upward to telomere on chrosomal short arm and 5'-terminus of this base sequence : 169628
caattggccacttgtagttaagttataagtcgaatgcaattagatactgtttcctttgtcacttgaatttccctgatagatccagcttgaatacacctgtgttaagatgctaactacaatgcagaattcactgaattccagggggtaaagaaatgtggacctacagaaaccctgaattagaactgtttctggcttgttaaattctaacatgtccttcctctgatttatcatcttcttcctaaccccaaaatattaagtacccctcactacacacacacacacacacacacacacacacacacacacacgtatattatctttggctctcagtattatctccttggtattctcagtatactctcctttgataatctcagtacagc

SEQ ID NO: 25139 - DNA, 279 bp, Homo sapiens
  AP001710.1_241653
  Located on chromosome 21
  Distance between a terminus base of telomere on chromosomal short arm and 5'-terminus of this base sequence : 29209189
  Distance between 3'-terminus of neighbour sequence of sequence listing upward to telomere on chrosomal short arm and 5'-terminus of this base sequence : 2863
tatctgtaaatagccactgcactccagcctgggaaacacagcaagacctgtctaaaaaaataaaataataataataataataataataatcctgaatgttcccaacctgtattagcataaatgaccagctctcaaagtatggactagggttccctaaaatacttccagggagtcagtgaggctcctccttttccaactaccctgtgcaagtccaggttctgctcatagggtccaaccaaacagtatattgcaagagagtgaatgcaaaagtaggtatga

SEQ ID NO: 25140 - DNA, 419 bp, Homo sapiens
  chr21.fa.O7frz.29585668
  Located on chromosome 21
  Distance between a terminus base of telomere on chromosomal short arm and 5'-terminus of this base sequence : 29304996
  Distance between 3'-terminus of neighbour sequence of sequence listing upward to telomere on chrosomal short arm and 5'-terminus of this base sequence : 95528
gcttatgaaggtaaccttagacttgaggtctttgttcaacatcaccttctcaatgaaggtgtcctcctggccagtggccccaccccaccacctccacccctcatccctggcacatttcctttcttacttccctgatttatttttctctcctttattatttatttatttatttatttatttatttatttatttattgagaaagagtctcgccctgttgctcaggctggagtgcagtgatgtgatctcggctcactgcaacctccacatcccaggttcaagcaatgctcttgcctccgcctcctgagtagctgggactacaggcgcgtgccaccacactgggctaatttttgtatttttagtagagacagggttttgtcatgttggccaggctggtctcaaactgctggactcaagtgatc

SEQ ID NO: 25141 - DNA, 275 bp, Homo sapiens
  D21S1888
  Located on chromosome 21
  Distance between a terminus base of telomere on chromosomal short arm and 5'-terminus of this base sequence : 29431612
  Distance between 3'-terminus of neighbour sequence of sequence listing upward to telomere on chrosomal short arm and 5'-terminus of this base sequence : 126197
agaaagacattccatcgctccagagattccaagggtttggagaactgtgtgccaggaactgggacaaagtgtgtgtgtgtgtgtgtgtgtgtgtgtgtgtgtgtatacatatatatatacacacatatatatttatatacattttttttcttaccataacaaacatcctttttttttgagtcggaatcttgctctgtcgctcaggctggagtgcagcggcgcaatctcggctcactgcaacctccatctcccaggttcaagtgattctcctgcct

SEQ ID NO: 25142 - DNA, 360 bp, Homo sapiens
  AP001711.1_135797
  Located on chromosome 21
  Distance between a terminus base of telomere on chromosomal short arm and 5'-terminus of this base sequence : 29442151
  Distance between 3'-terminus of neighbour sequence of sequence listing upward to telomere on chrosomal short arm and 5'-terminus of this base sequence : 10264
tcttatctacctatgacctggaagcccctcgcttagagttctcccaccttaccagaccaaaccaatgtacatcttacacatattgattgctgtctcatttctccctaaaatgtataaaagcaacctgtgccccgaccaccttgggcacaggtcatcaggacctcctgaggctgtgtcatgggcacactgttaatcttggcaaaataaactttctaaattgattgagacctgagatattttgggttacacacacacacacacacacacacacacacacacacacacacacacacgttaagtgaaaaaaatccatctatcatatatatactgattccaaaagaaggtacatacgtgctcagt

SEQ ID NO: 25143 - DNA, 321 bp, Homo sapiens
  AP001711.1_189577
  Located on chromosome 21
  Distance between a terminus base of telomere on chromosomal short arm and 5'-terminus of this base sequence : 29495947
  Distance between 3'-terminus of neighbour sequence of sequence listing upward to telomere on chrosomal short arm and 5'-terminus of this base sequence : 53436
gatcacgaggtcaggagttcgagaccagcctggccaacatggcgaaaccccatgtctactaaaaatacaaaaatgagccaggcatggtggcgcatgcctgtaatcccagctactcaggaggctgaggaaggagaatcgcttgaaaccaggaggtggaggttgcagtgagatgagatcgcaccattgcactccagcctgggtgacagagcaagactccatctcaaaaaaaaaagaaagaaagaaagaaagaaagaaagaaaccagagcatgcctgagaaaaatggagaagggtgggcccatgtaatcaaaggctattaacca

SEQ ID NO: 25144 - DNA, 405 bp, Homo sapiens
  AP001712.1_80715
  Located on chromosome 21
  Distance between a terminus base of telomere on chromosomal short arm and 5'-terminus of this base sequence : 29726097
  Distance between 3'-terminus of neighbour sequence of sequence listing upward to telomere on chrosomal short arm and 5'-terminus of this base sequence : 229829
cagtcagataaatggagcaaacattgaaaagtaaaacccactctcagaaaattacaatggtcatcagcgattagatcttctaagatgttctaagaatcacttgagcctaggagttagaggctgcaataagctatgattgcaccactgtactccagcttgggtgacagagtgagatcctgtttcagaaaacaaacaaaaaaacaaaacaaaagaaaaaggcatgcagaatacacacacacacacacacacacacacacacacacacacacacacacagtatatgtgcggaaaagattttggattggtgaaatattgaatattgtgctctatttgctctcccccctccttggatttctaatgtgaggggaaaaaatcttccttctcgtgatggttaatattgaatgt

SEQ ID NO: 25145 - DNA, 405 bp, Homo sapiens; identical to SEQ ID NO: 25144
  AC026776.4_7934
  Located on chromosome 21
  Distance between a terminus base of telomere on chromosomal short arm and 5'-terminus of this base sequence : 29726097
  Distance between 3'-terminus of neighbour sequence of sequence listing upward to telomere on chrosomal short arm and 5'-terminus of this base sequence : -405

SEQ ID NO: 25146 - DNA, 287 bp, Homo sapiens
  AP001712.1_204393
  Located on chromosome 21
  Distance between a terminus base of telomere on chromosomal short arm and 5'-terminus of this base sequence : 29849986
  Distance between 3'-terminus of neighbour sequence of sequence listing upward to telomere on chrosomal short arm and 5'-terminus of this base sequence : 123484
aggctagaaccaggtcttagttactgaaacacacacacacacacacacacacacacacacaaactctactgtgctcgtcatgatttttcacgaatagtgggtactttgacagactcggtagaatgcaggtctccatgtggaagctctggctacaattctgaggttttgtcatggtccaaaggtctcctcttcgagtctggctctcttaacaacagcactctactacagagccctgcgcgtgcagtgatacctgagttaatcagtactctggaagtaagcctttatcc

SEQ ID NO: 25147 - DNA, 298 bp, Homo sapiens
  D21S261
  Located on chromosome 21
  Distance between a terminus base of telomere on chromosomal short arm and 5'-terminus of this base sequence : 29873629
  Distance between 3'-terminus of neighbour sequence of sequence listing upward to telomere on chrosomal short arm and 5'-terminus of this base sequence : 23356
agatgatggtgagtcctgagggggactgggacaagccctttgctggaagagaaattgttatttcatcttcccatcctgtagaaaaataaatttgacattaatcctgcactgtgccttccagacagccattcaggttttcttaggtaaattccattgtcttccttaataattggaccttttgatttttcctaatgttgtacctatatgtgtgtgtgtgtgtgtgtttgtgtggtatatgcataaatataaatgtgtatatatatattttctgttgatgctgttttaggtaaggtgtttc

SEQ ID NO: 25148 - DNA, 381 bp, Homo sapiens
  AP001712.1_272789
  Located on chromosome 21
  Distance between a terminus base of telomere on chromosomal short arm and 5'-terminus of this base sequence : 29918106
  Distance between 3'-terminus of neighbour sequence of sequence listing upward to telomere on chrosomal short arm and 5'-terminus of this base sequence : 44179
tccacaagaggaagcgtagacagggccaccatgtgctgttatgccgtgtgccctgcaggggcacctggaggagaggtgagtggaggctgatatccaggctttgagggtctgtatcttcccaggggttgcctttttctagttcacacagagggacctttgagactagctgtggcccgagtgtgtgtgtgtgtgtgtgtgtgtgtgtgtgtgtgtgtgagagagagagagtgagtgtctatgtctgcttgggtctccatgtgcatgggtgttgtgtctgtgtgtgtgtatgtgttgtgtgtaaatttgtgtgtgtgtgtgtgtgtgtgtgtgtgtgtgtatgtctttgttttgtttttttaatacatagtctggctctgtcac

SEQ ID NO: 25149 - DNA, 442 bp, Homo sapiens
  AP001712.1_277528
  Located on chromosome 21
  Distance between a terminus base of telomere on chromosomal short arm and 5'-terminus of this base sequence : 29922924
  Distance between 3'-terminus of neighbour sequence of sequence listing upward to telomere on chrosomal short arm and 5'-terminus of this base sequence : 4437
ccaagtgttcttattgttcaattcccacctatgagtgagaagatgcggtgtttggttttctgtccttgcgatagtttgttcagaatgccatcattctttgtatcactcttaagggatttagaatgttcttttgacacagccccactaccaacacatacactcccttagagccctccccctgatttctcagtctccatagccattggatgatggtgatggtggtggtgatgatgatgatgatgatgatgatgatggatgtgtctgtttatttgggaagcagtgagcatctagacactgaacccggctgccggttcttaattctagggctgtcacttcctgcctgtgtgaccctgggcaaggtactgcattgctgtgggctttggttttgttatctgtaaagttggggtcatgatagtacctactcataggactatcaggatga

SEQ ID NO: 25150 - DNA, 265 bp, Homo sapiens
  AP001713.1_42181
  Located on chromosome 21
  Distance between a terminus base of telomere on chromosomal short arm and 5'-terminus of this base sequence : 30026759
  Distance between 3'-terminus of neighbour sequence of sequence listing upward to telomere on chrosomal short arm and 5'-terminus of this base sequence : 103393
cggaatcgatgactttctaacacacaccacaacacacacacatacacacacacacacacacacacacacacacacacacacacacggcactgcccgcagcgcctcattattcccagatagataggatcagggggagggagccggctgctctatttttcttttaattaaataattaatttggactctgccttgttctagaaattattaaaaccaggcagccaaaaatttccagtaacatcttttcttcattaccaaagcaattcac

SEQ ID NO: 25151 - DNA, 404 bp, Homo sapiens
  chr21.fa.O7frz.30391540
  Located on chromosome 21
  Distance between a terminus base of telomere on chromosomal short arm and 5'-terminus of this base sequence : 30110889
  Distance between 3'-terminus of neighbour sequence of sequence listing upward to telomere on chrosomal short arm and 5'-terminus of this base sequence : 83865
tgaccttgacagttatgaagagcactgtttgggtattttataaaatgtccctcatttgagatttgactgatgtttttctcaaatcagactagtgttatgggttttgggggtgaccatttacttaggcaacacagggctgcatttggaagcttgttttttgtttgtttgtttgtttgtttgttgtttttgagacggagtgtcactctgtcaacccaggctggagtgcagtggcgtgatctcagctcactgcaaactccgcctcccggcttcaagagattctcctgcctcagcctcccaagcagctggtattgccggtgcctgccaccacacccggctaaatttagtatttttagtagagatgggatttcaccatgttgcccaggctgatctcgaatgcctgatct

SEQ ID NO: 25152 - DNA, 383 bp, Homo sapiens
  AP001713.1_217186
  Located on chromosome 21
  Distance between a terminus base of telomere on chromosomal short arm and 5'-terminus of this base sequence : 30201687
  Distance between 3'-terminus of neighbour sequence of sequence listing upward to telomere on chrosomal short arm and 5'-terminus of this base sequence : 90394
gacactgcagtgaactaagattacaccactgcactccagtctgggcaacaaagtgagatcctgtctcaaaaaaaggaagaggaggagaagaagaagaagaagaagaagaagaagaagaagaaggaggaggaggaggaggaggaggaggaggaggaggaggaggaagagagaagaggaggaggaaaagaaagagtaaggaaagaaggaaggaaggaaagaatgaatgaaggcaggcaggcaggcagggagggaggggagaggaagagagaagaaagaaggagaagaaaagaagaagaagaaggaagaggaggaggaggaaggggagaggaggaggaaaaagaagaagacatgtatgtattagtacatttacttgatcagcattg

SEQ ID NO: 25153 - DNA, 315 bp, Homo sapiens
  AP001713.1_326103
  Located on chromosome 21
  Distance between a terminus base of telomere on chromosomal short arm and 5'-terminus of this base sequence : 30310589
  Distance between 3'-terminus of neighbour sequence of sequence listing upward to telomere on chrosomal short arm and 5'-terminus of this base sequence : 108519
aagtcaaagttgtactgcatgaccacgtgggggaccaccttctggtagaggcatatgacctggagcaaaacagctttcaaaagaatggtttctgcatcatctgcacaaaaaaaagaaaaagaaagaaaaagagaaaaaagaaagaaagaaagaaagaaagaaagaaagaaagaaagaaagaaaatagcttgaattagaaaacatactggttctttgtccttgagcagctgaaccaagtgtggcaccacactgcagccaactgcatgctgtacaccgaggctgcagacagactgctcagtacctagatctaatgag

SEQ ID NO: 25154 - DNA, 172 bp, Homo sapiens
  HUMUT7582
  Located on chromosome 21
  Distance between a terminus base of telomere on chromosomal short arm and 5'-terminus of this base sequence : 30425359
  Distance between 3'-terminus of neighbour sequence of sequence listing upward to telomere on chrosomal short arm and 5'-terminus of this base sequence : 114455
tccttggaataaattcccggaagttttataccaaaagatggcatgagtatgtttacagttcttcacagagttctttctaaaaactttatctatctatctatctatctatctatctatctatctatctatctatctatataaacaggaatgtataactgtggtttccctgcaa

SEQ ID NO: 25155 - DNA, 262 bp, Homo sapiens
  AP001714.1_145409
  Located on chromosome 21
  Distance between a terminus base of telomere on chromosomal short arm and 5'-terminus of this base sequence : 30468894
  Distance between 3'-terminus of neighbour sequence of sequence listing upward to telomere on chrosomal short arm and 5'-terminus of this base sequence : 43363
atgttcacgttaccagttgaagaaagagctgtgcccatattggcctcagtcacatggttttcttggattccacaatgggttttcgcttatctgaatttccccccattagcccccagcatgcatgcttacacacacaaacacacacacacacacacacacacacacacacacacacacacacacaccctcccaggatccctacagaggcagctggtcaacaggcttgccaactcgagggtcagtctttggcctgtgcagatac

SEQ ID NO: 25156 - DNA, 415 bp, Homo sapiens
  AP001715.1_110028
  Located on chromosome 21
  Distance between a terminus base of telomere on chromosomal short arm and 5'-terminus of this base sequence : 30772296
  Distance between 3'-terminus of neighbour sequence of sequence listing upward to telomere on chrosomal short arm and 5'-terminus of this base sequence : 303140
ttggtatcactgttattccagactctgaatatatatgctagtgataaaaatcatttttggccaggtgcggtggctcacgcctgtaatcccagcactttgggaggctgaggagggcagatcatgaggtcaggagatcaagaccatcctggctaacatggtaaaaccccatctctactaaaaatacaaaaaattagccaggcgtggtggcacgggcctataatcccagctacttgggaggttgaggcaggagaatcacttgaacccaggaggtggaggttgcagtgagccaagatcatgccactgcactccagcctgggcgacagagcgagactctgtcttaaaaataaataaataaataaataaataaataaataaaaatcattttcttacacttatttgcatgagtactgatcag

SEQ ID NO: 25157 - DNA, 399 bp, Homo sapiens
  DISO7_00049858
  Located on chromosome 21
  Distance between a terminus base of telomere on chromosomal short arm and 5'-terminus of this base sequence : 30892783
  Distance between 3'-terminus of neighbour sequence of sequence listing upward to telomere on chrosomal short arm and 5'-terminus of this base sequence : 120072
tccaggattcctgactttgggggcagaatcctgcccagtgttttcttttcttttcttttcttttcttttcttttcttttcttttaagatagggtcttgctctgttgctcaggctggagtgcagtggtgtgatcatggctcactgcagccttgaccttctaggctcaagtgattctcccacctcagcctccctagtagctgggactacagagcatgccaccatgcccggctaatttttgtattttttgtagaaacggggtttcactatgttgcccaggctggtctcaaactcctgggctcaagtgatccacctgccttggcctcccaaagtgctgggattacaagtgtgagccacagcacctggtcctgatgttttctttcttggaagacctagatacaa

SEQ ID NO: 25158 - DNA, 350 bp, Homo sapiens
  AP001716.1_30378
  Located on chromosome 21
  Distance between a terminus base of telomere on chromosomal short arm and 5'-terminus of this base sequence : 31031758
  Distance between 3'-terminus of neighbour sequence of sequence listing upward to telomere on chrosomal short arm and 5'-terminus of this base sequence : 138576
gctattgtagatcaaatgacattccatgattcacaactgaaacagtgttaaagcctttaaaacaagattcacagacactgggtcacagtccacacattacacatggcattcatagtcagcgataccaggatgacggttttaccatttctaccttgaaaccgttgtggagagaaagaaagggagagtttgcagctactctcaatagcaatttttgaaatagagatcttccttattattattattattattattattattattattattattattttgagacggagtcttgctctgtcgccaggctggagtgcagtgttgcgatctcagctcactgcaacctccatcttatg

SEQ ID NO: 25159 - DNA, 219 bp, Homo sapiens
  D21S1898
  Located on chromosome 21
  Distance between a terminus base of telomere on chromosomal short arm and 5'-terminus of this base sequence : 31186486
  Distance between 3'-terminus of neighbour sequence of sequence listing upward to telomere on chrosomal short arm and 5'-terminus of this base sequence : 154378
gctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgc

SEQ ID NO: 25160 - DNA, 343 bp, Homo sapiens
  AP001716.1_267165
  Located on chromosome 21
  Distance between a terminus base of telomere on chromosomal short arm and 5'-terminus of this base sequence : 31268576
  Distance between 3'-terminus of neighbour sequence of sequence listing upward to telomere on chrosomal short arm and 5'-terminus of this base sequence : 81871
cagcctaaccaacatggagaaaccctgtctctactaaaaatacacaattagccgggcatgctggtacatgcctgtaatcccagctactcgggaggctgaggcaggagaattgcttgaacccaggaggcaaatgttgcggtgaaccgagatggcgccattgcactccagcctgggcaacaagagcaaagcaccatctcaaataaataaataaataaataaatataaatggaaagaaagaaaagctctttcttaaattgtgtcaactaatatttgcagtgagagggtcagggttgaaaacttaccatttcatgaccatcacaggtaggatagttcaggcaaggat

SEQ ID NO: 25161 - DNA, 415 bp, Homo sapiens
  AP001716.1_315841
  Located on chromosome 21
  Distance between a terminus base of telomere on chromosomal short arm and 5'-terminus of this base sequence : 31317368
  Distance between 3'-terminus of neighbour sequence of sequence listing upward to telomere on chrosomal short arm and 5'-terminus of this base sequence : 48449
agactatgagcaagtctgtatgacaaaagggctggtttcattaacaaatcaattgcaaggaaaaagagggagagcttatctcttttcttttcttttcttttcttttcttttcttttcttttttcttttcttttctcttcttttcttttttgagacagagtttcgctctgtcgcccaggctggagtgcagtggcacaatctcagctcactgcaatctctgcctcctggattcaagcgattctcctgcctcagcctcccaagtagctgggattacaggcacccaccaccatgcccagctaatttttgtattttagtagagacggggtttcaccatgttggccaggctggtcttgaactcctgacctcaggtgattctcccacttcagcctcccaaagcgtttggattacaggcatga

SEQ ID NO: 25162 - DNA, 261 bp, Homo sapiens
  chr21.fa.O7frz.31677754
  Located on chromosome 21
  Distance between a terminus base of telomere on chromosomal short arm and 5'-terminus of this base sequence : 31397180
  Distance between 3'-terminus of neighbour sequence of sequence listing upward to telomere on chrosomal short arm and 5'-terminus of this base sequence : 79397
cagtcttccaatttcattatgttgatgcaaatcaatgtcaagtcaacgtcttgtgtatagaaatacacacacacacacacacacacacacacacacacacacatatatatatatactggaaaaatacagcctctgggtttttactcagtggcaacagcacaaggaatacaaggatcttagagcaataaaatggaatactctgataatattggtccacacacaaaaaacactcagattcaatgaccactgaatctatgtgac

SEQ ID NO: 25163 - DNA, 268 bp, Homo sapiens
  D21S1910
  Located on chromosome 21
  Distance between a terminus base of telomere on chromosomal short arm and 5'-terminus of this base sequence : 31527029
  Distance between 3'-terminus of neighbour sequence of sequence listing upward to telomere on chrosomal short arm and 5'-terminus of this base sequence : 129588
ttctctggaataaacgtggtgttttattttctgggttataaagtgaacaaatacttagatactattatttctttacccaatgcttttgatttttaagcacttttattttaaaaatgtgaattatacagtccccccctacacacacacacacacacacacacacacacacacacacacacacacacacacacacacacacacacacacacacacacacacacacacacacacacacccctataagcacattaaatactactttgccgtg

SEQ ID NO: 25164 - DNA, 264 bp, Homo sapiens
  D21S1254
  Located on chromosome 21
  Distance between a terminus base of telomere on chromosomal short arm and 5'-terminus of this base sequence : 31652622
  Distance between 3'-terminus of neighbour sequence of sequence listing upward to telomere on chrosomal short arm and 5'-terminus of this base sequence : 125325
ggtggctgagcgagactctgtctgtgtgtgtgtgtgtgtgtgtgtgtgtgtgtatacacatatatacgtatatataaattgtatatatataaagaaagaatatatatataaagaatatatatgcgtatatatataaagaaataaagttgttttaaggatggtcattctagtttataaatacatgtttattagaggccttctacttatctatatcaacattagggattttaatgtaagtgccaaaattaaggatcatcagtattt

SEQ ID NO: 25165 - DNA, 209 bp, Homo sapiens
  AP001718.1_147778
  Located on chromosome 21
  Distance between a terminus base of telomere on chromosomal short arm and 5'-terminus of this base sequence : 31827316
  Distance between 3'-terminus of neighbour sequence of sequence listing upward to telomere on chrosomal short arm and 5'-terminus of this base sequence : 174430
gtgatcttccaaggttcctattttcattctgttttcagcctctgcaaatttcttactttgtttctattttgtgtgtgtgtgtgtgtgtgtgtgtgtgtgtgtgtgccagttttcttggagttaaaaagtggatttttgcatttttctgtttttttaaagtttttgttgggtgagtcattctgagtatctagtccactctacttccagca

SEQ ID NO: 25166 - DNA, 298 bp, Homo sapiens
  D21S1445
  Located on chromosome 21
  Distance between a terminus base of telomere on chromosomal short arm and 5'-terminus of this base sequence : 31952917
  Distance between 3'-terminus of neighbour sequence of sequence listing upward to telomere on chrosomal short arm and 5'-terminus of this base sequence : 125392
ttgtgagaagcaaactgtggggtttggttgcaagagaagatcttactagggaccagttgcagggtgtattaatcaggggtttccagagaaacagaactaataggatctatctgcctgtcatctctctctctctctcctatctatctatctatctatctatcatctatctatctatcatctatctatctatctatctatctatctatctatcatctaatctatcatctatctatctattcatcatctatttatcaactatcatctctcatctatcaactatttgtttgccatctattat

SEQ ID NO: 25167 - DNA, 347 bp, Homo sapiens
  AP001718.1_319781
  Located on chromosome 21
  Distance between a terminus base of telomere on chromosomal short arm and 5'-terminus of this base sequence : 31999173
  Distance between 3'-terminus of neighbour sequence of sequence listing upward to telomere on chrosomal short arm and 5'-terminus of this base sequence : 45958
caggtgaattgcagatctaaatgtgaaaggtaaaataaaacttctagttgatagcgtagtataatatcttcctactctagtgtacataaagacttcttaaacagggctcaaaatatattaactattaaaaaaattacatttcactaaaattaagaatttttgttcattaaaagatgacagtaagagggtgaaaaggtaagcaactattcagaatacacacacacacacacacacacacacacacacacacacacacacaaaactcttacaagccagtaagaataagataacccagtagaaaaagggacaagacactgggatgggtacttcataaaacaggctatcca

SEQ ID NO: 25168 - DNA, 287 bp, Homo sapiens
  AP001719.1_124177
  Located on chromosome 21
  Distance between a terminus base of telomere on chromosomal short arm and 5'-terminus of this base sequence : 32142699
  Distance between 3'-terminus of neighbour sequence of sequence listing upward to telomere on chrosomal short arm and 5'-terminus of this base sequence : 143179
cagtgatgttaatgactcatcttatgactcttggggactttctctgccctgtaaataccacatccctcttctaccaaataaatgttattattattattattattattattattattattattattatttttgtagcccatggcccagtctaattatgacaaaaaggtttacaaagagacacactttaaagatagggacatggatgggctcaagacggtaaaggatgtgctgtattctgcaaacccaagcatagaagcatagaagactggaatggctatcttaagatc

SEQ ID NO: 25169 - DNA, 287 bp, Homo sapiens
  AP001719.1_138655
  Located on chromosome 21
  Distance between a terminus base of telomere on chromosomal short arm and 5'-terminus of this base sequence : 32157053
  Distance between 3'-terminus of neighbour sequence of sequence listing upward to telomere on chrosomal short arm and 5'-terminus of this base sequence : 14067
atcgcctgcaaatagtgatagttttacctccttctatccattttttatatttttgattttgttctctttctaattgtgttggctaatatctcaagtacaaaattaaataacaacatgatagtgagaaaatgcttgtctcattcctgacttaagggtaaaagcttttagtatttcttgattaagcatactttttgtttttgagtttaagacacacacacacacacacacacacacacacacacacacacacacgcaatatttaggggttcctatgttattgaccatgg

SEQ ID NO: 25170 - DNA, 232 bp, Homo sapiens
  Z66786
  Located on chromosome 21
  Distance between a terminus base of telomere on chromosomal short arm and 5'-terminus of this base sequence : 32206101
  Distance between 3'-terminus of neighbour sequence of sequence listing upward to telomere on chrosomal short arm and 5'-terminus of this base sequence : 48761
tgatgctgtgattccaagcagaacctctcagtagttgcatctttatcacttccattcttttaagaattctgctatatatcacacacacacacacacacacacacacacacacacagtttccaagttcctcaaatggtagaatattttaaatatttccatttaacaaatcaatgtttttaacatgaaaatccaagttgaatataattgtgccacccacaaaaatgatagggtt

SEQ ID NO: 25171 - DNA, 224 bp, Homo sapiens
  D21S1920
  Located on chromosome 21
  Distance between a terminus base of telomere on chromosomal short arm and 5'-terminus of this base sequence : 32274447
  Distance between 3'-terminus of neighbour sequence of sequence listing upward to telomere on chrosomal short arm and 5'-terminus of this base sequence : 68114
cgttccaaaagattcagagccagagagaaacaaaacgccctttgttgatgaagcatttactcatacatacatacaagtgtgtatatatatatacacatatatatgtgtgtgtgtgtgtgtgtgtgtgtgtgtgtgtgtgtgtgtgtatacatatatatatatattttttttgagacagagtctctgtcacccaggctggagtgcagtggtgcaatctcggctca

SEQ ID NO: 25172 - DNA, 316 bp, Homo sapiens
  AP001720.1_105551
  Located on chromosome 21
  Distance between a terminus base of telomere on chromosomal short arm and 5'-terminus of this base sequence : 32462960
  Distance between 3'-terminus of neighbour sequence of sequence listing upward to telomere on chrosomal short arm and 5'-terminus of this base sequence : 188289
gaccataacctaccacagacagggtctctctctctctctctctctctttttccctgttcttgcgccagctgcctgacaatttgtgggattaaagctctaagctgcttactggctcttctgactagggagagggagcaagcctcattatttttctattcttttcagtgactgctcactcctcttcctccaaaatccctatccatccatccatccatccatccatccatccatccatccatccatccaactttccatctacccatctatccttccatctatccaatccacttgcgtgttgaacgtctactatgagcca

SEQ ID NO: 25173 - DNA, 426 bp, Homo sapiens
  AP001720.1_148377
  Located on chromosome 21
  Distance between a terminus base of telomere on chromosomal short arm and 5'-terminus of this base sequence : 32505684
  Distance between 3'-terminus of neighbour sequence of sequence listing upward to telomere on chrosomal short arm and 5'-terminus of this base sequence : 42408
taaagacttgaggctaggtgaggtggtacatgtctgtaatctcagcactttgggaggctgaggcgggaggatagcttgagctcaggagtttcggaccagcctgagcaacatggtgagaaactcaatctctacaaaaaatagaaaaattagccggacatggtggtgtgcgcctctagtcccagttacttgggaggctaaagtaggagaatcgcttgagcccaggaggtcgaggctgcagtgagctgagatcgtgccactgcactccagcctgggtgacagactgagaccttgtctcaaaaaataataataataataataataataataataggtttaaaataaggtcagcactacccatgctaattctaaagggatgtggcataagatggctttcacaataaaatgtacaattcatacaagttgaaa

SEQ ID NO: 25174 - DNA, 393 bp, Homo sapiens
  AP001721.1_105116
  Located on chromosome 21
  Distance between a terminus base of telomere on chromosomal short arm and 5'-terminus of this base sequence : 32801412
  Distance between 3'-terminus of neighbour sequence of sequence listing upward to telomere on chrosomal short arm and 5'-terminus of this base sequence : 295302
caatacaaatgccatcttagaaaatctcagtggtggccaagcacagtggctcatgcctttaatcccagcactttgggaggccaaggcgggtggatcagctgaggtcaggagatggagaccatcctggctaacacagtgaaaccccatctctactaaaaatacaaaaaattagccgggcgtggtggcacacacctgtagtcccagctactcgggaggctgaggcaggaaaattgcttgaacccaggaggtggaggttgcagtgagctgagatggcgccactgcactccagcctgggcgaaagagcaagactctgtctcaaaaaacaaaacaaaacaaaacaaaacaaaacaacaaccacacacaaaaaacctcagtggtttctgtataagacag

SEQ ID NO: 25175 - DNA, 168 bp, Homo sapiens
  AP001721.1_147827
  Located on chromosome 21
  Distance between a terminus base of telomere on chromosomal short arm and 5'-terminus of this base sequence : 32844412
  Distance between 3'-terminus of neighbour sequence of sequence listing upward to telomere on chrosomal short arm and 5'-terminus of this base sequence : 42607
aaattcacatcactcttgacctacatagaaacacacacacacacacacacacacacacacacacacacacacacacacatattcatatctacatataggtccacatgcatggtaagctatgttccttttggatcatgattatttttgtggctatccttggtagagttc

SEQ ID NO: 25176 - DNA, 448 bp, Homo sapiens
  AP001721.1_224451
  Located on chromosome 21
  Distance between a terminus base of telomere on chromosomal short arm and 5'-terminus of this base sequence : 32920728
  Distance between 3'-terminus of neighbour sequence of sequence listing upward to telomere on chrosomal short arm and 5'-terminus of this base sequence : 76148
gtattaggctcctagagctatgaagaaatacagtgttagatcagttcttttttatcaaagaagattttatgaggacacacagtagctgccaatgaagactctgatcttaaaagatatagcatgtaacttaaaatttcttaacttcccttaattgatttctaaataatagattgataaggagaatcctgggaaaggccaaacattgagaattttgttaatattaattcttccttataatcactctaaagaatgataattcttttgctttatcttaagaaggtactttactatctggatcatttttatcaccttccagatacatttaaaatttttatcagccatccatccatccatccatccatccatccatccatccatccaaccaccatctatcttatccacccacccttccatcatttattatgtatggcgtacatactatgaacaa

SEQ ID NO: 25177 - DNA, 262 bp, Homo sapiens
  D21S1895
  Located on chromosome 21
  Distance between a terminus base of telomere on chromosomal short arm and 5'-terminus of this base sequence : 32928323
  Distance between 3'-terminus of neighbour sequence of sequence listing upward to telomere on chrosomal short arm and 5'-terminus of this base sequence : 7147
agttctactgataaactgtgggctgttgtattgtttaaacctctgtctgctggaaggcttctttttctgatactgaagcatgttttcctaagccacctggatgcaaagaggagattttcaggtgaccttggggtctctcccttgccagacttctcagacaaaacacacacacagatacacacacacacacacacacacacacacacacacacacacacagcatctttgtccatcctgggccaggtaggttcttatgagacag

SEQ ID NO: 25178 - DNA, 177 bp, Homo sapiens
  AP001721.1_329689
  Located on chromosome 21
  Distance between a terminus base of telomere on chromosomal short arm and 5'-terminus of this base sequence : 33026249
  Distance between 3'-terminus of neighbour sequence of sequence listing upward to telomere on chrosomal short arm and 5'-terminus of this base sequence : 97664
ttcttagagcaactgagcttctacttgttgctaaaatttcccttttagtccaatgacacacacacacacacacacacacacacacacacacacacacacacatatatagtcctttgatagtgaaaagctcttattttctaataagcacacaggctaagtgacttatccaaagttgca

SEQ ID NO: 25179 - DNA, 382 bp, Homo sapiens
  AL163267.1_52329
  Located on chromosome 21
  Distance between a terminus base of telomere on chromosomal short arm and 5'-terminus of this base sequence : 33087801
  Distance between 3'-terminus of neighbour sequence of sequence listing upward to telomere on chrosomal short arm and 5'-terminus of this base sequence : 61375
aggacaactatcacattggattagagacccaccttactccaatgtgacttcatcttaactcattacacctgcaatggccctatttccaaataaggatactttccatgaaactgggggttaggacttctatacacatacacagatgtgtgtgtgtgtgtgtgtgtgtgtgtgtgtgtataggaggacataattgagcccataaccccatccatttcccctcatgaaagataaagctaagtatgtgagctcctgcgcctcagttccttcctctgtgaaatgggaaagattatatcaccacttcccatcctgggaaaggatgagaagagatacagcctctacatgcacagcactgggcacacagtgcagaaataagagctcattg

SEQ ID NO: 25180 - DNA, 298 bp, Homo sapiens
  AL163267.1_112980
  Located on chromosome 21
  Distance between a terminus base of telomere on chromosomal short arm and 5'-terminus of this base sequence : 33148391
  Distance between 3'-terminus of neighbour sequence of sequence listing upward to telomere on chrosomal short arm and 5'-terminus of this base sequence : 60208
ataaagtgaatttctgatagccagttgcttcactgatttccattgcaaaatcaaggatgtgtttttttctttttttaggaaacaaagatttcacttacatgtaaaagatatatttaagaacatagtaaacttctaaaagcacagcttaaagaaaaagaaccacccacaacaaaacacttttttcaaaatatcaacagtcatagaacacacacacacacacacacacacacacacacacatatgtatcatacaaatgttgaattggtttacagttgtttgtacatttcagctaaagacc

SEQ ID NO: 25181 - DNA, 276 bp, Homo sapiens
  AL163267.1_119620
  Located on chromosome 21
  Distance between a terminus base of telomere on chromosomal short arm and 5'-terminus of this base sequence : 33155113
  Distance between 3'-terminus of neighbour sequence of sequence listing upward to telomere on chrosomal short arm and 5'-terminus of this base sequence : 6424
tactgtttcaggctagtggaagctaggggccttttgatttataaagagctctctgtgcctccagttacattttaggaagcaaagccgtgataaatgaagctctggctgctgatctcctggatacacacacacacacacacacacacacacacacacacacacacacacggcctacacaccttttcccctgtagcacagaggctttcaccaccaggagatttaaccctggcctagggtagccacgtgggcatccgtgttcatccgacatcctcttac

SEQ ID NO: 25182 - DNA, 388 bp, Homo sapiens
  AL163267.1_125018
  Located on chromosome 21
  Distance between a terminus base of telomere on chromosomal short arm and 5'-terminus of this base sequence : 33160303
  Distance between 3'-terminus of neighbour sequence of sequence listing upward to telomere on chrosomal short arm and 5'-terminus of this base sequence : 4914
catgttgctattcctaaaccttagcagagttcttatcccacagtaggtattccactaatacttattcagtggataaataaattacaaaactatttagggaactcaaaattactgataattctcaatctaggtggctcaattcagaagggaatagaattcaataagatagaaatagaaagtgaatatacgattcagaaatgaataggatataatctggtctgctctaaaagaatggcttttgcagaaaaaaatggctagctgacccctaacagctgttcccttctcctttcatagtaatagaagtcttaatttttagctgtgtccatagtcacaaacaaacaaacaaacaaacaaacaaacaaaaaactacacttcctaacatcgttgc

SEQ ID NO: 25183 - DNA, 198 bp, Homo sapiens
  D21S1894
  Located on chromosome 21
  Distance between a terminus base of telomere on chromosomal short arm and 5'-terminus of this base sequence : 33231882
  Distance between 3'-terminus of neighbour sequence of sequence listing upward to telomere on chrosomal short arm and 5'-terminus of this base sequence : 71191
aaagccagctacaagtcttgctgcacttaagtgtaaggtttaatcaaaatggatggtagatttcacaaaacagaaccaaccatttatcatagttactaaaacgaatatcacataatgtgtacgtgtgtgtgtgtgtgtgtgtgtgtgtgtgtgtgtgtgtgtgtaaaatttagtgcactcaatagcattgagcctcat

SEQ ID NO: 25184 - DNA, 438 bp, Homo sapiens
  AL163267.1_333883
  Located on chromosome 21
  Distance between a terminus base of telomere on chromosomal short arm and 5'-terminus of this base sequence : 33369360
  Distance between 3'-terminus of neighbour sequence of sequence listing upward to telomere on chrosomal short arm and 5'-terminus of this base sequence : 137280
aacgccatggtatctgtattagtcaggactttccagagacagaaccagtaagaatggatggatagagatttgatacacagaggattgactgataggtagacagatgacagatagatggtagatagacagacagacagatagatagatagatagatagatagatagatagatagatagatagacagacagatagacagacagatagataatgtgatttattttaaggtatttgctcaggggattgtagagcctggcaagtcctgattctacaagcaggttggcaagctgggtcccaaggaagagctgatgctgtagctctggtctgagggcagtctggaagtagattttcttcttcctctggggatctcaatcttcttctcttaaggccttcagctgattggatgaggcccacccatgttatggcaggtaatacacttt

SEQ ID NO: 25185 - DNA, 221 bp, Homo sapiens
  AL163268.1_274750
  Located on chromosome 21
  Distance between a terminus base of telomere on chromosomal short arm and 5'-terminus of this base sequence : 33649170
  Distance between 3'-terminus of neighbour sequence of sequence listing upward to telomere on chrosomal short arm and 5'-terminus of this base sequence : 279372
agaagcatgttccaggattaccaaaaagagggattttcaagggaatgaggccagggttagcgtgtttccagggtcccagaataggcccagctcccacccagatgcccatgaggtaggagacattaaattaaacacacacacacacacacacacacacacacacacacaccccactgggtgtagaaggacccaaaaagaagaaaggtttatgttccaattct

SEQ ID NO: 25186 - DNA, 212 bp, Homo sapiens
  AL163268.1_319799
  Located on chromosome 21
  Distance between a terminus base of telomere on chromosomal short arm and 5'-terminus of this base sequence : 33694285
  Distance between 3'-terminus of neighbour sequence of sequence listing upward to telomere on chrosomal short arm and 5'-terminus of this base sequence : 44894
actcaaacagctgctttatcatccaaaatcgttttgacatcttaaattttgattgctttacctaaacacacacacacacacacacacacacacacacacacacacacacacacacaaaaccctccactgttatgcatcttattttttacacattgcacttttaagtttttatctggtgacattttctcaccttctagcatcacctgcaaggt

SEQ ID NO: 25187 - DNA, 194 bp, Homo sapiens
  Z67492
  Located on chromosome 21
  Distance between a terminus base of telomere on chromosomal short arm and 5'-terminus of this base sequence : 33770154
  Distance between 3'-terminus of neighbour sequence of sequence listing upward to telomere on chrosomal short arm and 5'-terminus of this base sequence : 75657
cttctgtaatggagtgagccaattcctgacaataggtctgtgtgtgtgtgtgtgtgtgtgtgtgtgtacacatgtatatgtaaagggtttgttttattggttctgtttctctggagaaccctaatagggtgctcctggagtaatttctattcaataccaaatgtatcagatcatcagcacgggcaacttgtttt

SEQ ID NO: 25188 - DNA, 390 bp, Homo sapiens
  AP001724.1_79661
  Located on chromosome 21
  Distance between a terminus base of telomere on chromosomal short arm and 5'-terminus of this base sequence : 33793103
  Distance between 3'-terminus of neighbour sequence of sequence listing upward to telomere on chrosomal short arm and 5'-terminus of this base sequence : 22755
aaggatcgttctaagcttcaagatccaaaagatagattgatggagagagagagagagagagagatgaatggatggataaagacagatcagatagatagatagatagatagatagatagatagatagatccatccatcttctagagaactctgactaaaaccaatacttgtgagaatcctgtataaaatgtagctagtgatcttggacaaccctctaaagtaagaaggtcatgagccttctctgcaaacaggttttgacagtgagaagggaaagaaaatagtgacacctggactcctgggaaggaaaagaaaattcgtttttagcaatgaggttgctaaaagaagcaactagaaaacaagctactccaacttcagatctttgcttggtaaa

SEQ ID NO: 25189 - DNA, 265 bp, Homo sapiens
  chr21.fa.O7frz.34199007
  Located on chromosome 21
  Distance between a terminus base of telomere on chromosomal short arm and 5'-terminus of this base sequence : 33917920
  Distance between 3'-terminus of neighbour sequence of sequence listing upward to telomere on chrosomal short arm and 5'-terminus of this base sequence : 124427
cttaattagctagacaaattgcacaaattctgcaattctatttttactttaactatggccaaagctccttttcagtttctcatagctttctacccttcagctgctagacgtccccagttataaggcaactcgaagtgtgtgcaagggacagaagtttgtatatctgaaactacaatttggtaaaacacaagacaaaggggggaggagagagggagagagagagagagagagagagaggaataagagtcctatttgcacttaccat

SEQ ID NO: 25190 - DNA, 467 bp, Homo sapiens
  chr21.fa.O7frz.34304519
  Located on chromosome 21
  Distance between a terminus base of telomere on chromosomal short arm and 5'-terminus of this base sequence : 34023496
  Distance between 3'-terminus of neighbour sequence of sequence listing upward to telomere on chrosomal short arm and 5'-terminus of this base sequence : 105311
accagtgagaattaaggcttacagaaacaaaaagcgatcacccgtgaaaagaaggagaggccccttattttatttttatctatttattttttaattctccaaactgcttcggaagagtcccttattttatttatttatttatttatttgtttgtttgtttgtttgtttattgagacagagtctcaatcttggttcagtgcaacctctgcctcctgggttcaagtgattctcctgcctcagcctcctgagtagctgggattacaggcgcccgccaccatgcatggctaacttttgtatttttagtagagacagggtttcgccatgttggccaagctgatctcgaacttctggcctcaagtgatccacccgcctcggcctcccaaagtactgggattacagacatgagccactgcacccagcctagtcccttaggttaaaagtgaggtttactttgacaagtttcacct

SEQ ID NO: 25191 - DNA, 155 bp, Homo sapiens
  chr21.fa.O7frz.34431997
  Located on chromosome 21
  Distance between a terminus base of telomere on chromosomal short arm and 5'-terminus of this base sequence : 34151040
  Distance between 3'-terminus of neighbour sequence of sequence listing upward to telomere on chrosomal short arm and 5'-terminus of this base sequence : 127077
gtgaagcagaatatcttgacaggtttcagtagcaccttggagaaatctatagcactcatatgcacaaaagttcatgtagctttgtgtgtgtgtgtgtgtgtggtcactgcttaggaatgggagaaagtgtgaatctgttccgactattgagtatg

SEQ ID NO: 25192 - DNA, 170 bp, Homo sapiens
  AP001726.1_12371
  Located on chromosome 21
  Distance between a terminus base of telomere on chromosomal short arm and 5'-terminus of this base sequence : 34403552
  Distance between 3'-terminus of neighbour sequence of sequence listing upward to telomere on chrosomal short arm and 5'-terminus of this base sequence : 252357
aagcttcaatatttctgtttgtctctctctgtctttgtctcactatctgtctgtctctcatacacacacacacacacacacacacacacacacacctgtgtctcaggcaagaaaggggtcctcaccctaggagatgtaagatggcttttctttaaatcgtggaagtctta

SEQ ID NO: 25193 - DNA, 237 bp, Homo sapiens
  D21S1252
  Located on chromosome 21
  Distance between a terminus base of telomere on chromosomal short arm and 5'-terminus of this base sequence : 34403579
  Distance between 3'-terminus of neighbour sequence of sequence listing upward to telomere on chrosomal short arm and 5'-terminus of this base sequence : -143
tctgtctttgtctcactatctgtctgtctctcatacacacacacacacacacacacacacacacacacctgtgtctcaggcaagaaaggggtcctcaccctaggagatgtaagatggcttttctttaaatcgtggaagtcttagttaattctttttaaactaattcatcactggctctggggcttctctgctttctcctccttcctgccacagtgaccttaagccacagagcattgc

SEQ ID NO: 25194 - DNA, 184 bp, Homo sapiens
  Z66764
  Located on chromosome 21
  Distance between a terminus base of telomere on chromosomal short arm and 5'-terminus of this base sequence : 34463541
  Distance between 3'-terminus of neighbour sequence of sequence listing upward to telomere on chrosomal short arm and 5'-terminus of this base sequence : 59725
agctgtgcacccgaagagagaaggggaaataaagtcttatcgtgagagaaagtgtgtgtgtgtgtgtgtgtgtgtgtgtgtgtgtgtgtgtagagagacaggagggagagaagaggaggacatgggaagagaggagaggagaagggggagaaggggagaatgagtcctcatttaacctggtcct

SEQ ID NO: 25195 - DNA, 188 bp, Homo sapiens
  AP001726.1_75803
  Located on chromosome 21
  Distance between a terminus base of telomere on chromosomal short arm and 5'-terminus of this base sequence : 34466981
  Distance between 3'-terminus of neighbour sequence of sequence listing upward to telomere on chrosomal short arm and 5'-terminus of this base sequence : 3256
ctcactatggctccacaattacatgtcaattccgtaaaataaatctctctccacttacatacgtacacacacacacacacacacacacacacacacacgacctgttggttttgttactggggagaactctgactaatataattatcccaaagtttcagtttctggtctgaaagtgatcttcagtccac

SEQ ID NO: 25196 - DNA, 126 bp, Homo sapiens
  DISO7_10004974
  Located on chromosome 21
  Distance between a terminus base of telomere on chromosomal short arm and 5'-terminus of this base sequence : 34561351
  Distance between 3'-terminus of neighbour sequence of sequence listing upward to telomere on chrosomal short arm and 5'-terminus of this base sequence : 94182
gtctgtggcacagtgtggggcgggggagggggtcctctgctctgatccaccccaacacccgaatggtcttagtattttatattatattatattatattatattatttcattcaacattgaggcaca

SEQ ID NO: 25197 - DNA, 177 bp, Homo sapiens
  D21S267
  Located on chromosome 21
  Distance between a terminus base of telomere on chromosomal short arm and 5'-terminus of this base sequence : 35043999
  Distance between 3'-terminus of neighbour sequence of sequence listing upward to telomere on chrosomal short arm and 5'-terminus of this base sequence : 482522
cctccaacctgggtgacagaccctgtctctaaaaatatgtgtgtgtgtgtgtgtgtgtgtgtgtatagtgggtgtgtatatatatatgtaacaaaatattgggtattgtaatctcattttctacataaataatcccctatgttatttctgatatcgaagatagaaatccagatccat

SEQ ID NO: 25198 - DNA, 249 bp, Homo sapiens
  D21S1900
  Located on chromosome 21
  Distance between a terminus base of telomere on chromosomal short arm and 5'-terminus of this base sequence : 35050118
  Distance between 3'-terminus of neighbour sequence of sequence listing upward to telomere on chrosomal short arm and 5'-terminus of this base sequence : 5942
tcccaactgtgattggtagcagacagatagactttaactaactcttctcttgttgctttttttcccccctaaatttctggaagactagagatataaagcactgtatgtttctgtgagaatttcacaaattcttgtgtgtgtgtgtgtgtgtgtgtgtgtgtgtgtgttggtttggtgaattattcctcactctgccctctggtgtgtgctctttatttttacttagagccactgaatttgcttttgaag

SEQ ID NO: 25199 - DNA, 226 bp, Homo sapiens
  AP001728.1_72315
  Located on chromosome 21
  Distance between a terminus base of telomere on chromosomal short arm and 5'-terminus of this base sequence : 35141239
  Distance between 3'-terminus of neighbour sequence of sequence listing upward to telomere on chrosomal short arm and 5'-terminus of this base sequence : 90872
ttattggtgctactgattaaccttttaagctttataacattcttatataaaatagatcagtctttctacatctgtatgagggatggactgagatgaatacaccattgctacatttctatcactctcatgttccttggcctgtcttctatctttgtgtgtgtgtgtgtgtgtgtgtgtgtgtgtgttgtatatgtattcctgactttgaacaaataatccaggagta

SEQ ID NO: 25200 - DNA, 147 bp, Homo sapiens
  D21S1919
  Located on chromosome 21
  Distance between a terminus base of telomere on chromosomal short arm and 5'-terminus of this base sequence : 35141327
  Distance between 3'-terminus of neighbour sequence of sequence listing upward to telomere on chrosomal short arm and 5'-terminus of this base sequence : -138
tgagatgaatacaccattgctacatttctatcactctcatgttccttggcctgtcttctatctttgtgtgtgtgtgtgtgtgtgtgtgtgtgtgtgttgtatatgtattcctgactttgaacaaataatccaggagtagcagttgcc

SEQ ID NO: 25201 - DNA, 469 bp, Homo sapiens
  chr21.fa.O7frz.35551933
  Located on chromosome 21
  Distance between a terminus base of telomere on chromosomal short arm and 5'-terminus of this base sequence : 35270690
  Distance between 3'-terminus of neighbour sequence of sequence listing upward to telomere on chrosomal short arm and 5'-terminus of this base sequence : 129216
ttattggcaaactaagaatagaaggacaaaattataaaactttattaagaaacatttaagagatcctaagtttatggaaagatacattgtgttcatgagttggaagattcaattttaagaagttgtcatttccttctgaatgggtttatgcactcaatgcgatgtcaaattcctaacggtgtgtatatttggggtgtgcgtgtgtgtgtgtgtgtgtgtgtgtgtgtgaatttgacaagctaattctaaaatgttaatgaaactataaagggataatagtagagggatttagttttgttcatttagtggtggtcacatagctccaaaagcagaaagagagggcaagccccattgccctgagcagtgcgagtctctgcttgtatcacatttgctatagttcaactgaacaaagcaagaccaagccacgggtttatgtggaggaggcaactcaaagatcttcatacatgga

SEQ ID NO: 25202 - DNA, 205 bp, Homo sapiens
  D21S270
  Located on chromosome 21
  Distance between a terminus base of telomere on chromosomal short arm and 5'-terminus of this base sequence : 35407119
  Distance between 3'-terminus of neighbour sequence of sequence listing upward to telomere on chrosomal short arm and 5'-terminus of this base sequence : 135960
acaaagttatggtcaagggggcggtaggggagggcatctgggtaatttactgtgtgtgtgtgtgtgtgtgtgtgtgtgtgtgtgtgtgtacatatacatatgtattatattttaaaaattttacataactagtatttcactatctttttgattttgaaaaaaatgaactaagttgaactttaaccaccatttattaaaacatttc

SEQ ID NO: 25203 - DNA, 172 bp, Homo sapiens
  AP001729.1_35980
  Located on chromosome 21
  Distance between a terminus base of telomere on chromosomal short arm and 5'-terminus of this base sequence : 35443951
  Distance between 3'-terminus of neighbour sequence of sequence listing upward to telomere on chrosomal short arm and 5'-terminus of this base sequence : 36627
tctaccactgaatatggttcctagcatataataggcacactcatttaaagtacttaaaaaagtactttattaggtccatactttattaagcctctgggattttgtgtgtgtgtgtgtgtgtgtgtgtgtgtgtgtgtgtgtgtgtgtgtgtggttatttaacatgctctgaa

SEQ ID NO: 25204 - DNA, 258 bp, Homo sapiens
  AP001729.1_196007
  Located on chromosome 21
  Distance between a terminus base of telomere on chromosomal short arm and 5'-terminus of this base sequence : 35604037
  Distance between 3'-terminus of neighbour sequence of sequence listing upward to telomere on chrosomal short arm and 5'-terminus of this base sequence : 159914
ctgccatggtcttagaatacactgccttcacactctagacatttgtgtgtgtgtgtgtgtgtgtgtgtgtgtgtgtgtgtgtgtgtgtgagagagagagagagagagagagagagagagagagagagagagagagagagagagagagagtgtaaccatgaagaggtaattgatacctagggcctctgagctcctccaccaacaccctccccagaagtggccagattacttttggagtaattgtatcataggcaaatca

SEQ ID NO: 25205 - DNA, 162 bp, Homo sapiens
  D21S1440
  Located on chromosome 21
  Distance between a terminus base of telomere on chromosomal short arm and 5'-terminus of this base sequence : 35718225
  Distance between 3'-terminus of neighbour sequence of sequence listing upward to telomere on chrosomal short arm and 5'-terminus of this base sequence : 113930
ccccaccccttttagttttatacaacttcagactttcttagttgtgaaagacttaagtaagacctgatctggtcctgtagccttcaattttattattattattattattattattattattactatatttttttagtagcagaacactttattttcaaactc

SEQ ID NO: 25206 - DNA, 237 bp, Homo sapiens
  AP001730.1_48181
  Located on chromosome 21
  Distance between a terminus base of telomere on chromosomal short arm and 5'-terminus of this base sequence : 35795129
  Distance between 3'-terminus of neighbour sequence of sequence listing upward to telomere on chrosomal short arm and 5'-terminus of this base sequence : 76742
atggctttctactgagtccatgccagctacatacttctctttgagtgtctaaaatgacagaggtgtttttaatgagggcaattataacagtctgactttagctcagagctaaggctgagacactctgtgtgtgtgtgtgtgtgtgtgtgtgtgtgtgtgtgtgtgtgtgtgtgtgtgagggagagaggaggatggggaagaggagattgattcatgaatgcagagtatctagaaagg

SEQ ID NO: 25207 - DNA, 246 bp, Homo sapiens
  AP001730.1_61315
  Located on chromosome 21
  Distance between a terminus base of telomere on chromosomal short arm and 5'-terminus of this base sequence : 35808288
  Distance between 3'-terminus of neighbour sequence of sequence listing upward to telomere on chrosomal short arm and 5'-terminus of this base sequence : 12922
gaaactcataacagtggttgtctctgggataggaaactgaactggagtctaggaagggtttttcattgtccacaattttaactatgggcttatattactttatatatatatatatatatatatatatatatatatatatatataaaatacttaaaaagctctacagatgattctagccagcactgggtgttgagcagccccagtttttcattccagggcttctgacaagctaatggtagttgtact

SEQ ID NO: 25208 - DNA, 234 bp, Homo sapiens
  D21S1425
  Located on chromosome 21
  Distance between a terminus base of telomere on chromosomal short arm and 5'-terminus of this base sequence : 35828593
  Distance between 3'-terminus of neighbour sequence of sequence listing upward to telomere on chrosomal short arm and 5'-terminus of this base sequence : 20059
ctcaatgtctgccttgaaatgaagtgtgtgtgtgtgtgtgtgtgtgtgtgtgtgtgtgtgtgtgtgacagagagagagagagacagagagagagacatgcatgtcggattgggaggagagatggttccaggttggataaaaatattttccaaaaagaatcttggatttgaaggtggcctgttattttctatagggtccaaaacggaagtaaaaaaaccctttgactcacctata

SEQ ID NO: 25209 - DNA, 221 bp, Homo sapiens
  D21S1917
  Located on chromosome 21
  Distance between a terminus base of telomere on chromosomal short arm and 5'-terminus of this base sequence : 35919023
  Distance between 3'-terminus of neighbour sequence of sequence listing upward to telomere on chrosomal short arm and 5'-terminus of this base sequence : 90196
gctgggttttggagttcaagaggttaacaggactgagtttaggtaaatttgtcctctccattttgcttgaaatattgtgttgtgtgtgtgtgtgtgtgtgtgtgtgtgtgtgtgtgtggtgtgtgtgtgtgtgaatgttagaaaaataaatgtaaagttaccagtgttaatgttcataataaaagttaataactgtgaggctttaatggtccaggctcact

SEQ ID NO: 25210 - DNA, 198 bp, Homo sapiens
  AP001730.1_172030
  Located on chromosome 21
  Distance between a terminus base of telomere on chromosomal short arm and 5'-terminus of this base sequence : 35919038
  Distance between 3'-terminus of neighbour sequence of sequence listing upward to telomere on chrosomal short arm and 5'-terminus of this base sequence : -206
tcaagaggttaacaggactgagtttaggtaaatttgtcctctccattttgcttgaaatattgtgttgtgtgtgtgtgtgtgtgtgtgtgtgtgtgtgtgtgtggtgtgtgtgtgtgtgaatgttagaaaaataaatgtaaagttaccagtgttaatgttcataataaaagttaataactgtgaggctttaatggtcca

SEQ ID NO: 25211 - DNA, 242 bp, Homo sapiens
  D21S1444
  Located on chromosome 21
  Distance between a terminus base of telomere on chromosomal short arm and 5'-terminus of this base sequence : 35936236
  Distance between 3'-terminus of neighbour sequence of sequence listing upward to telomere on chrosomal short arm and 5'-terminus of this base sequence : 17000
caacacccttatcaacctgcctggcactattgtgatggctgccacatgaaaacatagcttagagcttcctttgccatctatctatgtatctgtctatgtatgtatgtatgtatgtatgtatgcatgcatgcgtgtgtgtgtgtatgtatgtatgtatgtatgtatgtatctatctatctatctatctatctatctatctatctatctatctgtcatctccttactcatttaacagaatcatt

SEQ ID NO: 25212 - DNA, 208 bp, Homo sapiens
  AP001730.1_223890
  Located on chromosome 21
  Distance between a terminus base of telomere on chromosomal short arm and 5'-terminus of this base sequence : 35970943
  Distance between 3'-terminus of neighbour sequence of sequence listing upward to telomere on chrosomal short arm and 5'-terminus of this base sequence : 34465
aaccattaggatggctatgaacacacacacacacacacacacacacacacacactagcaagtgttggtatagatatggagaaattgaaatgcttgtgcagtgttggtggaaatgttaaatggtgcagctgctatggaaaatgtatgaggtttcccctaaaaattaaaaataaaattaccatataatctagcaattccacttctggata

SEQ ID NO: 25213 - DNA, 119 bp, Homo sapiens
  D21S259
  Located on chromosome 21
  Distance between a terminus base of telomere on chromosomal short arm and 5'-terminus of this base sequence : 36025729
  Distance between 3'-terminus of neighbour sequence of sequence listing upward to telomere on chrosomal short arm and 5'-terminus of this base sequence : 54578
agaatgtggtctcacaagcctacacacacacacacacacacacacacacacacactcacacacacgaccatgcatggcggttgtgagatagtaacgcaatggattttcattgacattcc

SEQ ID NO: 25214 - DNA, 230 bp, Homo sapiens
  D21S1883
  Located on chromosome 21
  Distance between a terminus base of telomere on chromosomal short arm and 5'-terminus of this base sequence : 36075266
  Distance between 3'-terminus of neighbour sequence of sequence listing upward to telomere on chrosomal short arm and 5'-terminus of this base sequence : 49418
gctctggaatggttaaggcagaaattttaaaaaatgaaaatttaaaaaatatatatgtgtacaatatcatacacacatatatacaaaataatacacatatatattgtgtttgtgtgtacacacacacacacacacacacacacgtgacaacttcatgctagggagaatggtgattctagacatcctgaactccagaatgatggtgaaataggtaatgcaagtcacctccc

SEQ ID NO: 25215 - DNA, 142 bp, Homo sapiens
  Z67797
  Located on chromosome 21
  Distance between a terminus base of telomere on chromosomal short arm and 5'-terminus of this base sequence : 36097747
  Distance between 3'-terminus of neighbour sequence of sequence listing upward to telomere on chrosomal short arm and 5'-terminus of this base sequence : 22251
agcctgctggtccacactgggacttggacttgccagcctcaataatcatatgagccaattctttataataaatttatttaaatacacacacacacgcacacacacacacacacacacacatgcgcatttgatttctctggag

SEQ ID NO: 25216 - DNA, 440 bp, Homo sapiens
  chr21.fa.O7frz.36506581
  Located on chromosome 21
  Distance between a terminus base of telomere on chromosomal short arm and 5'-terminus of this base sequence : 36225386
  Distance between 3'-terminus of neighbour sequence of sequence listing upward to telomere on chrosomal short arm and 5'-terminus of this base sequence : 127497
cagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaa

SEQ ID NO: 25217 - DNA, 338 bp, Homo sapiens
  DISO7_00004531
  Located on chromosome 21
  Distance between a terminus base of telomere on chromosomal short arm and 5'-terminus of this base sequence : 36303031
  Distance between 3'-terminus of neighbour sequence of sequence listing upward to telomere on chrosomal short arm and 5'-terminus of this base sequence : 77205
caagggccatctgtagatctgctgctccaaagtctctcacagtggctcttctttggaggtcactctccagttaagtgggggaccaactgcaaacttctcccatcaatatgaactgcaatatgatattgcagcaaacaaaacacacacacacacacacactctcccagaagcatttaacaggagaagtgtgtacctacacatttagtcccaagatctctttccaggccctgtccaggttcgtggtggaagcctgtcctctgcacactggcttccccaaatcttcccatattccagagcaggggaatcctttctccatcttttggctcagatctactgcg

SEQ ID NO: 25218 - DNA, 217 bp, Homo sapiens
  G08076
  Located on chromosome 21
  Distance between a terminus base of telomere on chromosomal short arm and 5'-terminus of this base sequence : 36466659
  Distance between 3'-terminus of neighbour sequence of sequence listing upward to telomere on chrosomal short arm and 5'-terminus of this base sequence : 163290
tacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctc

SEQ ID NO: 25219 - DNA, 393 bp, Homo sapiens
  chr21.fa.O7frz.36867300
  Located on chromosome 21
  Distance between a terminus base of telomere on chromosomal short arm and 5'-terminus of this base sequence : 36586093
  Distance between 3'-terminus of neighbour sequence of sequence listing upward to telomere on chrosomal short arm and 5'-terminus of this base sequence : 119217
actgtctacaggatcctaagaaagagcaactaaaattatgttaatgttattaattataattttaatcatcaatactgttaataataatagaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaag

SEQ ID NO: 25220 - DNA, 442 bp, Homo sapiens
  AP001732.1_248093
  Located on chromosome 21
  Distance between a terminus base of telomere on chromosomal short arm and 5'-terminus of this base sequence : 36673040
  Distance between 3'-terminus of neighbour sequence of sequence listing upward to telomere on chrosomal short arm and 5'-terminus of this base sequence : 86554
ccagaactctgaatagttcgatagatggatagatagatagatagatagatagatagatagatagatagatagacagacagacagacagacagacagacagctagctagctatgggggatggagaaggattgattttaaggaattggatcatataattgtagaagttggcaagtccaaaatctgagttctccagaactctgaagagttcagatagatagatagatagatagatagatagatagacagatagatagatagatgatagagagagagagagatgatagatatggagggatggagaaggattgattttaaggaattttaaggaattggatcatataattgtggaagctggcaagtccaaaatctgtagggaaggtcagcaggcttgtgacccagggaagagtcagtgttgcagctctagtccaaaggcaatttacag

SEQ ID NO: 25221 - DNA, 307 bp, Homo sapiens
  AL163278.1_22085
  Located on chromosome 21
  Distance between a terminus base of telomere on chromosomal short arm and 5'-terminus of this base sequence : 36786201
  Distance between 3'-terminus of neighbour sequence of sequence listing upward to telomere on chrosomal short arm and 5'-terminus of this base sequence : 112719
atttccattgatggcaaacccattctctgttacacacatacacacacacacacacacacacacacacacacacacacaaaacacccgaatgttgagagaagggactttcagttgttatgtcagtacctgaagaaaatgtagaattaagagagatacaaagtgtttttttaatatttacataaataaaggaaaaactttgtatgtacacaatttgtacacacagaaaagacaactaaattatctatacactaaaggagagttgcctgatgaatcagacaagatttcaacaagaaacagttcattccaa

SEQ ID NO: 25222 - DNA, 410 bp, Homo sapiens
  AL163278.1_51983
  Located on chromosome 21
  Distance between a terminus base of telomere on chromosomal short arm and 5'-terminus of this base sequence : 36815803
  Distance between 3'-terminus of neighbour sequence of sequence listing upward to telomere on chrosomal short arm and 5'-terminus of this base sequence : 29295
gcaatgaatttgtggatatgaccctaaaagcacaagcaacaaaagtaaaaatgcagccgggcacggtggctcacgcctgtaatcccagcactttgggaggccgaggcgggaggatcacgaggtcaggagctcaagaccagcctgacctacatggtgaaactccatctctactaaaaatacaaaaattagctgggcatgctggtgggcacctgtaatcccagctactcaggaggctgaagcaggagaatccttgaacccggaagtgggagtttgcagtgagccaagatcgcgccactgcactccagcctgggtgacagagcaagacaccatctcaaaataaataaataaataaataaataaataaataaataaataaataaataaataaattcgcacaaatagaattcaat

SEQ ID NO: 25223 - DNA, 184 bp, Homo sapiens
  AL163278.1_88514
  Located on chromosome 21
  Distance between a terminus base of telomere on chromosomal short arm and 5'-terminus of this base sequence : 36852640
  Distance between 3'-terminus of neighbour sequence of sequence listing upward to telomere on chrosomal short arm and 5'-terminus of this base sequence : 36427
gctcggtaatttccagttaaagctcagctgtgtgtgtgtgtgtgtgtgtgtgtgtgtgtgtgtttatgtctactccactcatcacaaatacctttaataagcaaatttacctcctccatttgctgaattttatgtcttctctattccttgatgagaattgaatgggatcattccatggctttga

SEQ ID NO: 25224 - DNA, 106 bp, Homo sapiens
  D21S1891
  Located on chromosome 21
  Distance between a terminus base of telomere on chromosomal short arm and 5'-terminus of this base sequence : 36998024
  Distance between 3'-terminus of neighbour sequence of sequence listing upward to telomere on chrosomal short arm and 5'-terminus of this base sequence : 145200
gtgacagagcgagactccatctcaaatatatatatatatatacacacacacacacacacacacacacacacacattctcactagcaacatccaagggttccaattt

SEQ ID NO: 25225 - DNA, 294 bp, Homo sapiens
  AL163278.1_286559
  Located on chromosome 21
  Distance between a terminus base of telomere on chromosomal short arm and 5'-terminus of this base sequence : 37050562
  Distance between 3'-terminus of neighbour sequence of sequence listing upward to telomere on chrosomal short arm and 5'-terminus of this base sequence : 52432
aactgtccagtgccttcagatatttttaatattttcttcttttctagctattctcaggaaaaggattggcttttattgtatgtgtgcagaaaaaattgctcgcaaaaattacccaaattctccacccctccatctacacacacacacacacacacacacacacacacacacacacattatttattgctggggctcagaggacaataccccaaagtatcgtgctttgatatgctgagcacatcttaattaaaggaaattggaaagcctcaaaagctaccgcagaaccatagactt

SEQ ID NO: 25226 - DNA, 230 bp, Homo sapiens
  D21S268
  Located on chromosome 21
  Distance between a terminus base of telomere on chromosomal short arm and 5'-terminus of this base sequence : 37155850
  Distance between 3'-terminus of neighbour sequence of sequence listing upward to telomere on chrosomal short arm and 5'-terminus of this base sequence : 104994
gggaggctgaagcaggcaaattgctcaggagttggaggttgcagtgagccaagatctcaccactgctctccagcctgggcaacagagtgagacaggctcaaaaaaaaaaaagaaaaaaaagaaaacacacacacacacacacacacacacacacacaaacaaaactccaaaaacaacaagtgttggcaaggatgtgaacaaactgtggcttttatacactgccagcggga

SEQ ID NO: 25227 - DNA, 430 bp, Homo sapiens
  HUMUT6930B
  Located on chromosome 21
  Distance between a terminus base of telomere on chromosomal short arm and 5'-terminus of this base sequence : 37324167
  Distance between 3'-terminus of neighbour sequence of sequence listing upward to telomere on chrosomal short arm and 5'-terminus of this base sequence : 168087
gggaaggctatggaggagagccagactcctgctctttgttttggtcagttcagaagtcacttaaccaataagtcctttcagggaaggaattcactctaccactacagaatagttttgcttcacatgttttcttgacacagaaatttgtagaaccacagcctctttcttttcttttctttttctttttctctttctttctctctttctttcctttcctttccctttctttctttctttctttctttctttctttctttctttctttctttctttctttctttctttctttctgtctctctctctctctttctttctttctttctttctttttctctttctctttctctctttctttctttcttgacagagtttcactcttgtcacccaggctggagtgcaatggtgcgatctcaactcactgcaacctccg

SEQ ID NO: 25228 - DNA, 439 bp, Homo sapiens
  AL163279.1_257390
  Located on chromosome 21
  Distance between a terminus base of telomere on chromosomal short arm and 5'-terminus of this base sequence : 37360278
  Distance between 3'-terminus of neighbour sequence of sequence listing upward to telomere on chrosomal short arm and 5'-terminus of this base sequence : 35681
tcttccaagctcaaactatgactttcgttaatgtggcagactgtattttcctagaattcccacgacaagatttctagtcctatatgctcttcaacaacctcgtgactcgctaccaaaaggtggagttcactgcttgaactgcctaggactgccctgacaaatgctgtgaggcagaagtgatgctgcgtgactgccaaggctaggtcataaaaggcagtactgcatctgtctggttctctccctctctctctctctctctctctctctctctgtgtgtgtgtgtgtgtgtgtgtgtgtgtgtgtgtgtctgtgcatattttactttgtgattgtctatgtttggtttcattaatctacaaaaaagaaaaacccctttttatcttccagaaattctttgttagatctggtagttttggtattcctttctggtattctggat

SEQ ID NO: 25229 - DNA, 241 bp, Homo sapiens
  AF121897.1_1368
  Located on chromosome 21
  Distance between a terminus base of telomere on chromosomal short arm and 5'-terminus of this base sequence : 37439901
  Distance between 3'-terminus of neighbour sequence of sequence listing upward to telomere on chrosomal short arm and 5'-terminus of this base sequence : 79184
tgtaatatgtagaaacattgccatcatatgcatccattgactgtttcccatcctttatgctatacgatcatgtgtatcacatttccatataccattaactctactatgtaatattcccattgaacagtcttcttcctcttcttcttcttcttcttctttttttttttaagtaggaggtaatcttttgtgcttacccagacttttaaatttctgatgccttatgaagagtgaagtttccatc

SEQ ID NO: 25230 - DNA, 238 bp, Homo sapiens
  AL163280.1_14561
  Located on chromosome 21
  Distance between a terminus base of telomere on chromosomal short arm and 5'-terminus of this base sequence : 37456643
  Distance between 3'-terminus of neighbour sequence of sequence listing upward to telomere on chrosomal short arm and 5'-terminus of this base sequence : 16501
aaccaacttgtgcatttaacagctcatcctgacaaaattcaatttgctgattctttttgtatttgattcttctaactatatatatatatatatatatatatatatatatatatactttctgaatttgtaaaggttatttgctgagaatggtttgttaatatgagtggagactgtacacttaggtgggattataaaacctgttaggattaacatatcattctaaagcaccattctaaat

SEQ ID NO: 25231 - DNA, 379 bp, Homo sapiens
  AL163280.1_237340
  Located on chromosome 21
  Distance between a terminus base of telomere on chromosomal short arm and 5'-terminus of this base sequence : 37675901
  Distance between 3'-terminus of neighbour sequence of sequence listing upward to telomere on chrosomal short arm and 5'-terminus of this base sequence : 219020
tagatcacgaggtcaggagttcgagaccagcctggccaatatggtgaaaccccatctctactgaaaatacaaaaattagctaggcattgtggcacgtacctgtagtcccagctgctcggcaggctgaggcaggagaatcgcttgaacccgggaggcggaggttgtagtgagccgagatcatgccactgcactccagcctgggtgacagagcaagactctgtctcaaaaaaaaaaaaaaatacacacacacacacacacacacacacacacacacactcattactcattataatatcatacagaatagttttgttgccctaaaaaatcctctgcgcttcacctatttatctctctctcctctagctcctgataaccactg

SEQ ID NO: 25232 - DNA, 468 bp, Homo sapiens
  AL163281.1_13496
  Located on chromosome 21
  Distance between a terminus base of telomere on chromosomal short arm and 5'-terminus of this base sequence : 37790934
  Distance between 3'-terminus of neighbour sequence of sequence listing upward to telomere on chrosomal short arm and 5'-terminus of this base sequence : 114654
tccatagtcagataactcggagcgcttggcaaccatagcccggcccctgcagagccctgctgtacctcgggtctcggtctcagctcttcatatctcgatccacttcattcattcagtcatttgctcacacctctgggggccgagggaagggtttgttcagtcgagtcagatttcttgtggtccaaagcctcatgttggcagtgtatatgtgtgtgtctgtatgtgtgtgcctgtgtgtgtgtgtatgtgtgtggggcgtgtgtgtgtgtgggggcatgtgtgtgtgtgtgtgtgtgtgtgtgtgtgtgagagagagagagttggaaggcaggggaatggattggttgggaagtagtctgtgctggcagctctgtgtgcccagacaccccgatacatccatgtctatgcaaagaccatctctcaagcaccaggccttttagcggctgctatggtagcctcactctttca

SEQ ID NO: 25233 - DNA, 193 bp, Homo sapiens
  Z67428
  Located on chromosome 21
  Distance between a terminus base of telomere on chromosomal short arm and 5'-terminus of this base sequence : 37791108
  Distance between 3'-terminus of neighbour sequence of sequence listing upward to telomere on chrosomal short arm and 5'-terminus of this base sequence : -294
ttgtggtccaaagcctcatgttggcagtgtatatgtgtgtgtctgtatgtgtgtgcctgtgtgtgtgtgtatgtgtgtggggcgtgtgtgtgtgtgggggcatgtgtgtgtgtgtgtgtgtgtgtgtgtgtgtgagagagagagagttggaaggcaggggaatggattggttgggaagtagtctgtgctggca

SEQ ID NO: 25234 - DNA, 443 bp, Homo sapiens
  AL163281.1_91266
  Located on chromosome 21
  Distance between a terminus base of telomere on chromosomal short arm and 5'-terminus of this base sequence : 37868827
  Distance between 3'-terminus of neighbour sequence of sequence listing upward to telomere on chrosomal short arm and 5'-terminus of this base sequence : 77526
aggtggaaactgattaggatctaggaaaattgagaggaggctgcttacagctctgcagatgcatctgaaataagtgctgattctcatctatctattacctgtctatctgtatttgtctatcatctacttatgtttgtctgtctgtctctctgatctatctatctatctatctatctatctatctatctatctatcatctatctatctatctgtctatctatctatctatctatctatctatcatctatctatctatctatctatcatcatctatctagagcaagcaggatagaacaggcaggccttacctcaagtcctcaaggaaccccagcttcctccaccctctctgatagagctggtgcctgagcattattatgcaaagtccctaaacaaggtagtggatgatgaactcaggctgcctggtgacactcaggaatagagcc

SEQ ID NO: 25235 - DNA, 247 bp, Homo sapiens
  AL163281.1_137783
  Located on chromosome 21
  Distance between a terminus base of telomere on chromosomal short arm and 5'-terminus of this base sequence : 37915393
  Distance between 3'-terminus of neighbour sequence of sequence listing upward to telomere on chrosomal short arm and 5'-terminus of this base sequence : 46123
gagtcgctaaaactacgtaacaatcatcaaggcatgtttggctcttggggaaaatggaaagcatagttttggttttaaaataatttgttttattaagagtgtgtgtgtgtgtgtgtgtgtgtgtgtgtgtgtgtgtgtgatacgaaaatgtccagtaggtgacctttgttgatctttgttgctgcctcttcagagccctgacttccaccttggactcatctcccttgtaggcaactaagtgaaatct

SEQ ID NO: 25236 - DNA, 111 bp, Homo sapiens
  D21S1893
  Located on chromosome 21
  Distance between a terminus base of telomere on chromosomal short arm and 5'-terminus of this base sequence : 37926184
  Distance between 3'-terminus of neighbour sequence of sequence listing upward to telomere on chrosomal short arm and 5'-terminus of this base sequence : 10544
taacaaaatccgccacggctgctgggagccgatagttccggggaagttttatgcaaaattgagtgtgtgtgtgtgtgtgtgtgtgtgtccgtgtccgtgtggtgtgcatac

SEQ ID NO: 25237 - DNA, 286 bp, Homo sapiens
  chr21.fa.O7frz.38310861
  Located on chromosome 21
  Distance between a terminus base of telomere on chromosomal short arm and 5'-terminus of this base sequence : 38039252
  Distance between 3'-terminus of neighbour sequence of sequence listing upward to telomere on chrosomal short arm and 5'-terminus of this base sequence : 112957
aaacttactaaggatacatgcctcattttactatgaatttcagccatgaaatttaagtgaaaaagataaatggcatccacttagcagttccgttcttctcaggatggaaaaggggaaggaggaaaaatagctagtgggaaaaagaattgcaaaaatcttcactttctaagctattgctccaagatgcaacacacacacacacacacacacacacacagaaaatcaaaagcaggcctttgaactgcagaatatgaactggtctctcttacaaggcttgtagaataca

SEQ ID NO: 25238 - DNA, 253 bp, Homo sapiens
  AL163281.1_320531
  Located on chromosome 21
  Distance between a terminus base of telomere on chromosomal short arm and 5'-terminus of this base sequence : 38097732
  Distance between 3'-terminus of neighbour sequence of sequence listing upward to telomere on chrosomal short arm and 5'-terminus of this base sequence : 58194
aagctgtgacagtcaaactaagacagagagagagagagagagagagagagagagagagagagagagagagagagagaaaggggcttgtaaaggagtaagcggcatcagtcacacgccgggttgttgcagcctttgtcatttttgctaagtatctgttcagaagaaccagagaagatccaggtctcagaaggagcctgcccactgaaaggtgagctttaattttataactggaaggaattcctgagtgctttac

SEQ ID NO: 25239 - DNA, 245 bp, Homo sapiens
  AL163281.1_327314
  Located on chromosome 21
  Distance between a terminus base of telomere on chromosomal short arm and 5'-terminus of this base sequence : 38104366
  Distance between 3'-terminus of neighbour sequence of sequence listing upward to telomere on chrosomal short arm and 5'-terminus of this base sequence : 6381
ggttctgcaaagatttcttatttaatgcaaaaataaaacaacaacacaaattttatatcaataggaaaaaaactctgtcttaaattgcattctctggataaatgttttgagatgtatataatcattaaatattctaaataatgaatgttttattttatgagtgaccatggcaaacacacacacacacacacacacacacacacacacacaagcatgcacacaagtagctggtaatcacattgtcc

SEQ ID NO: 25240 - DNA, 480 bp, Homo sapiens
  AL163282.1_86896
  Located on chromosome 21
  Distance between a terminus base of telomere on chromosomal short arm and 5'-terminus of this base sequence : 38202878
  Distance between 3'-terminus of neighbour sequence of sequence listing upward to telomere on chrosomal short arm and 5'-terminus of this base sequence : 98267
atccatttaagacctgaaaagaacaaaaagattgagtatgaagaaactctgcctgcctgatggctgagctgggaccttggtcttttcttgtctttggacttcgagtgaaacattggctctccttgggtctagagcttgatggctttcagattggaattacacattggctttcctgggacttcttagcatccataatcatgtgggccaattccttataataaacttattctctctctctctctacacacacacacacacacacacacacacacacacattcttatataagtatatacatatataccaatataaagagatataaatatgtatgctaataaatagcactatctctctatatgtcttattggctttgttactctggagaaccctgacaaatagaaatttaatgttatggatttaatggtagtacctctccaaaattcatatgttgaagccctaaccaatgtaatggtatctgga

SEQ ID NO: 25241 - DNA, 396 bp, Homo sapiens
  AL163282.1_194629
  Located on chromosome 21
  Distance between a terminus base of telomere on chromosomal short arm and 5'-terminus of this base sequence : 38310631
  Distance between 3'-terminus of neighbour sequence of sequence listing upward to telomere on chrosomal short arm and 5'-terminus of this base sequence : 107273
cagcggtagttatacaatccatcttcattctgtacatctttaatatacaaggctcccgtggatgtgatgagaaatctagatcctgaaatagaggaaaacagtggcttggttaaaagacaatgaaagcaacccaaccacacagacaaagtccttaaacagttttttttttcccccacctgaagaaacttaatgaaaaggctaaaaatgggtgcgtgcgtctgcgtgtgtgtgtgtgtgtgtgtgtgtgtgtgtgtgtgtcaattaagggtccaagctgttttaattttttgactagcctacattaagggtttttagtccttatgctatacaataaatatatacttagcaaatctaacctcataaacttttttttagatcatgcatttatcttacagc

SEQ ID NO: 25242 - DNA, 460 bp, Homo sapiens
  AL163282.1_278284
  Located on chromosome 21
  Distance between a terminus base of telomere on chromosomal short arm and 5'-terminus of this base sequence : 38394342
  Distance between 3'-terminus of neighbour sequence of sequence listing upward to telomere on chrosomal short arm and 5'-terminus of this base sequence : 83315
ctgaaatcagtagtttatgcttcagttgttgaattagacataattaggtaattccatattaagttcagaatggcatttaaaatgagtttggatatttccagtctttctttgcctgctgctagacagaaacatggctgcctctctggttcctgaattttaaagactttgtgtgtgtgtgtgtgtgtgtgtgtgtgtgtgtgtgtgtgtgtgtgtgtgtgagatatatgtgtatatctacacatacatgcaaacacacataagtaatatcacacacttatgtgaattactgcataaaatcaagcttaatgtataacctttttatctgctttctgactttataggattaatatgtgataagcgtactcccttatctctttcagaatgtattctttcttgagaagataaggatggagagatctactgaaaaagcaatgcacagtcctgtcatattgtcctagca

SEQ ID NO: 25243 - DNA, 200 bp, Homo sapiens
  AL163283.1_3648
  Located on chromosome 21
  Distance between a terminus base of telomere on chromosomal short arm and 5'-terminus of this base sequence : 38490757
  Distance between 3'-terminus of neighbour sequence of sequence listing upward to telomere on chrosomal short arm and 5'-terminus of this base sequence : 95955
tgcaaatgtacatattcaccttatatactctctctgtatatacatatatatatacacacacacatatacccacatacacacatctatacacacacacaagcaacacacacacacacacacacacacacacacacagacacgcatattttcttctgggacccaaagccagcctttgcagcctaccatataacattgttagg

SEQ ID NO: 25244 - DNA, 346 bp, Homo sapiens
  AL163283.1_17164
  Located on chromosome 21
  Distance between a terminus base of telomere on chromosomal short arm and 5'-terminus of this base sequence : 38504128
  Distance between 3'-terminus of neighbour sequence of sequence listing upward to telomere on chrosomal short arm and 5'-terminus of this base sequence : 13171
atccacctatggaataccaaaccaccctttctccaccctaaacccacatttcctcaggcccctcctagagccacagtttccaccacccaccccatcgctcgataagggagtcacaacatcctccctgttttcttcactctgtccacatccgtggtgtccatcaaagctacatgcctctttgccataacatctctcagccctgcctgtccatccatccatccatccatccatccatccatccattcaaccatccatccatccatccatccatccatccatccatccatccaaccatccattcaggcttccctagactcccctcgactgaactatgtacaaggagtgc

SEQ ID NO: 25245 - DNA, 399 bp, Homo sapiens
  AL163283.1_19112
  Located on chromosome 21
  Distance between a terminus base of telomere on chromosomal short arm and 5'-terminus of this base sequence : 38506155
  Distance between 3'-terminus of neighbour sequence of sequence listing upward to telomere on chrosomal short arm and 5'-terminus of this base sequence : 1681
aagtacagagactcaaaggaaagagcaagagagcctggggtaacctgggggagagagagcatggggtgacctggagaagagagaacttggggttagagaaacctgcaaatggaatggccctgggtaggactttggcgggggtggtgcttcaaaacagccacaaggctctgtgtgtgtgtgtgtgtgtgtgtgtgtgtgtgtgtgtgtgtgcacacgcacgcgcatgtgcgcatatgtgcttttgggcatttcacagggccccagggaccaccgtgacagcctcagtgagggatggcacagtcatccgaagcctggacagacgtgggttaaaataaagtcacttaattgaattaactttacaagttcaatggaaaaatgtttcacttgcagttagtcagc

SEQ ID NO: 25246 - DNA, 459 bp, Homo sapiens
  chr21.fa.O7frz.38874608
  Located on chromosome 21
  Distance between a terminus base of telomere on chromosomal short arm and 5'-terminus of this base sequence : 38589516
  Distance between 3'-terminus of neighbour sequence of sequence listing upward to telomere on chrosomal short arm and 5'-terminus of this base sequence : 82962
agaaagcagttgtagttcacatacttgcaaaatttggaaaagtaaaataaaagactcagtaactgaaaagattcaataactgctgtgctgcatgtatatctggggtgatactaaaataattcaacaacctgcacaaatacataaattagtaattaaaaactttcctctaatttcatacatatccctgtacacacacacacacacacacacacacacacactcacacactgctcagcaagtttctgaagctatagcattgtttacccaactgtcctgacacttctgattttaggaattgctagggtgatctctcgtttgggcagatgtcccaagctgacgtccgtggctgagctgttgatagtggcaggagacagacaaatccctaggcagacagtggtgggtccccattgaaacccaaccttcaagccgaagacagtttaaagcctagctataagtcct

SEQ ID NO: 25247 - DNA, 172 bp, Homo sapiens
  D21S1906
  Located on chromosome 21
  Distance between a terminus base of telomere on chromosomal short arm and 5'-terminus of this base sequence : 38698341
  Distance between 3'-terminus of neighbour sequence of sequence listing upward to telomere on chrosomal short arm and 5'-terminus of this base sequence : 108366
agccagacgatataactcccaagtctgtgcgatttatctctggaatatttacaattcagcctgtaagaaagattgcccaacaaatggtcgtgtgtgtgtgtgtgtgtgtgtgtgtatgtgtgtgtattttatttttatttttattttatttttttgagatggagtcttgctc

SEQ ID NO: 25248 - DNA, 323 bp, Homo sapiens
  AL163283.1_246199
  Located on chromosome 21
  Distance between a terminus base of telomere on chromosomal short arm and 5'-terminus of this base sequence : 38701392
  Distance between 3'-terminus of neighbour sequence of sequence listing upward to telomere on chrosomal short arm and 5'-terminus of this base sequence : 2879
gctgtattggatacgtttacatttatttatttatttatttatttatttatttatttatttatttatttatttatgagacagagtcttgctctgcaaccaggctggaatgcagtggcaggatcttggctcactgcaacctccaccccccaggttcaagcaactcttcagcctcagcctcccgagtagctgggactacaggtgcatgccaccacacccagctaatttttgaaattttttttcatttttattgtttttagtagagagagacggggtttcaccacgttggccaggattgtctcaatctcttgacctcatgatctgcc

SEQ ID NO: 25249 - DNA, 393 bp, Homo sapiens
  AL163283.1_329610
  Located on chromosome 21
  Distance between a terminus base of telomere on chromosomal short arm and 5'-terminus of this base sequence : 38784639
  Distance between 3'-terminus of neighbour sequence of sequence listing upward to telomere on chrosomal short arm and 5'-terminus of this base sequence : 82924
cctatcaagtgaatggatgaagctcaaaggtgctgcatactcatcttctctttaatgagcaccttcttactcccagcaccccaccgtctctaatctccatgaccctcaggccccatgaaagcggatgcagtagaactgaaaatcccacagctcaggaaaagatgatgtcaggaatgcatgcatgtgtgtgtgtgtgtgtgtgtgtgtgtgtgtgtgtgtgtgtaaaaacagagatgccaggatactagcaaaactatattacatataataaatctaattcttcatcattctgtttgtctgaaggcctggctcttcttttagcaataattttaaactagaatgtgctctggggttaaaaccaggagaaatggtaatgaaacacaatgcagtagg

SEQ ID NO: 25250 - DNA, 143 bp, Homo sapiens
  D21S1887
  Located on chromosome 21
  Distance between a terminus base of telomere on chromosomal short arm and 5'-terminus of this base sequence : 38784796
  Distance between 3'-terminus of neighbour sequence of sequence listing upward to telomere on chrosomal short arm and 5'-terminus of this base sequence : -236
aaagatgatgtcaggaatgcatgcatgtgtgtgtgtgtgtgtgtgtgtgtgtgtgtgtgtgtgtgtaaaaacagagatgccaggatactagcaaaactatattacatataataaatctaattcttcatcattctgtttgtctg

SEQ ID NO: 25251 - DNA, 346 bp, Homo sapiens
  chr21.fa.O7frz.39188776
  Located on chromosome 21
  Distance between a terminus base of telomere on chromosomal short arm and 5'-terminus of this base sequence : 38903741
  Distance between 3'-terminus of neighbour sequence of sequence listing upward to telomere on chrosomal short arm and 5'-terminus of this base sequence : 118802
acagtattctgatgtggtctaaatctgcaggaatcttaatttgagtgagaaggaatatttctcatgtgtctaggagctctttgtgcttggaggaatggcagacactatgtgtgtgtgtgtatgtgtgcatatatatatatatatatatatatatatcctttccttgttttccattttattataaatattttctcatagctttgttagcaaaattaacccattgatcatgataaaaaaatgcaactttttttgcaagattgtcatttgtcttttgaatttgtgaaggttttcccaattcagagctctatctagtcacttttattagtctaggtcttgtggaacactt

SEQ ID NO: 25252 - DNA, 442 bp, Homo sapiens
  AL163284.1_203081
  Located on chromosome 21
  Distance between a terminus base of telomere on chromosomal short arm and 5'-terminus of this base sequence : 38997116
  Distance between 3'-terminus of neighbour sequence of sequence listing upward to telomere on chrosomal short arm and 5'-terminus of this base sequence : 93029
ctttacaatcttccaggcaagaaattttcacttggtcccagccaagctggtacctctccgcgcatggcctctctctgagcagccttcatcagctcaggggatgtgtgcgggtatgccaggatcccatccaggctgcctgacctcagcaccactgacttgcagagccagatgcctctgtgtgtgtgtgtgtgtgtgtgtgtgtgtgtgtgtgtgtgtgtgtgtggaggggatcagcaggggtgggcaccagcctgtgaattttttgtagaatgtttagccgcacccctggtctctacccactagatgataataccacccaccacactcagttgtgacaaccaaaaatgcttccccgacactgccaaatgtgccctcggggcctaccattgggaaccacgggattctgtgtatttgcccagttgttgaggaagtaggtcctgtg

SEQ ID NO: 25253 - DNA, 411 bp, Homo sapiens
  AL163284.1_250739
  Located on chromosome 21
  Distance between a terminus base of telomere on chromosomal short arm and 5'-terminus of this base sequence : 39044838
  Distance between 3'-terminus of neighbour sequence of sequence listing upward to telomere on chrosomal short arm and 5'-terminus of this base sequence : 47280
atgtacctggcttatttcacttagcattatgtccttcagtttcattcatcattcatgttgtcacataagggaagagtttccttcttctttaaggctgaataatattcccgggtgtgtgtgtgtgtgtgtgtgtgtgtgtgtgtgtgtgtgtgtttgcagagtgctaacatcttttcaagatcataattccagtccttttgagtaaatgcccagaagtgagattgctggatttgctggtggttctatttataatttttttagaaacctccatactgtcttctgcaggagctccaccattttgcattcccaccaacagattacaagggctccattttttttcacatcttcaccaacattcatttgcttttttttaatataaaataatcttagtaggtatgagatggcatctca

SEQ ID NO: 25254 - DNA, 301 bp, Homo sapiens
  AL163284.1_307705
  Located on chromosome 21
  Distance between a terminus base of telomere on chromosomal short arm and 5'-terminus of this base sequence : 39101718
  Distance between 3'-terminus of neighbour sequence of sequence listing upward to telomere on chrosomal short arm and 5'-terminus of this base sequence : 56469
cgttggcattaataccaattagtcacgatgatctgaaagcccccgcgaattccagaaggatgctgcatgttctaaagacaattccattccctcacctaggcttcaccactgcacaattcatccacgttacccaaaaccactggtaccccccaaaagtacagaggggatactttaatatatatagaaatatatattacatatatatatatatatatatatatatatatatatatatataaaattaaacactcaaagaactacatacctaaaaaggtgaaatttgctttatgtaaaccatgtc

SEQ ID NO: 25255 - DNA, 206 bp, Homo sapiens
  AL163285.1_75202
  Located on chromosome 21
  Distance between a terminus base of telomere on chromosomal short arm and 5'-terminus of this base sequence : 39208333
  Distance between 3'-terminus of neighbour sequence of sequence listing upward to telomere on chrosomal short arm and 5'-terminus of this base sequence : 106314
caggaagaggttctaccttcacaccagtcactgtttgaggaccccacatctttggaagctgcccttctctcacagtgtttgtgtgtgtgtgtgtgtgtgtgtgtgtgtgtgtgttcatggtcatttgtgtttgtccgatgacacttagcctaagggttggggtggggggagcagtgagtgggagctccttgattagaatctcctgg

SEQ ID NO: 25256 - DNA, 234 bp, Homo sapiens
  AL163285.1_94375
  Located on chromosome 21
  Distance between a terminus base of telomere on chromosomal short arm and 5'-terminus of this base sequence : 39227526
  Distance between 3'-terminus of neighbour sequence of sequence listing upward to telomere on chrosomal short arm and 5'-terminus of this base sequence : 18987
tcttagcctccataatcatgtaagccaattctttttagtcaatctctctagagaatgatatagatagatagatagatagatagatagatagataaataaatgatagatagatattctgtttcatcttatatatgttctgtttctgtttctctggagaaccctaactaatgcatacagttagtcattattaaacattaaatagtttcaagaagcttatcacgaggtgtctactgc

SEQ ID NO: 25257 - DNA, 157 bp, Homo sapiens
  D21S266
  Located on chromosome 21
  Distance between a terminus base of telomere on chromosomal short arm and 5'-terminus of this base sequence : 39254119
  Distance between 3'-terminus of neighbour sequence of sequence listing upward to telomere on chrosomal short arm and 5'-terminus of this base sequence : 26359
aggcaaatgaagacctgaacatgtaagttatgaagcagaaaaagccattctgggtctcactgtgtgtgtgagagtgtgtgtgtgtgtgtgtgtgtgtgtgtgtatgatgtctgcatctaactgtgctacatctacattgtgatgactcaatgtcccc

SEQ ID NO: 25258 - DNA, 356 bp, Homo sapiens
  AL163285.1_164305
  Located on chromosome 21
  Distance between a terminus base of telomere on chromosomal short arm and 5'-terminus of this base sequence : 39297376
  Distance between 3'-terminus of neighbour sequence of sequence listing upward to telomere on chrosomal short arm and 5'-terminus of this base sequence : 43100
gcaccttactttaagcatcaagttaaggtgctctattatctgtgaaagagttgaagatatagaggactaaacccacttcgggatgaatacatatttgctgaggaaggagctatacaaggactctgggaaaaaaatacatacacacacacacacacacacacacacacacacacacacacacacatagttttactcccagagttgaaaactaaacattagagctacactgtccaatatggtagctactagctaaatttacattttatacttaaatttattaaaattaaatagaattcaaattttggtttatcggttgccctattcatatttcaagtacagatgctcttcagcttaca

SEQ ID NO: 25259 - DNA, 372 bp, Homo sapiens
  chr21.fa.O7frz.39745106
  Located on chromosome 21
  Distance between a terminus base of telomere on chromosomal short arm and 5'-terminus of this base sequence : 39459837
  Distance between 3'-terminus of neighbour sequence of sequence listing upward to telomere on chrosomal short arm and 5'-terminus of this base sequence : 162105
tcttgtcactgttataggcaatggtctggccttgtgggctccagctcatgctcattggttccagcttgtccttgttcttcctcattttataacctccttcccttcccaaatgccatcagatgcaaagataagagccattgagagacctcttagtcagatcccacagtttgacccaaaaggccaaatcctctaagcaatcccttttaaacacacacacacacacacacacacacacacaaacacgcacacaccacatcattatagcaagtggaacacaaaaccaaatgagtgctcagcatggaggaaccttgaggacactatgctcagtgaaatatgccagttacaaaaagacaagtactgtatgattccact

SEQ ID NO: 25260 - DNA, 268 bp, Homo sapiens
  AP001743.1_32725
  Located on chromosome 21
  Distance between a terminus base of telomere on chromosomal short arm and 5'-terminus of this base sequence : 39574021
  Distance between 3'-terminus of neighbour sequence of sequence listing upward to telomere on chrosomal short arm and 5'-terminus of this base sequence : 113812
tgatcagcttctgaaatgtttccatcattacacaaagacatgaaagcatgtgtactgtgtatttatttgtgtgtgtgtgtgtgtgtgtgtgtgtgtgtgtactctctatttattacagtatgctttagaagagccaaatttgaaaacaacctgaacttctatcagcaaagtttttatcacataagctatggcacatctaccagtggaatacagtatatgacttgaaagaacaagtcaagtattgtacttatgtggaaagacgtttgag

SEQ ID NO: 25261 - DNA, 339 bp, Homo sapiens
  chr21.fa.O7frz.39934530
  Located on chromosome 21
  Distance between a terminus base of telomere on chromosomal short arm and 5'-terminus of this base sequence : 39649206
  Distance between 3'-terminus of neighbour sequence of sequence listing upward to telomere on chrosomal short arm and 5'-terminus of this base sequence : 74917
catccatttatgcatccactcatccatccatccacctacccatccatttatccatccactcatacatccatttgtccatccacctatccatccattcatccattcatccatccatccatccatccatccatccatccatccatttgtccgtccacctagccatccattcatccatgcatccatccatccatccatccatccactcatccatccatttgtccgtccacctagccatccattcatccatgcatccatccatccatccatccatccactcatccatgcaataataatttagccccgaatcatgctggatgcttggagtatgaagtccgatat

SEQ ID NO: 25262 - DNA, 386 bp, Homo sapiens
  AP001743.1_194618
  Located on chromosome 21
  Distance between a terminus base of telomere on chromosomal short arm and 5'-terminus of this base sequence : 39735734
  Distance between 3'-terminus of neighbour sequence of sequence listing upward to telomere on chrosomal short arm and 5'-terminus of this base sequence : 86189
ggagctattccaattgactttaaaacgtaggaatttaaaagtaactactagtggaaaatgcactaagggcaaaaagaacagagaaagaaaggaaaggaagaaaggaaggaaaggaagaaagaaagaaaggagggagggagggagagagagaaagagagagaaagagaaagaaagcaagagagggagggagaaagaaagagagaggagaggaggaaagaaagaaaggaaggaaggaggggagggaggagagggaggaaaggaaggaaggaaggaaggaaggaaggaagggagggagggagggagggagggaaggagggagggaggcatcttaacccctttcccacaatcacactattggctgagtgttgatgttatcctgagactgc

SEQ ID NO: 25263 - DNA, 357 bp, Homo sapiens
  AP001745.1_86100
  Located on chromosome 21
  Distance between a terminus base of telomere on chromosomal short arm and 5'-terminus of this base sequence : 39880052
  Distance between 3'-terminus of neighbour sequence of sequence listing upward to telomere on chrosomal short arm and 5'-terminus of this base sequence : 143932
gcttcagactcgaactagaattaccccacagactctcccggggctgcagcttaccaaatgcagatctcaggacgtaccagccttcataactgtgtgagctgattacacacacacacacacacacacacacacacacacacacacactcccattggttctgtttctctggaaaatcctgaccaatataatatacatatatgctattttgattaaataaactgtacaaatttatggaaaagcatgattgaagttatgatcgtctgggtcctattaaattcatggattccaaaaatatacgactgttttatgaagccgcatacattttgacattaaaagttgattgtcacattcagaaca

SEQ ID NO: 25264 - DNA, 339 bp, Homo sapiens
  AP001745.1_238665
  Located on chromosome 21
  Distance between a terminus base of telomere on chromosomal short arm and 5'-terminus of this base sequence : 40032601
  Distance between 3'-terminus of neighbour sequence of sequence listing upward to telomere on chrosomal short arm and 5'-terminus of this base sequence : 152192
tcctcagagtgtttacatggacagggcaaatgtgaaaaatccctccggccatcatgcaggaaaatatgtataaaggataactggagaaaaatgccttccatggacaaaacacagacagaaacacacacacacacacacacacacacacacacacacacaaacagcaggggtatctttcattgtgcctcaataaaacagaggttgaaggagacaccaagctagaaacagactgttaattttgggatttttttctttaatcattttaatataaagagacagcatgttacaatgacattttatggatgattataaattattatgaagtcctcaactggtaaa

SEQ ID NO: 25265 - DNA, 438 bp, Homo sapiens
  AC020557.3_79970
  Located on chromosome 21
  Distance between a terminus base of telomere on chromosomal short arm and 5'-terminus of this base sequence : 40112545
  Distance between 3'-terminus of neighbour sequence of sequence listing upward to telomere on chrosomal short arm and 5'-terminus of this base sequence : 79605
tcaggagttccagaccagtctggccaattggtgaaaccccatctctactaatgatacaaaaattagctgggcgtggtggcacgtgcgtataatcccagctactctggaggctgaggcaggagaatcgcttgaacctgggaggcggaggttgcagtgagccgaggtcatgccattgcactccagcctgggccacagagtgagacgagactcgtctcaaaataaataagtaaataaataaataaataaataaataaataaataaataaataaataaaattaaaaaaggttagcattatctcttgattgaaatgtcctacgtgattccccgactccgagcctgtcgctctggccaggaggatgttgggtgctcctgataggctgaggcctgggctatttgcagtgtcaaagggaaaggcctcatgctgttggttcattagt

SEQ ID NO: 25266 - DNA, 180 bp, Homo sapiens
  AP001746.1_77306
  Located on chromosome 21
  Distance between a terminus base of telomere on chromosomal short arm and 5'-terminus of this base sequence : 40206893
  Distance between 3'-terminus of neighbour sequence of sequence listing upward to telomere on chrosomal short arm and 5'-terminus of this base sequence : 93910
cttaatctgtttcacagaaccatattttaataccgtgtgtgtgcgcgtgtgtgtgtgtgtgtgtgtgtgtgtgtgtgtgtgtgtgtgtgcgctggtttataatatcacctgggcgggataaagaagattaggttcctttctgcttatttgtaaaacctgttcaagctgcagtaagattgt

SEQ ID NO: 25267 - DNA, 287 bp, Homo sapiens
  AP001746.1_313585
  Located on chromosome 21
  Distance between a terminus base of telomere on chromosomal short arm and 5'-terminus of this base sequence : 40443011
  Distance between 3'-terminus of neighbour sequence of sequence listing upward to telomere on chrosomal short arm and 5'-terminus of this base sequence : 235938
aacttgctcaatcaccagtaaccctaaacagttattaccagtgctgacaagatatcaatttaaccaataggttccttcagggaacagatgagaggtgtccaaccccatggaaatcccagcaaaatactaaatacctccctgtcacaatcaaatcctaaagccgactgtctttcttaggcttctgactatgtgtgtaggaggttacacacacacacacacacacacacacacacacacataaatgaagtggaacctcgggggaggacagtatgtcaaattcctctacg

SEQ ID NO: 25268 - DNA, 458 bp, Homo sapiens
  chr21.fa.O7frz.40840331
  Located on chromosome 21
  Distance between a terminus base of telomere on chromosomal short arm and 5'-terminus of this base sequence : 40555010
  Distance between 3'-terminus of neighbour sequence of sequence listing upward to telomere on chrosomal short arm and 5'-terminus of this base sequence : 111712
cagttacataagccagttccttgaagtgaatctgtgtgtgcacatgtgcatgtgtgtgtgtgtgcatgtgtgtgtccatgtgtgtgtccgtgcatgagtgtgcatgtgtgtatgcatgcatgtgtccgtgtgtgcatccatgtgtgcatgcacatgtgcatgtgtgtgcatgtgtgtgcacgtgtgcgtgtgtgtgcgtgtgtgtgcgtgcatgtgtgtgcacgtgtgcgtgtgtgtgcatgcatgtgtgtgcatgtgtgtgtgcgtgtgtgtgcacgtgtgcgtgtgatctccaactggttctgttcctctggctgaacctggaggatgcatcgtctttctgcattgtctacctgttttacagggacctgccttatctttaaaatcagaagtaattaagttcattttaaaagtcaaggcgagtaccaaaaagaatgtaaacactctattccaaggct

SEQ ID NO: 25269 - DNA, 298 bp, Homo sapiens
  HUMUT1355
  Located on chromosome 21
  Distance between a terminus base of telomere on chromosomal short arm and 5'-terminus of this base sequence : 40704046
  Distance between 3'-terminus of neighbour sequence of sequence listing upward to telomere on chrosomal short arm and 5'-terminus of this base sequence : 148578
atgatgaatgcatagatggatgggtggatggatggatggatggatggatggatggatggatggatgaatggatacatagatgaatggatggatagatagtatataaatggatggatggatagatacacagtaggtaggtaggtagtagatagatagatagatagatagatagatagatagatagatagataaacaggatagatagatagatagatagatagatagatagatagatagataaacaggatgaatatttagaaggctgggagtgggcagaaagcctggaaggacacacatt

SEQ ID NO: 25270 - DNA, 322 bp, Homo sapiens
  AP001747.1_295259
  Located on chromosome 21
  Distance between a terminus base of telomere on chromosomal short arm and 5'-terminus of this base sequence : 40763819
  Distance between 3'-terminus of neighbour sequence of sequence listing upward to telomere on chrosomal short arm and 5'-terminus of this base sequence : 59475
tgaggtcaaatactaagcaaacctcttgccagtcttgcagctcctcaagagcctgagagccacctctttggtggtggtggtggtggtggtggtggtgtttgaggtggagttttgctcttgtcgcccaggctggagtgcaatggtgcgatcttggctcactgcaacctctgcctcccaggttcaagtaattctcctgcctcaacttcccaagtagctgggattacaggcatgtgacaccacacccagctaattttttatttttagtagagaacggggtttttgtcatgttggctaggctgttctcaaactcctgatctcaaga

SEQ ID NO: 25271 - DNA, 399 bp, Homo sapiens
  AP001748.1_53265
  Located on chromosome 21
  Distance between a terminus base of telomere on chromosomal short arm and 5'-terminus of this base sequence : 40860701
  Distance between 3'-terminus of neighbour sequence of sequence listing upward to telomere on chrosomal short arm and 5'-terminus of this base sequence : 96560
aaacatttcagtcatgtcgtagtctttgactgaatatttagccctgaaatggtttttcctgtattttctaaatgccaaaccccaacctgaagtgagtgatgccttggtaaaggctctgtggcatttagatggccccggcacagtgagcttgccagaaagccaccttactttccatcctctgatgctgagttgtttgttttgttttgttttgttttgttttgttttgtttcagtctctttgagacccatctgtggttttccaggctttgcttaatcccagtccaggactagctgggactacaggcatgtgccaccacgtctggctaattttttgtatttttagtagagacagggtttcacaatgttagccaggatggtctcaatctcctgaccttgttat

SEQ ID NO: 25272 - DNA, 288 bp, Homo sapiens
  AP001748.1_186119
  Located on chromosome 21
  Distance between a terminus base of telomere on chromosomal short arm and 5'-terminus of this base sequence : 40993554
  Distance between 3'-terminus of neighbour sequence of sequence listing upward to telomere on chrosomal short arm and 5'-terminus of this base sequence : 132454
tggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgagga

SEQ ID NO: 25273 - DNA, 343 bp, Homo sapiens
  AP001748.1_323693
  Located on chromosome 21
  Distance between a terminus base of telomere on chromosomal short arm and 5'-terminus of this base sequence : 41131206
  Distance between 3'-terminus of neighbour sequence of sequence listing upward to telomere on chrosomal short arm and 5'-terminus of this base sequence : 137364
cacgcctgtaatcctacactttgagaggccaaggcaggtgggtcacctgaggtcaagagtttgagaccagcctggccaacacggtgaaaccctgtctctactaaaaatacaaaaataataataataataataataataataattagccaggtgtggtggcaggcacctgcagtctcagctactcaggaggctgaggtgggagaattgtttgaacctgggaggcagaggttgcagtgagctgagatcgcgccactatatgatctgggcgccactctgggtgacacagcaagactccatctcaaaaacaaacaaacaaaaccgggagtgcctggacacttagtga

SEQ ID NO: 25274 - DNA, 230 bp, Homo sapiens
  AP001751.1_16174
  Located on chromosome 21
  Distance between a terminus base of telomere on chromosomal short arm and 5'-terminus of this base sequence : 41208714
  Distance between 3'-terminus of neighbour sequence of sequence listing upward to telomere on chrosomal short arm and 5'-terminus of this base sequence : 77165
acatggtaagtgctcaaagaaccttaggcctcagaactgtgactgcctttggatggcagatctagaaaagaggccgtacgttcttccagttcccctgacaggtttacatcatggctgcacctaatgatcattgggactcacctatcatgtcccatcttacttatccatccatccatccatccatccattcatccattcatctctccatccattatccatctttctatcat

SEQ ID NO: 25275 - DNA, 385 bp, Homo sapiens
  AP001751.1_83947
  Located on chromosome 21
  Distance between a terminus base of telomere on chromosomal short arm and 5'-terminus of this base sequence : 41276437
  Distance between 3'-terminus of neighbour sequence of sequence listing upward to telomere on chrosomal short arm and 5'-terminus of this base sequence : 67493
gccggtaaatagtttaaatccttttttcctcactatcaaaataatacatattcattgacagagaatttggaaattaagaacattacaagaaacagaaggagaaaaacccaccatatattcacaacacaaagagaacaccttcaacattttggaatgtttccttccagcattgcctgtttctgtgcatttcaaaaacatagttaaataatgtctgtgtgtgtgtgtgtgtgtgtgtgtgtgtgtgtgtgtgtgtgtgtgtgttctagctgggttttctgagattctgtatttgtctttttggcatccatttgtcacagggccaattgtattcactataattttcttattttctgtattcttgatgctctggcattcaaagactctt

SEQ ID NO: 25276 - DNA, 153 bp, Homo sapiens
  D21S1890
  Located on chromosome 21
  Distance between a terminus base of telomere on chromosomal short arm and 5'-terminus of this base sequence : 41353618
  Distance between 3'-terminus of neighbour sequence of sequence listing upward to telomere on chrosomal short arm and 5'-terminus of this base sequence : 76796
ggtctgaccacagatttcccaatcgccacacacacacacacacacacacacacacacacacacacacgggttgtttgggagtcagttggttttcaaaggctttcaaggaaatgaagagtcccaaagttttccttaatcgttcagagtgttttt

SEQ ID NO: 25277 - DNA, 185 bp, Homo sapiens
  D21S1885
  Located on chromosome 21
  Distance between a terminus base of telomere on chromosomal short arm and 5'-terminus of this base sequence : 41365550
  Distance between 3'-terminus of neighbour sequence of sequence listing upward to telomere on chrosomal short arm and 5'-terminus of this base sequence : 11779
aggacaagtttggccccatcttgcgcgctctctctctctctctccccctctctttgtgtgtgtgtgtgtgtgtgtgtgtgtgtgtgtgtgtgtgtgtgtgctctcactttctcactcttgcccttctgccttccaccttgggatgccgcagcaagaaggccctaactagatgccagtgccatgct

SEQ ID NO: 25278 - DNA, 379 bp, Homo sapiens
  AC019224.3_187899
  Located on chromosome 21
  Distance between a terminus base of telomere on chromosomal short arm and 5'-terminus of this base sequence : 41458166
  Distance between 3'-terminus of neighbour sequence of sequence listing upward to telomere on chrosomal short arm and 5'-terminus of this base sequence : 92431
caatgaagaggcaatggaggccaggcgcagtggctcacacctgtaatcccagcactttgggaggccaaggcgggcggatcacgaggtcaggagtttgagaacagcctggccaacatagtgaaaccccatctctactaaaaatataacaattagctgggtgtggtggcgcacgcctgtaatcccaggtactcaggaggctgaggcaggagaatcccttgaacccaggaagcagaggttgcagtgagctgagattgcgccactgcactccagcctgggcaacaaagtgagactctgtctcaaaaacaaacaaacaaacaaacaaacaaacaaacaaaagaaggcaaaggaaacaaaaggctcattgtcaagtgacaatcaa

SEQ ID NO: 25279 - DNA, 112 bp, Homo sapiens
  Z66599
  Located on chromosome 21
  Distance between a terminus base of telomere on chromosomal short arm and 5'-terminus of this base sequence : 41521141
  Distance between 3'-terminus of neighbour sequence of sequence listing upward to telomere on chrosomal short arm and 5'-terminus of this base sequence : 62596
ggaaaattgggaaactgaacaagaatgaatatacaaaaataaaacttgtgatgctagtgaaatacacacacacacacacacacacacagcctttaatacttattccagaaaa

SEQ ID NO: 25280 - DNA, 390 bp, Homo sapiens
  AC019224.3_4432
  Located on chromosome 21
  Distance between a terminus base of telomere on chromosomal short arm and 5'-terminus of this base sequence : 41560778
  Distance between 3'-terminus of neighbour sequence of sequence listing upward to telomere on chrosomal short arm and 5'-terminus of this base sequence : 39525
aggcacagtggctaattgtaccttgggaggctgagacgggaggatcgagaccatcctgggcaccatagtgagaccccatctctacaaaaaaaaaaaaaaattttttttaaatagccaggcatggtgaggctgaagtaggatcacttgagcctggaaggtcgaagctgaagtgagccatgatcacaccactacactccagcctaggtgacagagcaagacaccatctcaagaaagaaaaaaaagaaagaaaagaaaagaaaagaaaagaaaagaaaagaaaagaaaagaaaagaaaagaaaagaaaagaaaaaacgaaggggaaaaaaagagaatcataaacataaatgtaaaatttctcaaaaaaatcgttatgaccataggttaggcaa

SEQ ID NO: 25281 - DNA, 270 bp, Homo sapiens
  AP001752.1_29824
  Located on chromosome 21
  Distance between a terminus base of telomere on chromosomal short arm and 5'-terminus of this base sequence : 41560897
  Distance between 3'-terminus of neighbour sequence of sequence listing upward to telomere on chrosomal short arm and 5'-terminus of this base sequence : -271
catggtgaggctgaagtaggatcacttgagcctggaaggtcgaagctgaagtgagccatgatcacaccactacactccagcctaggtgacagagcaagacaccatctcaagaaagaaaaaaaagaaagaaaagaaaagaaaagaaaagaaaagaaaagaaaagaaaagaaaagaaaagaaaagaaaagaaaaaacgaaggggaaaaaaagagaatcataaacataaatgtaaaatttctcaaaaaaatcgttatgaccataggttaggca

SEQ ID NO: 25282 - DNA, 339 bp, Homo sapiens
  chr21.fa.O7frz.41962492
  Located on chromosome 21
  Distance between a terminus base of telomere on chromosomal short arm and 5'-terminus of this base sequence : 41676661
  Distance between 3'-terminus of neighbour sequence of sequence listing upward to telomere on chrosomal short arm and 5'-terminus of this base sequence : 115494
tttagagcagacactgtcagactgcagcaggagtccatgtgctttgggctgcgttcccaagcagcctggcgctgccctgaattttgtcttcacaacccaggagcctggtcctgagaatgggccactgcagcagccactcctcccactcggaggcctttcgctgacctggtattgggtcctgggactgcagagtcagctgaccctggagcagggtccagattctgctatggacacgtgctgggtggcgatgcagcacatgtgtgtgtgtgtgtgtgtgtgtgtgcgcgcgcgtgctgcccgatctgaggcaaccgtgcggtggagacagtttctacgaga

SEQ ID NO: 25283 - DNA, 307 bp, Homo sapiens
  chr21.fa.O7frz.42053077
  Located on chromosome 21
  Distance between a terminus base of telomere on chromosomal short arm and 5'-terminus of this base sequence : 41767372
  Distance between 3'-terminus of neighbour sequence of sequence listing upward to telomere on chrosomal short arm and 5'-terminus of this base sequence : 90372
ggtttccttaatttgactttctgattgttcattactatttgtagaaatgcaacatatttttgtatattgattgtgtttcctgcagccttgctaaattcatttattcatcctaatatttgttgatttttttttgtgtgtgtgtgtgtgtgtgtgtgtgtgtgtgtgatccttatgattttccatatataagaccatgtcatctgtgaataaagatagtgttacttcctttttaatccagatgccttttatttcttttccttgcttggttgttctggtttgtctctagtagaatgttgaacagaagtgg

SEQ ID NO: 25284 - DNA, 224 bp, Homo sapiens
  D21S1259
  Located on chromosome 21
  Distance between a terminus base of telomere on chromosomal short arm and 5'-terminus of this base sequence : 41828809
  Distance between 3'-terminus of neighbour sequence of sequence listing upward to telomere on chrosomal short arm and 5'-terminus of this base sequence : 61130
cactggctctgctgaccttgtgccttggtaagtgggcagtgaggccgcctgacgcagggcgccgtgtgtgagagtgtgtgtgtgtgtgtgtgtgtgtgtgtgtgtgtgtgtatgtgtccagtgttggggtcagcgttgggccttgataccttgttgattaatttttcttaaaggtatatattttaacctttgcttatgaccaacagaatatttattacagtccc

SEQ ID NO: 25285 - DNA, 233 bp, Homo sapiens
  AP001752.1_325542
  Located on chromosome 21
  Distance between a terminus base of telomere on chromosomal short arm and 5'-terminus of this base sequence : 41856630
  Distance between 3'-terminus of neighbour sequence of sequence listing upward to telomere on chrosomal short arm and 5'-terminus of this base sequence : 27597
acattctaggtttgctgtaaagagcatgatgaaaagctccagctatctcaatgttccatacaggttgaggttttgtttccgttctgctttttacctgaagaggatctcgtgtgtgtgtgtgtgtgtgtgtgtgtgtgtgtgtgtgtgtgtgtctacctacctactacctatttgtcatctatctataattgacaaaatatgattgtgtatatggagtaccatgtgatctatgt

SEQ ID NO: 25286 - DNA, 304 bp, Homo sapiens
  chr21.fa.O7frz.42257923
  Located on chromosome 21
  Distance between a terminus base of telomere on chromosomal short arm and 5'-terminus of this base sequence : 41972112
  Distance between 3'-terminus of neighbour sequence of sequence listing upward to telomere on chrosomal short arm and 5'-terminus of this base sequence : 115249
ctcatcttcatgtagcttgaagtataggcgtgtgccaccgtacccggctaatttttgtatttttagtaaaaatggggtttcgccatgttggccaggctggtctcaaactcctggcctcaagtgatcccaaagtgctgggattacaggcatgagccactgcacatggcctgatgtagaacatttttggtcattgtttcctcagattgtttttctgttgcaccctctctgggggagtatgtgtgtgtgtgtgtgtgtgtgtgtgtgtgtgtgcgcgcacacgctacatgaagttccataactcact

SEQ ID NO: 25287 - DNA, 173 bp, Homo sapiens
  D21S1912
  Located on chromosome 21
  Distance between a terminus base of telomere on chromosomal short arm and 5'-terminus of this base sequence : 42082821
  Distance between 3'-terminus of neighbour sequence of sequence listing upward to telomere on chrosomal short arm and 5'-terminus of this base sequence : 110405
gagcccaccctggtaaccttgtttcacctttgtcgcctctgtaaagaccctgtgtctgaatacaggcggatcctgaagtcgggacttcactctgtgaatttgggggacgcagtgcagcccataaccttatcttttgtgtgtgtgtgtgtgtgtgttttaaatctgtatgaggg

SEQ ID NO: 25288 - DNA, 261 bp, Homo sapiens
  AP001754.1_14819
  Located on chromosome 21
  Distance between a terminus base of telomere on chromosomal short arm and 5'-terminus of this base sequence : 42223987
  Distance between 3'-terminus of neighbour sequence of sequence listing upward to telomere on chrosomal short arm and 5'-terminus of this base sequence : 140993
gctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtag

SEQ ID NO: 25289 - DNA, 173 bp, Homo sapiens
  AP001754.1_288457
  Located on chromosome 21
  Distance between a terminus base of telomere on chromosomal short arm and 5'-terminus of this base sequence : 42496736
  Distance between 3'-terminus of neighbour sequence of sequence listing upward to telomere on chrosomal short arm and 5'-terminus of this base sequence : 272488
ggtctttgtaggtgatcaagttaagaggaggctgttaggataggccctactgcaataatgctttgtatccttataaaaaggggagatttggacacacacacacacacacacacacacacacacacacacacacacacacacacggagaagctgtgtgaagataaaggcagagc

SEQ ID NO: 25290 - DNA, 272 bp, Homo sapiens
  AP001754.1_314785
  Located on chromosome 21
  Distance between a terminus base of telomere on chromosomal short arm and 5'-terminus of this base sequence : 42522925
  Distance between 3'-terminus of neighbour sequence of sequence listing upward to telomere on chrosomal short arm and 5'-terminus of this base sequence : 26016
tagaattctaggtttgcagtgattttctttcagctctttaaagatgtcattctattacctttagtttcttcaacagctcttttaggagagctttaaaggaatcatttttaaaacattttgttcagcttttcaagttgttctcagcaggagtatatgtctgacatagctactttgtcccatatggaagcagaggcccccattttctctctctctctctctctctctctctctctctctctccttccatcccataggaccagatcctgtacctc

SEQ ID NO: 25291 - DNA, 402 bp, Homo sapiens
  AL163300.1_51406
  Located on chromosome 21
  Distance between a terminus base of telomere on chromosomal short arm and 5'-terminus of this base sequence : 42598432
  Distance between 3'-terminus of neighbour sequence of sequence listing upward to telomere on chrosomal short arm and 5'-terminus of this base sequence : 75235
gactcatgtctgtaatcctagcactttgggaggccaaggcaggtggatcacttgagcccaagagtttgagaccagcccgggcaacatggcaaacacccaactctataaaaaatacaaaaattagctagttatggtggcacatgcctgtagtctcagatgctgagaaggctgaggtgggaagatcacctgagcccaggaggtggaggctgtggtgagccatgaccacaccacgactgggtcattgcactccagcctgggtgacaaagggagactctgtctttaaagtgtgtgtgtgtgtgtgtgtgtgtgtgtgtgtgtgtgtgtgtgtgtgtgtgtgtataacattaccagagactatgctctaaaaactggtaaacctagaggaaatgataatttcctgga

SEQ ID NO: 25292 - DNA, 255 bp, Homo sapiens
  D21S1903
  Located on chromosome 21
  Distance between a terminus base of telomere on chromosomal short arm and 5'-terminus of this base sequence : 42645120
  Distance between 3'-terminus of neighbour sequence of sequence listing upward to telomere on chrosomal short arm and 5'-terminus of this base sequence : 46286
gcttgctgaactcacctgcagattttggacttgccagcccccacaatcacataaggcaattccttaaaataaatcactcatatatgtatacacacacacacacacacacacacacacacacacacacaaaggaagtgggtgattttccagaaaaatatgtcatagatagatgatagatagatagatagatagatagatagatagatagggccgggcgcagtggctcatgcctgtattctgagcactttgggaggc

SEQ ID NO: 25293 - DNA, 232 bp, Homo sapiens
  DISO7_10004535
  Located on chromosome 21
  Distance between a terminus base of telomere on chromosomal short arm and 5'-terminus of this base sequence : 42851225
  Distance between 3'-terminus of neighbour sequence of sequence listing upward to telomere on chrosomal short arm and 5'-terminus of this base sequence : 205850
aatagagactaggtctcgctacgttgccaaggctatggtgagccaagatcacaccactgcactccagcctgggtgacagagtaagatcctgtcagaaagaaagaaaggaagaaggaagggagggagggagggaaggaaggaaggaaggaaggaaggaaggaaggaaggaaggaaggaaggaaggaaggaaaaagaaaagaaaaaataaaaactgaactcacatgagaaccac

SEQ ID NO: 25294 - DNA, 311 bp, Homo sapiens
  chr21.fa.O7frz.43333725
  Located on chromosome 21
  Distance between a terminus base of telomere on chromosomal short arm and 5'-terminus of this base sequence : 43046778
  Distance between 3'-terminus of neighbour sequence of sequence listing upward to telomere on chrosomal short arm and 5'-terminus of this base sequence : 195321
tattgtgagatacctttcttgaacatggacacatatataagagaataattttaattgcatgtccatgtaactctcacccaggttaaatagacactgtgtacctcacagtttccttcatgctcctccctgatgataactccccctcatccatatgacacatctaatatatactacgtgtgtgtgtgtgtgtgtgtgtataattaattataattattattattttgagacaatgttttgctctgtggcccaggccagaatgcagtggtgtgatcacagttctctgcagtctcaacttcctaggcataggtgat

SEQ ID NO: 25295 - DNA, 198 bp, Homo sapiens
  D21S1897
  Located on chromosome 21
  Distance between a terminus base of telomere on chromosomal short arm and 5'-terminus of this base sequence : 43048402
  Distance between 3'-terminus of neighbour sequence of sequence listing upward to telomere on chrosomal short arm and 5'-terminus of this base sequence : 1313
cctgagttagtgttaataagttgtatttcttttctttttaaatggtgatgtgtgtgtgtgtgtgtgtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctc

SEQ ID NO: 25296 - DNA, 215 bp, Homo sapiens
  chr21.fa.O7frz.43435582
  Located on chromosome 21
  Distance between a terminus base of telomere on chromosomal short arm and 5'-terminus of this base sequence : 43148514
  Distance between 3'-terminus of neighbour sequence of sequence listing upward to telomere on chrosomal short arm and 5'-terminus of this base sequence : 99914
tttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattcca

SEQ ID NO: 25297 - DNA, 438 bp, Homo sapiens
  AL163302.1_10513
  Located on chromosome 21
  Distance between a terminus base of telomere on chromosomal short arm and 5'-terminus of this base sequence : 43235177
  Distance between 3'-terminus of neighbour sequence of sequence listing upward to telomere on chrosomal short arm and 5'-terminus of this base sequence : 86448
tttcttaggcatgtccattaacgcagcttgtccttcttcgctttttaaaatagactttactttttagggaaggtttaggttcacagtaaaatcaagcaggcagtacagagttcccatgcaccctctgctccaccacaaacatgcagcctccctcaccatcaacacccacaccagagtggcccaggaaaacgtgtacacatgtgtacacacacacacacacacacacacacacacacacagcatgtccacaggtggaggtgtgtggggaggatgttccgggcccagtgacagcacgaacacatgaacccatccatccatccatccatccatccatccattcatccatccatccatccatccaccaatcctcttggctctgcttctctggagagcactgtgcacacagatgcacacagatatcttcacttggtcttcaac

SEQ ID NO: 25298 - DNA, 237 bp, Homo sapiens
  AL133493.1_120316
  Located on chromosome 21
  Distance between a terminus base of telomere on chromosomal short arm and 5'-terminus of this base sequence : 43520097
  Distance between 3'-terminus of neighbour sequence of sequence listing upward to telomere on chrosomal short arm and 5'-terminus of this base sequence : 284482
caaccagatctaacgataactcactatcatgagaacagcaccaagaagctggcgctaacccacttgtgaaggaccaccaccatgatccaatcccttcccaccaggtcccacttccaacgttggggattacacttcacggtgagatttgtgcagagaggacacaggtccaaaccatatcacctgctgtctttttatttatttatttatttatttatttattgagacagagttgcttcg

SEQ ID NO: 25299 - DNA, 430 bp, Homo sapiens
  AL133493.1_102395
  Located on chromosome 21
  Distance between a terminus base of telomere on chromosomal short arm and 5'-terminus of this base sequence : 43537500
  Distance between 3'-terminus of neighbour sequence of sequence listing upward to telomere on chrosomal short arm and 5'-terminus of this base sequence : 17166
ttgtctagtggatgccattaagaaagtaaacaggggccgggcgtggtggctcacgcctgtaatcccagcactttgggaggccgaggcaggtggatcacctgaggttaggagttcgagaccagcctggccaacatggtgaaaccccgtctctactaaaatacaaacattagccgggtgtcttggtggatgcctataatcccagctacttgggaggctgaggcacaaaaatcacttgaacccgggaggcggaggctgcagtgagcccagatcatgccactgcacgccagcctgggcaacaaagcgagactttatctcaaaaatattaaaaaaaaagaaaagaaaagaaaagaaaagaaagtgaacagacacaccacggagtgcagggtggtgtttgcagtacgtgcagccgtggaggtcttacagaagtcct

SEQ ID NO: 25300 - DNA, 295 bp, Homo sapiens
  AL163303.1_2807
  Located on chromosome 21
  Distance between a terminus base of telomere on chromosomal short arm and 5'-terminus of this base sequence : 43566457
  Distance between 3'-terminus of neighbour sequence of sequence listing upward to telomere on chrosomal short arm and 5'-terminus of this base sequence : 28527
aaatacttgctcatgtattggaattgccccaacttaaacattagaataaatgctgtagattttggggcagctctgatgtctcagctctcatccctggtggcagtgactcagaggcaaggcgtcatgggcccgctgtccatggtgctgaatccgtgtcacctgtttctctctctctctctctctctctctctctttctctctctctctctctctctctctgtgtgtgtgtgtgtgtgtgtgtgtgtgtgtgtgtgtgttttggggcagggggagctcaaacttcctttccagtgta

SEQ ID NO: 25301 - DNA, 302 bp, Homo sapiens
  AL163303.1_26505
  Located on chromosome 21
  Distance between a terminus base of telomere on chromosomal short arm and 5'-terminus of this base sequence : 43590258
  Distance between 3'-terminus of neighbour sequence of sequence listing upward to telomere on chrosomal short arm and 5'-terminus of this base sequence : 23506
actggcttatttaatgtagcgtactgtcttcagggttcatccatgttgtagcatgtgttggaatttcttccctttttaagactgaataatattccattgtgtgtgtgtgtgtgtgtatatatatatatatatatatatatatatatatatatatatcacattttgtttattcattctttgatggacacttgggttgcatctaccttttggctatagtgaataatgctgccatgaacttgggtatacaaatatttgagtcccttgcttttacttaatttgtgcctatacctagaaatggaatt

SEQ ID NO: 25302 - DNA, 246 bp, Homo sapiens
  chr21.fa.O7frz.43958346
  Located on chromosome 21
  Distance between a terminus base of telomere on chromosomal short arm and 5'-terminus of this base sequence : 43671334
  Distance between 3'-terminus of neighbour sequence of sequence listing upward to telomere on chrosomal short arm and 5'-terminus of this base sequence : 80774
taggcttattgctgtcgagtgtctttgcttctaaccctgttaggggtcagagctgggaaatacgtgcatgtacacatacacacctctgtgtaagcatacatacatgtaagtgtgtgtgtgtgtgtgtgtgtatatatatatatgcacatatacatgcatatatgtgcgtgtataaaacagacaagtcccacaatgtcctttctcttcctgttatccccaccccttgtacatgacagtgatgttcta

SEQ ID NO: 25303 - DNA, 381 bp, Homo sapiens
  AL163303.1_336908
  Located on chromosome 21
  Distance between a terminus base of telomere on chromosomal short arm and 5'-terminus of this base sequence : 43900264
  Distance between 3'-terminus of neighbour sequence of sequence listing upward to telomere on chrosomal short arm and 5'-terminus of this base sequence : 228684
tacagtaagtgtacaaggccaggcacggtggctcatgcctgtaatcccagcactttcggaggccgaggcaggaggaccacttgagtccaggagttcgagaccagcctgggcaacatcgtgagacccccatctctacaaaacatacaaaattagctgggtatggtggcacatgcctgtgatcccagctactcgggaggctgaggtggagggatcacctgaacccaggagactgaggctgcagtgagctgtgatgaggccactacgttccagcctggatgacagagtgagccccttagataataataataataataaggaggaggaggaggaggaggaggaggaaaagaaggagaagtactttacaacttctgtaacgtaggt

SEQ ID NO: 25304 - DNA, 114 bp, Homo sapiens
  DISO7_10004536
  Located on chromosome 21
  Distance between a terminus base of telomere on chromosomal short arm and 5'-terminus of this base sequence : 44179081
  Distance between 3'-terminus of neighbour sequence of sequence listing upward to telomere on chrosomal short arm and 5'-terminus of this base sequence : 278436
atacagagtagccaccacgtcccaatctaactcctgacttttccccttatattgtatgtgtgtgtgtgtgtgtgtgtaatcaagtatttctgaaatgcagtataatccaattag

SEQ ID NO: 25305 - DNA, 271 bp, Homo sapiens
  AP001760.1_59926
  Located on chromosome 21
  Distance between a terminus base of telomere on chromosomal short arm and 5'-terminus of this base sequence : 44301507
  Distance between 3'-terminus of neighbour sequence of sequence listing upward to telomere on chrosomal short arm and 5'-terminus of this base sequence : 122312
acagaggttgtagtgagctgagatcacaccactgcattccagcctgggtgacagagaagagtccttccaaaaaaaaaaaaaaaaaatctctgtgtgtgtgtgtgtgtgtgtgtgtgtgtgtgtgtgtgtgtgtgtgtgtatagaattcatctattgaaccttatttaaaaggttttgttatttagaaagaaggtttaatcttttaaaagggaaggaacctaggtttccaaatatcttgggttttcatggctgtaattccttgatggtgaac

SEQ ID NO: 25306 - DNA, 379 bp, Homo sapiens
  AP001760.1_204591
  Located on chromosome 21
  Distance between a terminus base of telomere on chromosomal short arm and 5'-terminus of this base sequence : 44446163
  Distance between 3'-terminus of neighbour sequence of sequence listing upward to telomere on chrosomal short arm and 5'-terminus of this base sequence : 144385
atttctggatccactttagaatgagcttatcaggtgtcacagtatacctactgagattattagcattactttgagtcttaagagaattaacacctttgcattattattattattattattattattattattattattattattattattattattattttgagatggagtttcgctcttgttgcccgggctggagtgcaatggcacaatctcagctcactgcaacctctgcctcccgggttcaagtgattcttctgcctcagtctcctgagtagctgggattacaggcgcctgccaccacacccggctaattttttttatttttagtagagatggggtttcaccatgttggccaggctggtctcgaactccagacctc

SEQ ID NO: 25307 - DNA, 339 bp, Homo sapiens
  chr21.fa.O7frz.44825268
  Located on chromosome 21
  Distance between a terminus base of telomere on chromosomal short arm and 5'-terminus of this base sequence : 44538071
  Distance between 3'-terminus of neighbour sequence of sequence listing upward to telomere on chrosomal short arm and 5'-terminus of this base sequence : 91529
tgtacgatacgtaatacttgacaatgatcataaatgaccatcttactggtttatgtatttactatacaatacattttattattttagatggtactctttctatctatctatctatctatctatctatctatctatctatctatcatctatctatctatctatgtaaagttagttaacagttagttaccagtaaaatagcctcgagcaggtcctttgggacatattctagaacaaggtgccgttatcatagagaatgacagctccatatgtctcattgtccttgaagaccttccagggggaaaagatgtgatgtagaggtggaagacagtgatattgatg

SEQ ID NO: 25308 - DNA, 256 bp, Homo sapiens
  M22_13336565
  Located on chromosome 22
  Distance between a terminus base of telomere on chromosomal short arm and 5'-terminus of this base sequence : 13336435
  Distance between 3'-terminus of neighbour sequence of sequence listing upward to telomere on chrosomal short arm and 5'-terminus of this base sequence : 0
actctatgttcttccctggatccagaccctaactcaggggacagcggcaccgcctcctgcccggctctcggctgcctgcactgctcgtcatggtgacaggatggcctgccccagatgagtgtcagtgtgcgtgtgtgtgtgtgtgtgtgtgtgtgtgtgtgtgtgcttttgctgcatttcttctgtcttgcttttgtcatctctctttctccctttcctccctgaggcctgcacagggcagctgtgctatccactt

SEQ ID NO: 25309 - DNA, 474 bp, Homo sapiens
  M22_13529347
  Located on chromosome 22
  Distance between a terminus base of telomere on chromosomal short arm and 5'-terminus of this base sequence : 13528994
  Distance between 3'-terminus of neighbour sequence of sequence listing upward to telomere on chrosomal short arm and 5'-terminus of this base sequence : 192303
aagacagagattattctattccagcagctaaaatagagtctagctcttaacagatactattaaatatttagtcctagtgtggtggctcacgcttataatcccaacactttgggaggccgaggtgggtggatcatgaggtcaggagactgagaccaacctggctaacatgatgaaaccctgtctctactaaaaatacaaaaaattagccaggcatggtggtgggtgcctgtagtcccagtacttgggaggctgaggcaggagaatgctgtgaacccgggaggtggaggttgcagtgagccaagattgctccactgcactccagcctgggtgacagtgtgagactccatcacaagaataaataaataaataaataaataaataaataaataaataaataaataaaataaaaagataccattaaatatttaacaaattaattgactataaactagcatctatccattctattcattc

SEQ ID NO: 25310 - DNA, 421 bp, Homo sapiens
  AP000536.1_4323
  Located on chromosome 22
  Distance between a terminus base of telomere on chromosomal short arm and 5'-terminus of this base sequence : 13531910
  Distance between 3'-terminus of neighbour sequence of sequence listing upward to telomere on chrosomal short arm and 5'-terminus of this base sequence : 2442
ctggacaacatggaatgattacatctctacaaaaattagctggacgtagtggcacatacctgtggtcctagctactcaggaggctgaggtgagagaatcacttgagcccagaaagttaagactgctaggagccgtgattacaccactgcactcctggcttgggcaatgaagcacaactgtgtctcaaaacacacacacacacacacacacacacacacacaaacaaagaaacaaaaacctttgttaagccactcacacttcctgttcttcaatttgttttctctcttgagaaagggaaaccatcagcagaatctccatttctacataaggttacaaatatagtggaattcaatcaatagaaagatggatagtcttagaaaagttacttaaaacttaaatgtaggactatgacttcctttca

SEQ ID NO: 25311 - DNA, 207 bp, Homo sapiens
  AP000536.1_16330
  Located on chromosome 22
  Distance between a terminus base of telomere on chromosomal short arm and 5'-terminus of this base sequence : 13544030
  Distance between 3'-terminus of neighbour sequence of sequence listing upward to telomere on chrosomal short arm and 5'-terminus of this base sequence : 11699
accatcctgtgaaccagtaagaaagacatacttgtgttctttattaggtatagaacacagaaaaatccccgaaatacacacacacacacacacacacacacacacacatgcacaaatctgttaaatgtcctgtttagtttctggatacaagtttttgagctttagttttcctaatctttaaaaagagttaatattagtcggacagcg

SEQ ID NO: 25312 - DNA, 138 bp, Homo sapiens
  DISD22_0001515
  Located on chromosome 22
  Distance between a terminus base of telomere on chromosomal short arm and 5'-terminus of this base sequence : 14124401
  Distance between 3'-terminus of neighbour sequence of sequence listing upward to telomere on chrosomal short arm and 5'-terminus of this base sequence : 580164
tttgagaatcttccttgcctatattttcctgagatgttggtttttctttgtcacagataacaatgctcattccctccccattaaaaactaaatatatatatatatatatatatgattaaacgattactacatgtgctt

SEQ ID NO: 25313 - DNA, 331 bp, Homo sapiens
  chr18.fa.O7frz.15506859
  Located on chromosome 22
  Distance between a terminus base of telomere on chromosomal short arm and 5'-terminus of this base sequence : 14194807
  Distance between 3'-terminus of neighbour sequence of sequence listing upward to telomere on chrosomal short arm and 5'-terminus of this base sequence : 70268
atgacataatgcaatcacagttcaaatccaagcgggtattttgtagaaattgacaattgattttaagactttcatggcatgtagatgacacagaaatgcgcagtaactctgaaaaaaacaaaagaataaatttagaggaaaaatacaacccagtttgaagaattattacaaagctacaaaaatcataacagtgtgattttggcataaagatatagagatcagtagaacagaacagagtccagaaaccaagtatacataaaacacatacacactctctctctctctcttaaaatatgactggtcaagtgactgcttatgaactgtaattgct

SEQ ID NO: 25314 - DNA, 353 bp, Homo sapiens
  AP002414.1_163232
  Located on chromosome 22
  Distance between a terminus base of telomere on chromosomal short arm and 5'-terminus of this base sequence : 14194807
  Distance between 3'-terminus of neighbour sequence of sequence listing upward to telomere on chrosomal short arm and 5'-terminus of this base sequence : -331
atgacataatgcaatcacagttcaaatccaagcgggtattttgtagaaattgacaattgattttaagactttcatggcatgtagatgacacagaaatgcgcagtaactctgaaaaaaacaaaagaataaatttagaggaaaaatacaacccagtttgaagaattattacaaagctacaaaaatcataacagtgtgattttggcataaagatatagagatcagtagaacagaacagagtccagaaaccaagtatacataaaacacatacacactctctctctctctcttaaaatatgactggtcaagtgactgcttatgaactgtaattgcttgatacatgagtctagcatctc

SEQ ID NO: 25315 - DNA, 341 bp, Homo sapiens
  AC005301.22_5043
  Located on chromosome 22
  Distance between a terminus base of telomere on chromosomal short arm and 5'-terminus of this base sequence : 14213182
  Distance between 3'-terminus of neighbour sequence of sequence listing upward to telomere on chrosomal short arm and 5'-terminus of this base sequence : 18022
gaggtattacctcatacgtgctagaatggccattatcaaacacacacacacacacacacacacacacacacaccaggaaataccaagtgttaacaagaatgtgaagaaactgaaacccttgtgcattgatggtaggaatgtaaagtggtgtagccactacagaaaacggtaagaaggttcctcagaaaattaaaactggtattagcatatgaccccgcaatcccacttctgggtattcatccaaaagcattgaaatcaggatctcaaaaagatacttacacttccacgttcactgcaacattattcacaatagccaagagttagaaacaatccaaatgcac

SEQ ID NO: 25316 - DNA, 243 bp, Homo sapiens
  AC005301.22_108895
  Located on chromosome 22
  Distance between a terminus base of telomere on chromosomal short arm and 5'-terminus of this base sequence : 14316950
  Distance between 3'-terminus of neighbour sequence of sequence listing upward to telomere on chrosomal short arm and 5'-terminus of this base sequence : 103427
tacaatgtaacctgtcgatgtaaaaaaaaaatagagaaagaaaggaggcaggggggagagagagagggagagagggagaaagagggagagagagggagagagagggagagagggagagagagggagagagagagagagagagagagagagagagagaaagagagagagagagagagagactgactctgagactaaaggggaaaaacagccacaccataaaattgtattacactgaccactggt

SEQ ID NO: 25317 - DNA, 322 bp, Homo sapiens
  AC007064.27_66627
  Located on chromosome 22
  Distance between a terminus base of telomere on chromosomal short arm and 5'-terminus of this base sequence : 14352146
  Distance between 3'-terminus of neighbour sequence of sequence listing upward to telomere on chrosomal short arm and 5'-terminus of this base sequence : 34953
ctcgcaccaatctagtaagactgtgtgtgtcaaggagaaaattatgtttatttcagggattgaggatattaattaatttatttatttatttatttattattttcttaagacagagtcttgctctgttgcccaggctggagtgcagtggcacaacctcagctcactgcagctttcgcctcctgggttcaaacgattcttctgcctcagcctcccgagacctgggactacaggcacatggaccacacctggctaatttttgtatttttagtagagacagggtgtcaccatggtggtcaggctggtctcgaactcatgacctcat

SEQ ID NO: 25318 - DNA, 250 bp, Homo sapiens
  AC006946.20_86451
  Located on chromosome 22
  Distance between a terminus base of telomere on chromosomal short arm and 5'-terminus of this base sequence : 14592167
  Distance between 3'-terminus of neighbour sequence of sequence listing upward to telomere on chrosomal short arm and 5'-terminus of this base sequence : 239699
tgtttactggttccagaaagagagagagagagagagagagagagagagagagagagaggaaggaaggaaggaaggaaggaaggaagggaaggaaggagagaaagaaggaaggaaggcaagaaagaaaagaaagaaaacggggaaggggaaaggaagagggaaggaagggagggagggaaggaagaaggaaagagccttggcagggacctggcatacaggggcttaggctgtaaactgaataacgccagga

SEQ ID NO: 25319 - DNA, 288 bp, Homo sapiens
  AC005399.19_18036
  Located on chromosome 22
  Distance between a terminus base of telomere on chromosomal short arm and 5'-terminus of this base sequence : 14747290
  Distance between 3'-terminus of neighbour sequence of sequence listing upward to telomere on chrosomal short arm and 5'-terminus of this base sequence : 154873
gtatagcagagttaccagtggtttaaagtgctgcatatatgattgttatatgaggtaaataagattctctgacccagagttaagaaaatggaaataataattgctaaggcatattaagaattatatatgtatgtgtgtgtgtatatatatatatatatatatatatatatatatatatatatatatataacatttaatccctacagcaatacatacctataaatgagtatatacaaatatgtgtgtgtatgtgtgtgtgtgtatatatactcatttaatccttgcagc

SEQ ID NO: 25320 - DNA, 173 bp, Homo sapiens
  Z23643.1_75
  Located on chromosome 22
  Distance between a terminus base of telomere on chromosomal short arm and 5'-terminus of this base sequence : 14903501
  Distance between 3'-terminus of neighbour sequence of sequence listing upward to telomere on chrosomal short arm and 5'-terminus of this base sequence : 155923
gacagatctcttgagcattgagcagtggtgtactggggagggcgttatccatgaccaggtcaaaagttcagtgggacctacgttgaaggtgtgtgtgtgtgtgtgtgtgtgtgtgtgtgtgtgtgtgtgtgtttgcgatatatgcatatgtaaagttcattattccgtcagaa

SEQ ID NO: 25321 - DNA, 152 bp, Homo sapiens
  D22S420
  Located on chromosome 22
  Distance between a terminus base of telomere on chromosomal short arm and 5'-terminus of this base sequence : 14903538
  Distance between 3'-terminus of neighbour sequence of sequence listing upward to telomere on chrosomal short arm and 5'-terminus of this base sequence : -136
gagggcgttatccatgaccaggtcaaaagttcagtgggacctacgttgaaggtgtgtgtgtgtgtgtgtgtgtgtgtgtgtgtgtgtgtgtgtgtttgcgatatatgcatatgtaaagttcattattccgtcagaattttcagtgtagaaca

SEQ ID NO: 25322 - DNA, 217 bp, Homo sapiens
  DISO7_10008808
  Located on chromosome 22
  Distance between a terminus base of telomere on chromosomal short arm and 5'-terminus of this base sequence : 15152762
  Distance between 3'-terminus of neighbour sequence of sequence listing upward to telomere on chrosomal short arm and 5'-terminus of this base sequence : 249072
tgtgctatggttacccaccatttttattagctttttatcttgaagaaatttgagatatagtaacttgtaagaatactgcattgacctcccttcacctagattcaacaattgttaacattttgctacatgtacattaacactttattttcatacacacacacacacacacacacacacacacttcctattttagtgtgtcataagaacgaggatgtag

SEQ ID NO: 25323 - DNA, 345 bp, Homo sapiens
  AC016026.13_111154
  Located on chromosome 22
  Distance between a terminus base of telomere on chromosomal short arm and 5'-terminus of this base sequence : 15389643
  Distance between 3'-terminus of neighbour sequence of sequence listing upward to telomere on chrosomal short arm and 5'-terminus of this base sequence : 236664
aatactgcaatggactatgagtaggatggaagggaacagcatagaacagaacagaatagaatagaatagaatagaatagaatagaatagaatagaatagaatagaatatagaatagaatagaatagaatccagagtgtactgtggcatgatgagaataaaacgttatttcttggaacttgcagctgtgtctgggtctcaatgtaacgtgcatccccgtggggggtgtcgtcagaaaaatctgaacaccactgaacttggcttttcccatgactctggtaatggaattaacccacgcagtcatttttttctgactcttttttactctcacttaaagagcgactgac

SEQ ID NO: 25324 - DNA, 328 bp, Homo sapiens
  AC016027.15_43221
  Located on chromosome 22
  Distance between a terminus base of telomere on chromosomal short arm and 5'-terminus of this base sequence : 15505698
  Distance between 3'-terminus of neighbour sequence of sequence listing upward to telomere on chrosomal short arm and 5'-terminus of this base sequence : 115710
gccaagattgtaccactgtactccagcctgggcgacagagtaagacttcatctcaaaaaaattcataacataacataacataacataacataacataacaaacataacataacataaaaataaaataaaataaaataaaaaagtaaaataaagtaaaataaaataaaataaaataaaataaaaaagttttaatacattctccctgaggtacttcttccacagaaacacttaggtagcagggaagcgcattttaaatccttcaacagtctgactgggtttagcaccctgggtggcgttagtcacagggtattccttaaagcttgtgagc

SEQ ID NO: 25325 - DNA, 313 bp, Homo sapiens
  AC016027.15_106772
  Located on chromosome 22
  Distance between a terminus base of telomere on chromosomal short arm and 5'-terminus of this base sequence : 15569076
  Distance between 3'-terminus of neighbour sequence of sequence listing upward to telomere on chrosomal short arm and 5'-terminus of this base sequence : 63050
ttaactatgaaaacattggcagtattttaatgggtacatttagtacacccaatgggttattttttgaggtgtcagattcaggttttgtcttctcacaaggcatccatttgacaagtagcctctgcctaatgtttttattgggtaacagtgatatcgatgtagcctttgctacttgtcaaatgtcactgacacccaatgaaaacatcagacttttaacattggctgccattttcattcaagacaatgaatgaaacccacatcaaaattaatattattattattattatttttgagatggagtttcactcttgtt

SEQ ID NO: 25326 - DNA, 424 bp, Homo sapiens
  AC016830.5_146408
  Located on chromosome 22
  Distance between a terminus base of telomere on chromosomal short arm and 5'-terminus of this base sequence : 15603987
  Distance between 3'-terminus of neighbour sequence of sequence listing upward to telomere on chrosomal short arm and 5'-terminus of this base sequence : 34598
gttctaccgtctgcttctatgatatcaacttttttttttttttaaagattcacatgagtgaaatcatgtagtatttatctttctgtgcctggcttatttcacttaacatgatgtcccccaggtccacctgtgttgtcatgaatgacaagatttcattcttttttatggctatatagtattccattatatatatatatatatatatatatgcgtgtgtgtatatatatacacatatataaacacatatatacacataatatacatatatgtacacatatacacacacacacacacacacacacacacacacacattatccattcatctgttgttggacacttaggttgattccatatcttggctgttgtgaatagtgctgcattaaacaggggagataatggattgctagatcatgtggtagttc

SEQ ID NO: 25327 - DNA, 102 bp, Homo sapiens
  D22S427
  Located on chromosome 22
  Distance between a terminus base of telomere on chromosomal short arm and 5'-terminus of this base sequence : 15631629
  Distance between 3'-terminus of neighbour sequence of sequence listing upward to telomere on chrosomal short arm and 5'-terminus of this base sequence : 27218
tgctgttttgtagagtgtttagacacacacacacacacacacacacacacacacacacacccctatactccaaactagaaagtgataaatacggctgggcac

SEQ ID NO: 25328 - DNA, 212 bp, Homo sapiens
  M22_15918113
  Located on chromosome 22
  Distance between a terminus base of telomere on chromosomal short arm and 5'-terminus of this base sequence : 15918025
  Distance between 3'-terminus of neighbour sequence of sequence listing upward to telomere on chrosomal short arm and 5'-terminus of this base sequence : 286294
atagactttgccacattctcccttagggaataacttaatctgtagggtgggggatggaacgttgaaggatgcagatgtaaaaggaaattatatatatatatatatatatataatatatatacgtatatattatgaagatatatgtatatatattatatataattatatatataatatatatataatttgggaatttgggaataaattgtatc

SEQ ID NO: 25329 - DNA, 109 bp, Homo sapiens
  DISO7_10435104
  Located on chromosome 22
  Distance between a terminus base of telomere on chromosomal short arm and 5'-terminus of this base sequence : 16090479
  Distance between 3'-terminus of neighbour sequence of sequence listing upward to telomere on chrosomal short arm and 5'-terminus of this base sequence : 172242
ggtatttccaagcagctccgcataaaatctttgcgcacacacacacatgcatgctcactctctctctctctctctctctctctctatctgcctgatagtttccttcagg

SEQ ID NO: 25330 - DNA, 377 bp, Homo sapiens
  AC000079.1_17708
  Located on chromosome 22
  Distance between a terminus base of telomere on chromosomal short arm and 5'-terminus of this base sequence : 16441200
  Distance between 3'-terminus of neighbour sequence of sequence listing upward to telomere on chrosomal short arm and 5'-terminus of this base sequence : 350612
ctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggat

SEQ ID NO: 25331 - DNA, 232 bp, Homo sapiens
  AC000087.2_35333
  Located on chromosome 22
  Distance between a terminus base of telomere on chromosomal short arm and 5'-terminus of this base sequence : 16520948
  Distance between 3'-terminus of neighbour sequence of sequence listing upward to telomere on chrosomal short arm and 5'-terminus of this base sequence : 79371
tcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtt

SEQ ID NO: 25332 - DNA, 323 bp, Homo sapiens
  AC002475.2_1867
  Located on chromosome 22
  Distance between a terminus base of telomere on chromosomal short arm and 5'-terminus of this base sequence : 16689092
  Distance between 3'-terminus of neighbour sequence of sequence listing upward to telomere on chrosomal short arm and 5'-terminus of this base sequence : 167912
gagtgtctgagtctccatacagacagtcagatcactggtatgttgtgggggtgcagttggggaaatgaggaaactccaggcatcagggggccccatttgagatgtaccatccagagtgtgagaattctaatgagtaggcaggggccataaggaccattttcttcctccctcccttccttccttccttccttccttccttccttccttccttccttccttccttcttccctccctcccgccctcccttctttccttcctttttcgtttttgaaatagggtctcactctgtcacccaagctggagtgcagtgacacaatcatagc

SEQ ID NO: 25333 - DNA, 166 bp, Homo sapiens
  DISO7_10445100
  Located on chromosome 22
  Distance between a terminus base of telomere on chromosomal short arm and 5'-terminus of this base sequence : 16772751
  Distance between 3'-terminus of neighbour sequence of sequence listing upward to telomere on chrosomal short arm and 5'-terminus of this base sequence : 83336
tcagctgggctagttgaagagttttgtgagggtttttgtttgtttgtttgtttgtttgtttttgcgggaggggtggaacaaggaccagcatgcagggcaagatgaggcctgagggtggaggggacagaagagccctgccgggacaagggacacagggacatcggtt

SEQ ID NO: 25334 - DNA, 156 bp, Homo sapiens
  DISO7_10445102
  Located on chromosome 22
  Distance between a terminus base of telomere on chromosomal short arm and 5'-terminus of this base sequence : 17278596
  Distance between 3'-terminus of neighbour sequence of sequence listing upward to telomere on chrosomal short arm and 5'-terminus of this base sequence : 505679
gacaacctaacacaaataagttgggaggggtggctcacacctcagcctcctgagtagctgggattacacacacacacatgcatgcacacacacacacacacatacacacaaagagaacaaaatggttgtaaggagagggggacagcagaggaagtg

SEQ ID NO: 25335 - DNA, 221 bp, Homo sapiens
  AC005500.2_70377
  Located on chromosome 22
  Distance between a terminus base of telomere on chromosomal short arm and 5'-terminus of this base sequence : 17575108
  Distance between 3'-terminus of neighbour sequence of sequence listing upward to telomere on chrosomal short arm and 5'-terminus of this base sequence : 296356
cctggccaaataagtaatttaagcaattttttttgtttcagaaaaaaaattaactcataaaggagcccccccgacacacacacacacacacacacacacacacacacacacacacacacgggaagcagcagtgtaattggaatgcccactgctgaggctctcgaatgagtgtcatgtgtgcacattttgcccctcacaatgcacgtcagactattaatagg

SEQ ID NO: 25336 - DNA, 408 bp, Homo sapiens
  AC004033.3_103840
  Located on chromosome 22
  Distance between a terminus base of telomere on chromosomal short arm and 5'-terminus of this base sequence : 17722630
  Distance between 3'-terminus of neighbour sequence of sequence listing upward to telomere on chrosomal short arm and 5'-terminus of this base sequence : 147301
gcagatgagtgataaccgagtgctgcttgttctgtctctagatacagcagcagcaacagcagctgcagcgaatagcacagctgcagctccaacaacagcaacagcagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtgagtacctgtg

SEQ ID NO: 25337 - DNA, 226 bp, Homo sapiens
  AC002470.17_60447
  Located on chromosome 22
  Distance between a terminus base of telomere on chromosomal short arm and 5'-terminus of this base sequence : 17977686
  Distance between 3'-terminus of neighbour sequence of sequence listing upward to telomere on chrosomal short arm and 5'-terminus of this base sequence : 254648
taaatgtttcctgagccaatagctagtgtgagataacaaagcctctcaacatgacagattcaattttttattccctaagtaaatgtgataaatcacacacacacacacacacacacacacacacacacacacacacacaaaacactcggctgggcgaagtggctcaagtctgtaatcccagcacttttggggggccaaggcagacggatcacctgaggtcgagttc

SEQ ID NO: 25338 - DNA, 346 bp, Homo sapiens
  AC002470.17_71764
  Located on chromosome 22
  Distance between a terminus base of telomere on chromosomal short arm and 5'-terminus of this base sequence : 17988993
  Distance between 3'-terminus of neighbour sequence of sequence listing upward to telomere on chrosomal short arm and 5'-terminus of this base sequence : 11081
gcatgataatggcataagtaaacccaggaggcggagcttgcagtgagcctagatggcaccactgcactccagcctgggcgacagagagagactccatttcaaaaaaacaaaacaaaacaaaacaaaacaaaacaaaacaaaacaaaaaacaacaaaaaaacatggcagaaggcatgcagcttccacctggctctttttcaggacatttgccctggaacctagacactatgctgtgataagacccatgaatgagacttcaggtgattcctgcccccagcttttgagccaccccaaccgatgctaaatggagtcagttgagccctgtctaaattgcagattcacgaat

SEQ ID NO: 25339 - DNA, 170 bp, Homo sapiens
  AC002470.17_124001
  Located on chromosome 22
  Distance between a terminus base of telomere on chromosomal short arm and 5'-terminus of this base sequence : 18041237
  Distance between 3'-terminus of neighbour sequence of sequence listing upward to telomere on chrosomal short arm and 5'-terminus of this base sequence : 51898
taagccttaccatgagtcagagtgttaagggggcctgtgagccagtcgtttggtggaggagggtccttcccacacctttgtttaggagtcatcattcacacacacacacacacacacacacacacacacacacacactctgagcacattatctgtgattctttcatcctc

SEQ ID NO: 25340 - DNA, 387 bp, Homo sapiens
  AC002470.17_222055
  Located on chromosome 22
  Distance between a terminus base of telomere on chromosomal short arm and 5'-terminus of this base sequence : 18139321
  Distance between 3'-terminus of neighbour sequence of sequence listing upward to telomere on chrosomal short arm and 5'-terminus of this base sequence : 97914
aaagctaggagttcaagaccagctgggcaacaaagtgagaccctgtctaggaagatagatagacagatgatagatagatagatagatagatagatagatagatagatagatagaaaaaaagatagatagatgatagaaagacaaagagagatgatagatagatagatgataggtagattagacagatagatgacagatagatagatagtggatagatgatagatgacagatcgatagatagatgataggtagatgataggtaggtagattagatagatgatgggtagatagatgacagacaatagatgatagatgataggtagatagatgatagatgacagatagatgatggatagattatataggtagatgataggtggatagatg

SEQ ID NO: 25341 - DNA, 228 bp, Homo sapiens
  AP000552.1_58316
  Located on chromosome 22
  Distance between a terminus base of telomere on chromosomal short arm and 5'-terminus of this base sequence : 18471413
  Distance between 3'-terminus of neighbour sequence of sequence listing upward to telomere on chrosomal short arm and 5'-terminus of this base sequence : 331705
gaatgaacattatgcaaatgtagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatgtatttatttatttatttatttattttgagatgaagtttcactcttgtcacc

SEQ ID NO: 25342 - DNA, 311 bp, Homo sapiens
  AP000553.1_60609
  Located on chromosome 22
  Distance between a terminus base of telomere on chromosomal short arm and 5'-terminus of this base sequence : 18809342
  Distance between 3'-terminus of neighbour sequence of sequence listing upward to telomere on chrosomal short arm and 5'-terminus of this base sequence : 337701
agtgagactccgacaagaaagagagagagagagagggagggagggagggagagagagagagagagagagagagagagagagagagagagagaaagaaagaaaaaaagaaagaaaaaaaggcacatactatagattttaaagtttcattttgtaagtcacaccagggcaggaagtagaatagagatttgagcccaagtgtacctgacaagtctctctgcctgcactcctagacaagatgatcaggacagacctcattcttctttggttgtccccaggcaggaggaaataaatgtcacttcctatgttggaag

SEQ ID NO: 25343 - DNA, 309 bp, Homo sapiens
  AP000553.1_67391
  Located on chromosome 22
  Distance between a terminus base of telomere on chromosomal short arm and 5'-terminus of this base sequence : 18815923
  Distance between 3'-terminus of neighbour sequence of sequence listing upward to telomere on chrosomal short arm and 5'-terminus of this base sequence : 6270
tgagctcaggtattcaaattagccaggcatgttggtgcgcacctgtagtcccagctacttgggaggcgtgagtgggagaatctcttgagcccagagggtggaggcaggcacctgtagtcccagctactcgggaggctgaggcaggagaattgcttgaacccgggaggtggagcttgcagtgagccgagatcacgccactgtactccagcctgggcaacagtacgagactccatctcaaaaaataaaaagtaataataataataataataataataataataaatctttaagttcaccaataacaataga

SEQ ID NO: 25344 - DNA, 309 bp, Homo sapiens; identical to SEQ ID NO: 25343
  AC018751.30_47793
  Located on chromosome 22
  Distance between a terminus base of telomere on chromosomal short arm and 5'-terminus of this base sequence : 18815923
  Distance between 3'-terminus of neighbour sequence of sequence listing upward to telomere on chrosomal short arm and 5'-terminus of this base sequence : -309

SEQ ID NO: 25345 - DNA, 202 bp, Homo sapiens
  D22S446
  Located on chromosome 22
  Distance between a terminus base of telomere on chromosomal short arm and 5'-terminus of this base sequence : 18817851
  Distance between 3'-terminus of neighbour sequence of sequence listing upward to telomere on chrosomal short arm and 5'-terminus of this base sequence : 1619
ccggaactttggaaggccaaggcaggcgaatcaggaggtcaggagatcgagaccatcctggctaacatggtgaaaccccgtctctactaaacacacacacacacacacacacacacacacacacaaagtgctgggattacaggcgtgagccaccacgcccatccagacatgttacatttcagatcagtggttacccaagtgg

SEQ ID NO: 25346 - DNA, 179 bp, Homo sapiens
  AP000555.1_53297
  Located on chromosome 22
  Distance between a terminus base of telomere on chromosomal short arm and 5'-terminus of this base sequence : 18967769
  Distance between 3'-terminus of neighbour sequence of sequence listing upward to telomere on chrosomal short arm and 5'-terminus of this base sequence : 149716
gccactgtactccagctctgggcgacactgcaagactccatctcagggggaaaaaaagcgagagagacagagagagagagagagagagagagagagagagagagagagagagagagagagagagatgaagtctcactatgctgcccaggccggtcctgaactcctgagatcacttcctc

SEQ ID NO: 25347 - DNA, 266 bp, Homo sapiens
  D86997.1_10735
  Located on chromosome 22
  Distance between a terminus base of telomere on chromosomal short arm and 5'-terminus of this base sequence : 19273084
  Distance between 3'-terminus of neighbour sequence of sequence listing upward to telomere on chrosomal short arm and 5'-terminus of this base sequence : 305136
taacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacg

SEQ ID NO: 25348 - DNA, 392 bp, Homo sapiens
  D86996.1_19729
  Located on chromosome 22
  Distance between a terminus base of telomere on chromosomal short arm and 5'-terminus of this base sequence : 19358977
  Distance between 3'-terminus of neighbour sequence of sequence listing upward to telomere on chrosomal short arm and 5'-terminus of this base sequence : 85627
atcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggatt

SEQ ID NO: 25349 - DNA, 246 bp, Homo sapiens
  D87010.1_10448
  Located on chromosome 22
  Distance between a terminus base of telomere on chromosomal short arm and 5'-terminus of this base sequence : 19564718
  Distance between 3'-terminus of neighbour sequence of sequence listing upward to telomere on chrosomal short arm and 5'-terminus of this base sequence : 205349
taaggctgagtagcagtctacatatatatatatatatatatatatatatatatatataccacatttgcttcatccactcattgattgatgggcatttgggttggttctatgtttttgcaattgcaaattgtgctgctataaacatgagtgttcaagtaattttttcatgtaatgacttcttttcctcttggtagatacctagtagtgagattgctggatcaaatggtagatccagttctttaatga

SEQ ID NO: 25350 - DNA, 380 bp, Homo sapiens
  X71966.1_621
  Located on chromosome 22
  Distance between a terminus base of telomere on chromosomal short arm and 5'-terminus of this base sequence : 19853856
  Distance between 3'-terminus of neighbour sequence of sequence listing upward to telomere on chrosomal short arm and 5'-terminus of this base sequence : 288892
tcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagc

SEQ ID NO: 25351 - DNA, 204 bp, Homo sapiens
  D22S686
  Located on chromosome 22
  Distance between a terminus base of telomere on chromosomal short arm and 5'-terminus of this base sequence : 19867207
  Distance between 3'-terminus of neighbour sequence of sequence listing upward to telomere on chrosomal short arm and 5'-terminus of this base sequence : 12971
taagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaa

SEQ ID NO: 25352 - DNA, 268 bp, Homo sapiens
  AC002308.1_149769
  Located on chromosome 22
  Distance between a terminus base of telomere on chromosomal short arm and 5'-terminus of this base sequence : 19891386
  Distance between 3'-terminus of neighbour sequence of sequence listing upward to telomere on chrosomal short arm and 5'-terminus of this base sequence : 23975
tatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttagga

SEQ ID NO: 25353 - DNA, 443 bp, Homo sapiens
  D86998.1_13083
  Located on chromosome 22
  Distance between a terminus base of telomere on chromosomal short arm and 5'-terminus of this base sequence : 19916238
  Distance between 3'-terminus of neighbour sequence of sequence listing upward to telomere on chrosomal short arm and 5'-terminus of this base sequence : 24584
atctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcag

SEQ ID NO: 25354 - DNA, 420 bp, Homo sapiens
  D86998.1_17657
  Located on chromosome 22
  Distance between a terminus base of telomere on chromosomal short arm and 5'-terminus of this base sequence : 19920786
  Distance between 3'-terminus of neighbour sequence of sequence listing upward to telomere on chrosomal short arm and 5'-terminus of this base sequence : 4105
ttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaac

SEQ ID NO: 25355 - DNA, 200 bp, Homo sapiens
  AC002060.3_47792
  Located on chromosome 22
  Distance between a terminus base of telomere on chromosomal short arm and 5'-terminus of this base sequence : 20031120
  Distance between 3'-terminus of neighbour sequence of sequence listing upward to telomere on chrosomal short arm and 5'-terminus of this base sequence : 109914
cactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaacca

SEQ ID NO: 25356 - DNA, 367 bp, Homo sapiens
  HUMUT8144
  Located on chromosome 22
  Distance between a terminus base of telomere on chromosomal short arm and 5'-terminus of this base sequence : 20271227
  Distance between 3'-terminus of neighbour sequence of sequence listing upward to telomere on chrosomal short arm and 5'-terminus of this base sequence : 239907
ggctgaggcaggagaatggcatgaacccgggaggtggaggttgcagtgagctgagactgcaccagtgcactccagcctgggcgacagagtgagactctgtctcaaaaaaaaaagaaaaagaaaagagaaagaaagaaggaaagaaaaagaaagaaagaaagaaagaaagaaagaaagaaagagaaagaaggaaagaaggaaagaaagactgctgcaccagtgaatcaacaaaggcacagtgagaagccaagaaaacagcctggtttgaaatgatatttgcaatgtaggtaaccgacaaagggctggaatccaggataaattacacactccttcaaatcaataagaaatggaaaaacaactcggcaac

SEQ ID NO: 25357 - DNA, 370 bp, Homo sapiens
  U07000.1_41020
  Located on chromosome 22
  Distance between a terminus base of telomere on chromosomal short arm and 5'-terminus of this base sequence : 20347685
  Distance between 3'-terminus of neighbour sequence of sequence listing upward to telomere on chrosomal short arm and 5'-terminus of this base sequence : 76091
tccaagatccaaacatttatctatttatctatccacccatccatccaaccagtcatacaaccatccatttaactattctttattcatcatccatccaactaaatctattcatccctctgtcatccattcattcctccctccctccctccctccctccctccctccatccatccatccatcatctgtctaacatccagccaaccatccatccattcaacattgaactatccattattcactcatccatccaaacatgcatccattcagtcatcacctattcatccatccattcatcctccaaccattcatctgttcatttgaagttgatgtgacacctactggggtccaagcacaatgcttaggccttgac

SEQ ID NO: 25358 - DNA, 395 bp, Homo sapiens
  chr22.fa.O7frz.20414814
  Located on chromosome 22
  Distance between a terminus base of telomere on chromosomal short arm and 5'-terminus of this base sequence : 20564596
  Distance between 3'-terminus of neighbour sequence of sequence listing upward to telomere on chrosomal short arm and 5'-terminus of this base sequence : 216541
gacttcaattggcaacagaaaaaagacagggggctgggtgcagtgggctgcctgtaatcccagcactttgggaggctaaggctggagaatcacttgagcccagcagttcaagaccagactgggcaacacagagagagtttgtctctacacaaaatttaaaaattagtcaggtgtggtggtgtgggcctgtagtctcagctactcaggtggctgaggttggggagatggcctgggcccgggaggtcaaggttgcagtgagccgagatcatgccactctagccgggaggccacagagcaagacactgtctccaaaaataaataaataaataaataaagaagaatgggcaggagagaggagaaggctgggactaaggtttcatttcgcctttaaatag

SEQ ID NO: 25359 - DNA, 478 bp, Homo sapiens
  chr22.fa.O7frz.20508887
  Located on chromosome 22
  Distance between a terminus base of telomere on chromosomal short arm and 5'-terminus of this base sequence : 20658830
  Distance between 3'-terminus of neighbour sequence of sequence listing upward to telomere on chrosomal short arm and 5'-terminus of this base sequence : 93839
tcaagataggtgctcagtaaacactggacggacagatgggcagaaggaaggagagaatgaaaggaggaaaggagggaaggaatgggtagctgagtagattcatggatgggtggatgcatggcagcacgggagggaggatgagtgattgggaggatggatggatggatggatggatggatggatgaaaggaagtaagccaacatggatggaatgagtgatggaattgattgtcccctgcacctggaggcttccagtgactcagccacagaggtcaggaagctggagacatgagcaggcggctcaccccatggtcccctccccctccccacctgatattttcattaggacacatcttctgcaccaggcccctcagctcctgccctgcaaagctgcagatgcctctgctggctttattaaggccctattagcccagcagccccagggaaggctaaagatgctgtcactgcagacactggtt

SEQ ID NO: 25360 - DNA, 449 bp, Homo sapiens
  AP000346.1_73508
  Located on chromosome 22
  Distance between a terminus base of telomere on chromosomal short arm and 5'-terminus of this base sequence : 20731021
  Distance between 3'-terminus of neighbour sequence of sequence listing upward to telomere on chrosomal short arm and 5'-terminus of this base sequence : 71713
gaggcttcaagctttaagataagacttccagccaggtggctcacacctgtaatcccagcactttgggagcctgaggcaggcagatcacctgaggtcaggagtttgagaccagcctggccaacatggtgaaaccctgtctctattaaaaatacacacacacacacacacacacacacacacacacacacacacacaaaattagctggcatgatggcacacacctgtaatcccagctactcgggaggctgaggcaggagaattccttgaacccgggaggtggaggttgcagtgagccatgatcgtgtcactgcactccagcctggcaacagagtgaggcttcacctcaaaaaaaagaaaaaaaaaacgaaattattcctgaagaaacacaggtatcagacttgctagacaaagaccttaaaaccatcttaaatacgctcaaacagttaaag

SEQ ID NO: 25361 - DNA, 358 bp, Homo sapiens
  chr22.fa.O7frz.20693425
  Located on chromosome 22
  Distance between a terminus base of telomere on chromosomal short arm and 5'-terminus of this base sequence : 20843282
  Distance between 3'-terminus of neighbour sequence of sequence listing upward to telomere on chrosomal short arm and 5'-terminus of this base sequence : 111812
atcagtaatgttgattcagaatcttttacctgtgcatccgtctcaggtcttcaggtcctttgcccagtcttacacattaaattgaaacaagttcacaataacttggcaaacatcactcaccacaagcaaaatgtaaatcaaaaccacacttagataccatctcattctaactagaatgagtgttacaaaaaaagacaaaaaacattgaaagaaaggcaaatgctggtgtgtgtttccagagagagagagagagagagagagacactcttctccagtttgtgagaaggtaaactagtacacacgctacagaaaccacttggaggttcctccaaaccttaaaagactccaactaccattt

SEQ ID NO: 25362 - DNA, 259 bp, Homo sapiens
  chr22.fa.O7frz.20879074
  Located on chromosome 22
  Distance between a terminus base of telomere on chromosomal short arm and 5'-terminus of this base sequence : 21029097
  Distance between 3'-terminus of neighbour sequence of sequence listing upward to telomere on chrosomal short arm and 5'-terminus of this base sequence : 185457
tactctagcttcataggctcatagtgcatgtgagcactcatgtggacacacgtgcacgcgcacacacatggacacacacacacacacacacaccgctgtctttggaatcagaccatgaaaatgcttcctcagaggcctaggggtgaggaagctgaggtgagttgtgcctccagctggatgtgctgggatggggtgggagatgaggtggccacacctgggtggcaggaactctggggcagtgaaccttctaacgaacaga

SEQ ID NO: 25363 - DNA, 149 bp, Homo sapiens
  chr22.fa.O7frz.21002845
  Located on chromosome 22
  Distance between a terminus base of telomere on chromosomal short arm and 5'-terminus of this base sequence : 21152889
  Distance between 3'-terminus of neighbour sequence of sequence listing upward to telomere on chrosomal short arm and 5'-terminus of this base sequence : 123533
cactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatt

SEQ ID NO: 25364 - DNA, 226 bp, Homo sapiens
  D22S1174
  Located on chromosome 22
  Distance between a terminus base of telomere on chromosomal short arm and 5'-terminus of this base sequence : 21284669
  Distance between 3'-terminus of neighbour sequence of sequence listing upward to telomere on chrosomal short arm and 5'-terminus of this base sequence : 131631
tgaggctatgtgcccagtctctaccagtctcacgtgcccagcaagcctcttggagtgtggacagaatctgctgcttgcttttttctgcctttgtgattttttttcctgattataaaagtgtgtgtgtgtgtgtgtgtgtgtgtgtgtgtgtgtgtgtgtgtgtgttttaaagagattcaaacaactcagaagtgtacagtgtgaatgtgaaggcccctagtgattc

SEQ ID NO: 25365 - DNA, 431 bp, Homo sapiens
  chr22.fa.O7frz.21246651
  Located on chromosome 22
  Distance between a terminus base of telomere on chromosomal short arm and 5'-terminus of this base sequence : 21396519
  Distance between 3'-terminus of neighbour sequence of sequence listing upward to telomere on chrosomal short arm and 5'-terminus of this base sequence : 111624
cactgctctgtctatggagtagccattcttttattcctttactgtcttaatcaacttactatggacttgccctgaattctttcttgctggagatccaagaaccttctttggggtctggattgggacctctttctggtaatgcaagaggaatacgtaatttactcttcccctacctgctcctttgtgctttctttctctctctctctctctctctctctctctctctatatatatatatatatatatatggctgtttgtaagaaagagcgcccaactgaaatcagccagaagcccctctcaggtttattctctagaataaacctgtctttaactgttgagccacttttcatgtttccttcctctttctttaactgttatagtcattatctgtagatactcgagaaactgttagaaataggtgaattgagcta

SEQ ID NO: 25366 - DNA, 285 bp, Homo sapiens
  AC011896.4_111859
  Located on chromosome 22
  Distance between a terminus base of telomere on chromosomal short arm and 5'-terminus of this base sequence : 21471441
  Distance between 3'-terminus of neighbour sequence of sequence listing upward to telomere on chrosomal short arm and 5'-terminus of this base sequence : 74491
aagtatgcagttcaacgtttctcttctgatttttaaaaaaaatttgactttgtttactttttattttattttaatttagagacaaggtttcactattttgcacaggctggtctcaaattcctgggctcaagtgatccccttgcctcggcctcccaaatactgggattacaggcatgagccactgcacctggccttaactttgaaatgaagttagaaatgtacattttatttttttaattattattattattatttattattttagaaacaggtctagctctgttg

SEQ ID NO: 25367 - DNA, 441 bp, Homo sapiens
  AC011896.4_96797
  Located on chromosome 22
  Distance between a terminus base of telomere on chromosomal short arm and 5'-terminus of this base sequence : 21517421
  Distance between 3'-terminus of neighbour sequence of sequence listing upward to telomere on chrosomal short arm and 5'-terminus of this base sequence : 45695
aaatcgtgctagatggcagttttgcaaactagtcttcacaacaagaacttaagcacaaattcctttgtttccaggaaaaaaaaatacattccatttcagagtaaaaacgtagtcatgactgtagagattgtaaagtttaaatcaaatccctacagacacttttagtgcattttattctgtctgagtatttccactggctgccactttcccttttacttaaatggatttatttatttatttatttatttatttatttatttatttataagaggtgacagtaataaaaatgtagtgccgggggcagaaaaacaccttttaaagaacagtgattatgtgaattctgtggccatgaatgaaaaaaggtcaataaagagaaaaagagcaaaggaatgaatgcaacttgagaatttatgatcagtctaagatgaccaggtagcttaa

SEQ ID NO: 25368 - DNA, 255 bp, Homo sapiens
  chr22.fa.O7frz.21538385
  Located on chromosome 22
  Distance between a terminus base of telomere on chromosomal short arm and 5'-terminus of this base sequence : 21688354
  Distance between 3'-terminus of neighbour sequence of sequence listing upward to telomere on chrosomal short arm and 5'-terminus of this base sequence : 170492
gtagtcctagctacatggcaggctgaggcgggaggatcacttgagcttgggaggtcgaggctgcagtgagccaaaatctctcctctgcactccagcctgggagtcagagtgaggccctgtctcaaacacacacacacacacacacacacacacacatacacacacacacacacacacacgtctttggatttggagcttacttggataatcccggatgatcttatcttgagatcctgaccttaattacgtctgtga

SEQ ID NO: 25369 - DNA, 410 bp, Homo sapiens
  chr22.fa.O7frz.21653771
  Located on chromosome 22
  Distance between a terminus base of telomere on chromosomal short arm and 5'-terminus of this base sequence : 21803795
  Distance between 3'-terminus of neighbour sequence of sequence listing upward to telomere on chrosomal short arm and 5'-terminus of this base sequence : 115186
aagtgattctcatgcctaagtctcccaagtagctgggattacaggcgtgcgccaccacgcccaacaaatttgtgtgtgtgtgtgtgtgtgtgtgtgtgtgtgtgtgtgtgtgtgtgtttccaagacagagtatcgctctgttacccaggctggagggcagtggtgcaatcttggcttactgcaacctccacctcccaggttcaagtgattctcctgcctcagcctccacagtagctgagactacaggcatgtgccaccatgcccagctaatttttgtatttttagtagagacagggttttgctatgttggccaggctggtcttgaactcctgaccttgtgatcctcccacctctgcctctcaaagtgctgggattaaggtgtgagccactgctcctggcctaattatggt

SEQ ID NO: 25370 - DNA, 149 bp, Homo sapiens
  HUMUT8049
  Located on chromosome 22
  Distance between a terminus base of telomere on chromosomal short arm and 5'-terminus of this base sequence : 21987171
  Distance between 3'-terminus of neighbour sequence of sequence listing upward to telomere on chrosomal short arm and 5'-terminus of this base sequence : 182966
gatcacgccactacactgcagcctgggcaagagcgagactccgtctcaataaataaataaataaataaataaataaataaataaataaatttaccatattacccagcaattctacttctagttatatacccatgagaatgaaaatgaaa

SEQ ID NO: 25371 - DNA, 255 bp, Homo sapiens
  AL049759.10_61270
  Located on chromosome 22
  Distance between a terminus base of telomere on chromosomal short arm and 5'-terminus of this base sequence : 22043334
  Distance between 3'-terminus of neighbour sequence of sequence listing upward to telomere on chrosomal short arm and 5'-terminus of this base sequence : 56014
ctgtgtactggcattaacctagacgtcagggatatagtggtgatacctttcatgtcacagagcttgtatatcatcgcaagagcagtgaggagccatggaagaatttatcatctgacactccttgtggccagcatgcctctccagcccccaagaggtggcaggaagggaggggggggtggggggagagagagagagagagagagagagagagagagagaaatatctcagaatctctccatctttcagaatatgaaa

SEQ ID NO: 25372 - DNA, 289 bp, Homo sapiens
  chr22.fa.O7frz.22023035
  Located on chromosome 22
  Distance between a terminus base of telomere on chromosomal short arm and 5'-terminus of this base sequence : 22173076
  Distance between 3'-terminus of neighbour sequence of sequence listing upward to telomere on chrosomal short arm and 5'-terminus of this base sequence : 129487
gtgctgagattacaggcatgagccaccatgcccggccaacacttgttattttctgtgtgtgtgtgtgtgtgtgtgtgtgtttttactgtatctattcttatgggtgtggctggcacattatttaatttgtgggggatttgtaggctctgtatttgttgggcctctgtgtctatgtgagctgaggtgccgggcaggggctggttcctgttagaatgtcggtcacatcctgctgtgttttctggaaatactttgttctccctcactggactgtgaactttctgaggatgta

SEQ ID NO: 25373 - DNA, 358 bp, Homo sapiens
  AL022323.7_114951
  Located on chromosome 22
  Distance between a terminus base of telomere on chromosomal short arm and 5'-terminus of this base sequence : 22277771
  Distance between 3'-terminus of neighbour sequence of sequence listing upward to telomere on chrosomal short arm and 5'-terminus of this base sequence : 104406
gcacagcctgatagacagtaagtgtccaatatatgttgagtgaagcaaactgataagtggtgaaggaaggaagggaggaagggagggagggagggagggagggaggaagggaggaaggctgttcaagagcagagattctctcgtatgcacatctgtgtccctgacacatagtaggcactcaataaatactcactgcactggaggaatgaaagaatgaatggatgagtgagactctttgcaagcagaaacagcccctatctttgtatccctgtcacgtgacacagtgcctgacatccaggagtttccatcaatgaatgttatgctgaatgaatgaatgaaccactgaagtgaactctat

SEQ ID NO: 25374 - DNA, 472 bp, Homo sapiens
  chr22.fa.O7frz.22230420
  Located on chromosome 22
  Distance between a terminus base of telomere on chromosomal short arm and 5'-terminus of this base sequence : 22380378
  Distance between 3'-terminus of neighbour sequence of sequence listing upward to telomere on chrosomal short arm and 5'-terminus of this base sequence : 102249
acaaacagtttaaacaaatctcacctccccaaaacaattattgttgacctttgataaacaaaaggcagctctgtatgctgtatgtcttatgggcattgtattgttcagagttctccagagaaacagagccaatcgggtgtgtgtgtgtgtgtgtgtgtgtgtgtgtgtgtgtgtgtgtgtgtaaataatacagttgatccctgaacaaggcagagattaggggtactgacttcctacttagtcaaaaatctgcatgtagcttttgactttctaaaatttaactactaatagcctagtgttgaccagaagcctcactcataaccacatacgtatattttgtatgttatattttatatattcttacaataaagtaagctagaggaaagatgttattaagaaaatcataaggaagagaaaatatatttcctgttcattaagtggaagtggatcatcataaaggtcttcatccttc

SEQ ID NO: 25375 - DNA, 170 bp, Homo sapiens
  chr22.fa.O7frz.22350942
  Located on chromosome 22
  Distance between a terminus base of telomere on chromosomal short arm and 5'-terminus of this base sequence : 22500943
  Distance between 3'-terminus of neighbour sequence of sequence listing upward to telomere on chrosomal short arm and 5'-terminus of this base sequence : 120093
gctagtacatggaaatagaatgagtttttttatagtggtcttgtatccagtgatcttcctgaactagtttatcagttctagtaaggtgtgtgcgtgtgtgtgtgtgtgtgtgtgtgtgtgtgtgtgtgtattccttaggattttttatgtatggaatcctatctgaataa

SEQ ID NO: 25376 - DNA, 266 bp, Homo sapiens
  D22S925
  Located on chromosome 22
  Distance between a terminus base of telomere on chromosomal short arm and 5'-terminus of this base sequence : 22577808
  Distance between 3'-terminus of neighbour sequence of sequence listing upward to telomere on chrosomal short arm and 5'-terminus of this base sequence : 76695
tggccccccatccaactctctctcatcttaacacacacattcacacactcaaactcacatacacacacacacacatacatacacacacacacacacacacacacacacacacacacacacacagcccggaggaaaaccataattaactgaagtccaggcaagtttcccgagcagggaccacatttcaaaggtgagggaagcaggcgaacaggaaacatactgggggcacgcttgggggtgaagcaggaaataagaaatcactcgca

SEQ ID NO: 25377 - DNA, 307 bp, Homo sapiens
  D22S926
  Located on chromosome 22
  Distance between a terminus base of telomere on chromosomal short arm and 5'-terminus of this base sequence : 22620720
  Distance between 3'-terminus of neighbour sequence of sequence listing upward to telomere on chrosomal short arm and 5'-terminus of this base sequence : 42646
ggtgggtcaaaccagatgtttctgctgttctgtgtgtgtgtgtgtgtgtgtgtgtgtgtgtgtgtgtgtgttttgaatagcaggtgttttctttttaatttttttaattatactttaagttctagggtacatgtgcaccgtgtgtgtatacagatgtttctgctttttgccaatggtgaataaaaccagtataagtatttgcaaacaaatttttgtttgaacataagttttcattccatttggataaaaacctaggagtagggtttgcttgatatgcataagcatatgtttattagaaattgccggc

SEQ ID NO: 25378 - DNA, 189 bp, Homo sapiens
  HUMUT7154
  Located on chromosome 22
  Distance between a terminus base of telomere on chromosomal short arm and 5'-terminus of this base sequence : 22645261
  Distance between 3'-terminus of neighbour sequence of sequence listing upward to telomere on chrosomal short arm and 5'-terminus of this base sequence : 24234
ttgcctggatgactgtaggttttgttttatctatctatctatctatctatctatctatctatctatctatctatctatctataatatatcctaatcctattattattattatttgagacaggttattgctctgtcacccaggctggagttcagcagtgcgatcttggctcattgcagccttgaacctcc

SEQ ID NO: 25379 - DNA, 198 bp, Homo sapiens
  D22S687
  Located on chromosome 22
  Distance between a terminus base of telomere on chromosomal short arm and 5'-terminus of this base sequence : 22661402
  Distance between 3'-terminus of neighbour sequence of sequence listing upward to telomere on chrosomal short arm and 5'-terminus of this base sequence : 15952
cccccagtttgcctaattattcctattattattattattattattattattattattagagacggaatcttgctctgtcatccaggctggagtgaagtggcatgatcttggctcactgcaacctccacctcccaggttcaagtgattctcttgtctcaacctcccaagtagctgggattacaggtgcacaccaccatg

SEQ ID NO: 25380 - DNA, 273 bp, Homo sapiens
  AL008721.1_34231
  Located on chromosome 22
  Distance between a terminus base of telomere on chromosomal short arm and 5'-terminus of this base sequence : 22661406
  Distance between 3'-terminus of neighbour sequence of sequence listing upward to telomere on chrosomal short arm and 5'-terminus of this base sequence : -194
cagtttgcctaattattcctattattattattattattattattattattattagagacggaatcttgctctgtcatccaggctggagtgaagtggcatgatcttggctcactgcaacctccacctcccaggttcaagtgattctcttgtctcaacctcccaagtagctgggattacaggtgcacaccaccatgcccggctaattttgttttagtagaggcagggtttcaccatgttggccaggctggtctctaactcctgacagatcaagtg

SEQ ID NO: 25381 - DNA, 353 bp, Homo sapiens
  AL008721.1_47562
  Located on chromosome 22
  Distance between a terminus base of telomere on chromosomal short arm and 5'-terminus of this base sequence : 22674481
  Distance between 3'-terminus of neighbour sequence of sequence listing upward to telomere on chrosomal short arm and 5'-terminus of this base sequence : 12802
ggatgtattgattttgaccactagcgtcccttccttgatgaaaccatgcctccctcactccccagaggctgttaatcactgttgtctgccctcctcaccacagcggagggcctgtgaccaggctgagccaatcctagcacccatgtcagtgtcctcttgggctcagtgattggtcctgaggtgaacatgtgacccaagcagagccaatccaaatccttagttggatttctatgtggaagctgagagagaggaagagcgatagatagatagatagttagatagatagatagatagatagatagacagacagacagacagacagatagttagaccttatggattacaagctgtaa

SEQ ID NO: 25382 - DNA, 269 bp, Homo sapiens
  D22S419
  Located on chromosome 22
  Distance between a terminus base of telomere on chromosomal short arm and 5'-terminus of this base sequence : 22739395
  Distance between 3'-terminus of neighbour sequence of sequence listing upward to telomere on chrosomal short arm and 5'-terminus of this base sequence : 64561
ggctcagggactctggaagtctttgaccatggcccatggtaagaagtacattttatttaatacaaagcagtggaatacacacacacacacacacacacacacacacacacacacacacacacatctgaaacaaatatttcacttaacgatgcttaaaactgactgtgtatgactcactctgatgatttttattccattctatttcacttcattatgtaaaaatgctgctagcatccatgtaaatgtattccatgacctaccgattggcc

SEQ ID NO: 25383 - DNA, 191 bp, Homo sapiens
  Z23611.1_159
  Located on chromosome 22
  Distance between a terminus base of telomere on chromosomal short arm and 5'-terminus of this base sequence : 22739450
  Distance between 3'-terminus of neighbour sequence of sequence listing upward to telomere on chrosomal short arm and 5'-terminus of this base sequence : -214
tttaatacaaagcagtggaatacacacacacacacacacacacacacacacacacacacacacacacatctgaaacaaatatttcacttaacgatgcttaaaactgactgtgtatgactcactctgatgatttttattccattctatttcacttcattatgtaaaaatgctgctagcatccatgtaaatgt

SEQ ID NO: 25384 - DNA, 262 bp, Homo sapiens
  AL022329.9_6983
  Located on chromosome 22
  Distance between a terminus base of telomere on chromosomal short arm and 5'-terminus of this base sequence : 22748137
  Distance between 3'-terminus of neighbour sequence of sequence listing upward to telomere on chrosomal short arm and 5'-terminus of this base sequence : 8496
aagatcgttcgagtactgtcagaagcgagattcaaattgaggccttccttattttaatgttcatcctctttcctttcaactgtatcacgatgcctgaaattattccagctgaacaaagtcagcctgaatgattcctggcgttaaggaaaaacctgctgcccctaacatatcacacacacacacacacacacacacacacacacacacacacacacacacacaaactagcaacccagttgtatgaaattcctttaagaaaggc

SEQ ID NO: 25385 - DNA, 165 bp, Homo sapiens
  D22S421
  Located on chromosome 22
  Distance between a terminus base of telomere on chromosomal short arm and 5'-terminus of this base sequence : 22748289
  Distance between 3'-terminus of neighbour sequence of sequence listing upward to telomere on chrosomal short arm and 5'-terminus of this base sequence : -110
ctgctgcccctaacatatcacacacacacacacacacacacacacacacacacacacacacacacacacaaactagcaacccagttgtatgaaattcctttaagaaaggcaaactctactattttataatcaagcatatggtttaaaattcagacactcctggcc

SEQ ID NO: 25386 - DNA, 193 bp, Homo sapiens
  D22S315
  Located on chromosome 22
  Distance between a terminus base of telomere on chromosomal short arm and 5'-terminus of this base sequence : 22811961
  Distance between 3'-terminus of neighbour sequence of sequence listing upward to telomere on chrosomal short arm and 5'-terminus of this base sequence : 63507
gcattatgattcatttctcacagaaagtggttccctctcccccttctctcttcctttactctctcctgctcctcacattccttcctttactcttcctttcctttgtcttttttgtgtgtgtgtgtgtgtgtgtgtgtgtgtgtgtgtgtgtgtgtgtgtgtgtggttttaaggagtggagagtttaataggca

SEQ ID NO: 25387 - DNA, 219 bp, Homo sapiens
  D22S1164
  Located on chromosome 22
  Distance between a terminus base of telomere on chromosomal short arm and 5'-terminus of this base sequence : 22918844
  Distance between 3'-terminus of neighbour sequence of sequence listing upward to telomere on chrosomal short arm and 5'-terminus of this base sequence : 106690
cattcagaagccatttgctgcctatcaggactttctgaagaagttcttttgcctctgcctaccctctggcaccctcccatggaggcacaggggacccagagctaaagcattaccaggccatctccaaaacaccccgtgtgtgtgtgtgtgtgtgtgtgtgtgtgtgtgtgtgtgtgtgtgcactttgcagcccccgaggtggagaggcagtgtctggat

SEQ ID NO: 25388 - DNA, 310 bp, Homo sapiens
  chr22.fa.O7frz.22845940
  Located on chromosome 22
  Distance between a terminus base of telomere on chromosomal short arm and 5'-terminus of this base sequence : 22995820
  Distance between 3'-terminus of neighbour sequence of sequence listing upward to telomere on chrosomal short arm and 5'-terminus of this base sequence : 76757
gttcataggaagccattagttcagggctttgtggttctggaaatgtgtctgttttgtttgtcctgcagatcccatggtagacataaaccagtcctctgggtctgtgtccccagtcctctcttaaacttctagccaattactctgaacttgttggggtttacactattttgacctcaacttacggtaagaaacattttacctcttgacccagtgaacacacacacacacacacacacacacacacacacacacacacatattttatagagactaaaccacagagggaatcttctgtattcgtgagtttgaa

SEQ ID NO: 25389 - DNA, 257 bp, Homo sapiens
  D22S429
  Located on chromosome 22
  Distance between a terminus base of telomere on chromosomal short arm and 5'-terminus of this base sequence : 23111682
  Distance between 3'-terminus of neighbour sequence of sequence listing upward to telomere on chrosomal short arm and 5'-terminus of this base sequence : 115552
caaagagcctggcacaatgcccagcccttaactcagttcagcaggtgagattgtgtgtgtgtatgtgtgtgtgtgtgtgtgtgtgtgtgtgtgtataatagaacagcattttgaacctaccaaaacaatacatttcagatataaagaccgtattctgagaaccaactcgtttttcaaagaactcaaaaccagcagtagagaaatagaaatacaaaatctagaggaacacattcgaggtcttcagacaatactcataa

SEQ ID NO: 25390 - DNA, 188 bp, Homo sapiens
  D22S1148
  Located on chromosome 22
  Distance between a terminus base of telomere on chromosomal short arm and 5'-terminus of this base sequence : 23142519
  Distance between 3'-terminus of neighbour sequence of sequence listing upward to telomere on chrosomal short arm and 5'-terminus of this base sequence : 30580
tgtgctcagagccatcctatagttgtattagtcagggttttcttagagggacagaactaataggatgtgtgtgtgtgtgtgtgtgtgtgtgtgtgtgtatgagtttattgtttgtttatttgtttatttatttttgagacaagagtctcactctgtcacccagactggagtgaagtggcgcgatcttg

SEQ ID NO: 25391 - DNA, 172 bp, Homo sapiens
  Z98949.1_128445
  Located on chromosome 22
  Distance between a terminus base of telomere on chromosomal short arm and 5'-terminus of this base sequence : 23155157
  Distance between 3'-terminus of neighbour sequence of sequence listing upward to telomere on chrosomal short arm and 5'-terminus of this base sequence : 12450
agacttaggcatgctgtttctctctctctctcctctttctctttctcctctctctctctcctctttctcctctctctctctctctctcacacacacacacacacacacacacacacacaattgttttgactcaggttgggaggagggtctgtgttaaatttctaggctacca

SEQ ID NO: 25392 - DNA, 427 bp, Homo sapiens
  AL022337.19_6630
  Located on chromosome 22
  Distance between a terminus base of telomere on chromosomal short arm and 5'-terminus of this base sequence : 23280413
  Distance between 3'-terminus of neighbour sequence of sequence listing upward to telomere on chrosomal short arm and 5'-terminus of this base sequence : 125084
aataaaggatgtcaaatgctgtgattgaagtgtattcattgggggcatttctaactggtgccctctgagtcaaattcagccctttagcatattttgaagtcatcataaatatcaaacttgtggccaagaatcatcaggaagcatctataagaatctataatagaggtccacccacacacacacacacacacacacacacacacacacacacacacacaatcagaagatctggaaatcccgggactgtattcccacagggccaccattacctggagttgaatagtggcaactccccactagaagagctcaattcttcatttggcttcagtcaccaccactccctattgctgcaccaggtctactgggcttatttatgctgcctccctggcctctggatggttttaacttacaacctttgataggagca

SEQ ID NO: 25393 - DNA, 377 bp, Homo sapiens
  AL080273.10_5746
  Located on chromosome 22
  Distance between a terminus base of telomere on chromosomal short arm and 5'-terminus of this base sequence : 23413514
  Distance between 3'-terminus of neighbour sequence of sequence listing upward to telomere on chrosomal short arm and 5'-terminus of this base sequence : 132674
tgactgagaaagtcattccaactcccagagcctccattgccccaaatatgaaatagacacactgcctcacagaggtattaggaagacttacaccctgagaaagtgtgcaaggagcttcatgtgaatcccggcacatagcaagcactcgctcgtgtcaatggctatcattactattgttgcctaacctgtgattgtctcatctactcaacaatattttaaggttctaagagaaaagcaccatctctcgtacctggtgtgtgtgcacctgaattcatgcgcgtgcacacgcgtgcacacacacacacacacacacacacacacacactccctagcacaggactggatgaccagaatgcttattggttgatttctgcttg

SEQ ID NO: 25394 - DNA, 259 bp, Homo sapiens
  D22S1154
  Located on chromosome 22
  Distance between a terminus base of telomere on chromosomal short arm and 5'-terminus of this base sequence : 23413692
  Distance between 3'-terminus of neighbour sequence of sequence listing upward to telomere on chrosomal short arm and 5'-terminus of this base sequence : -199
gcctaacctgtgattgtctcatctactcaacaatattttaaggttctaagagaaaagcaccatctctcgtacctggtgtgtgtgcacctgaattcatgcgcgtgcacacgcgtgcacacacacacacacacacacacacacacacactccctagcacaggactggatgaccagaatgcttattggttgatttctgcttggacccaagtcaagaaagtttcatttctaaagatttattgtaggtgagaatcaattcgcca

SEQ ID NO: 25395 - DNA, 296 bp, Homo sapiens
  AL080273.10_16352
  Located on chromosome 22
  Distance between a terminus base of telomere on chromosomal short arm and 5'-terminus of this base sequence : 23424221
  Distance between 3'-terminus of neighbour sequence of sequence listing upward to telomere on chrosomal short arm and 5'-terminus of this base sequence : 10270
acctagtgagcactcattcaatcagaattcccattcttcttctggtttcagagcaactatagcaccaggaaaagtccttacccgaaaggagtctcagtttccccatctatgaaaggaagtagcaatatgagctgaactctgaggaccctcctgccctgaaagtcattaagtctctctctctctctgtctttcacacacacacacacacacacacacacacacacacacacacacacacactaagagcccaaactctggaaacagacagacgtgtattcaaatgtcaaccttacctg

SEQ ID NO: 25396 - DNA, 244 bp, Homo sapiens
  D22S690
  Located on chromosome 22
  Distance between a terminus base of telomere on chromosomal short arm and 5'-terminus of this base sequence : 23454173
  Distance between 3'-terminus of neighbour sequence of sequence listing upward to telomere on chrosomal short arm and 5'-terminus of this base sequence : 29656
attctggaaataatctgttggccagaggtataatgggaatatatatatatatttaatatattgatatacaaacaaatatatatttatattgatatataaaagatatatatatgcaccttttatatattgatatattttatctatctatctatctatctatctatctatctatctatctcttttaaaaagaaatacatggcccttcttgtgagaagaagaacatatatggcaggtgtgagactca

SEQ ID NO: 25397 - DNA, 350 bp, Homo sapiens
  AL023513.1_83221
  Located on chromosome 22
  Distance between a terminus base of telomere on chromosomal short arm and 5'-terminus of this base sequence : 23539207
  Distance between 3'-terminus of neighbour sequence of sequence listing upward to telomere on chrosomal short arm and 5'-terminus of this base sequence : 84790
gctatgatcatactcttgcactccagcctgagcaacagagaccctgcctgtaaaaataatgatgatgatgatgatgatgatgatgataagaataataataataaatgaaaagcaaaagtaaaataaaaaacaaaaatacaaaaatttttaaaagagtgtaaaccctcggaggtgagagtcatccagtgacatctggtaagcagcggccacagtgagacaggtgccgttgtaattattccctcatgaaaggtcaaggaacctgagctgcagagtcaaaaagtgattgtccccccgtcacaccgttaataagtggcagagataggattctgtctgactcgaaatcctaaact

SEQ ID NO: 25398 - DNA, 278 bp, Homo sapiens
  AL023513.1_92664
  Located on chromosome 22
  Distance between a terminus base of telomere on chromosomal short arm and 5'-terminus of this base sequence : 23548690
  Distance between 3'-terminus of neighbour sequence of sequence listing upward to telomere on chrosomal short arm and 5'-terminus of this base sequence : 9133
gagcaagattctgtctcaaataataataataataataataataataataataataataataataataatgacaattgctgctacgaggatgtgtatacccgttgggctgtgcaaatcttcttaaacgttaggatcagatgggacttcgccaccctaatttcctgttccacattgattttgtcacagttagcacgagcaccacaaaaaaatccagctttgcaatgatgagtcatcaccaaaacaaaggtgacgtgatctaatgttgaaacggtgaacta

SEQ ID NO: 25399 - DNA, 380 bp, Homo sapiens
  Z99714.2_20725
  Located on chromosome 22
  Distance between a terminus base of telomere on chromosomal short arm and 5'-terminus of this base sequence : 23627474
  Distance between 3'-terminus of neighbour sequence of sequence listing upward to telomere on chrosomal short arm and 5'-terminus of this base sequence : 78506
caccggttagtatctcagattagagtgtgcagagacagccttggcagcgtccagctttacaaagttcacaacgctgcttcagcttcagtagggaggaaggaagagcagcaggaggaacctggtgcatgggttggagtgggagtttcataaccacgttctgcagaggagcctcagggctgcctgggaaggagccggagctgggggcccccgagccctcttcaccctcagcagctctgcttctcctgctgtctgtgtgggggttctgagtaagatgtggtttggatggaggatatcactgcactaaaagaaaagaaaagaaaagaaaagaaaagaaaagaaaagaaaagaaaagaaaaatataatgagatttgagcaattga

SEQ ID NO: 25400 - DNA, 268 bp, Homo sapiens
  D22S1167
  Located on chromosome 22
  Distance between a terminus base of telomere on chromosomal short arm and 5'-terminus of this base sequence : 23827781
  Distance between 3'-terminus of neighbour sequence of sequence listing upward to telomere on chrosomal short arm and 5'-terminus of this base sequence : 199927
ggggcttcaacaacattcttaacaatattgagaatgcataattttatctcatcgtgtgtgtgtgtgtgtgtgtgtgtgtgagagacagcatctcactctgtcacccaggctggagtgcagtggcacaatctcggctcactgcaacctctgcctcccgggctccagcagtcctcccacctcagcctcccaagcagctgggactaaactataggcctatgacaccatgcccaggttttttgttttttgcagagactgggttttgccatgt

SEQ ID NO: 25401 - DNA, 211 bp, Homo sapiens
  Z99774.1_68571
  Located on chromosome 22
  Distance between a terminus base of telomere on chromosomal short arm and 5'-terminus of this base sequence : 23894364
  Distance between 3'-terminus of neighbour sequence of sequence listing upward to telomere on chrosomal short arm and 5'-terminus of this base sequence : 66315
tctatttggaggcaaccacggttcccagtgtcatgttatccttcttgagatggtccacacattgtgaccaagtatatgtgaggtgcatatgagcatgtacacacacacacacacacacacacacacacacacacacacactctttttctttcttcatggctgtgtggaattccactgcctgcatggaccgtcgtttctgtaatcagtcctg

SEQ ID NO: 25402 - DNA, 423 bp, Homo sapiens
  Z97353.3_27415
  Located on chromosome 22
  Distance between a terminus base of telomere on chromosomal short arm and 5'-terminus of this base sequence : 24044101
  Distance between 3'-terminus of neighbour sequence of sequence listing upward to telomere on chrosomal short arm and 5'-terminus of this base sequence : 149526
caggaattggaacataacaaatctgccgactgccagctttgatctcacaaggatggagttggggaggtgaagagaaagtaaatgctctctcgactttccaaaggaaaacaattttctttcttggtaactgcaattacttgaaaaccatgtcaaaacaataatgtgcctccaatagtctcccactctctctctctctctctctctctctctctctctcccccctctcctcctcctccctgcttcctctaccttcttctcttccttctgcctccttcgttttgccctggtaataaggaccatggacagagacacataagctccgcccacacgcccttagctgacctatgctgggaaagaagggcagtggtcgatcaatacccaagatcaagtgagcttagctcctcacgtgagtatttcagaagg

SEQ ID NO: 25403 - DNA, 265 bp, Homo sapiens
  Z97353.3_31790
  Located on chromosome 22
  Distance between a terminus base of telomere on chromosomal short arm and 5'-terminus of this base sequence : 24048568
  Distance between 3'-terminus of neighbour sequence of sequence listing upward to telomere on chrosomal short arm and 5'-terminus of this base sequence : 4044
actagaaaccattcttgatgtcactatgatgtacatcattttacctaagatttacttatctacctatatccatccatccatccatccatacatccatccatccatccatccatccatccaacatcaggaaccttctgaaggctaactgcaccatatggtggatatgatggatagattttagtcctctttcgttgttggcactccaaatttgggatgggaattgtcattgagcagctattctgtgctatctagacgctttagacac

SEQ ID NO: 25404 - DNA, 391 bp, Homo sapiens
  Z97353.3_38578
  Located on chromosome 22
  Distance between a terminus base of telomere on chromosomal short arm and 5'-terminus of this base sequence : 24055219
  Distance between 3'-terminus of neighbour sequence of sequence listing upward to telomere on chrosomal short arm and 5'-terminus of this base sequence : 6386
ttctaggaatctaatgtttaacgattctgagatattgaaattttatgagtccaaattcccaaggtgtttgattttaaggataaattaatcccaccgtccagtattcaggactgctaaaaagtatagtagaattagaaagatattgacaataaccacagaaatagctaagctttgttgagaccttaaccatatgcaggcactgtgctgagtgcttcatgtgcagcaccttattttattttattttattttattttatttttttgcttttgctaattttttaaaattgtactttaagttctggggtacatgtgcagaacgcgcaggtttgttacataggtatacacatgccagggtggtttgctgcacccatcaacctgtcatctacattagg

SEQ ID NO: 25405 - DNA, 358 bp, Homo sapiens
  AL008638.1_38025
  Located on chromosome 22
  Distance between a terminus base of telomere on chromosomal short arm and 5'-terminus of this base sequence : 24245485
  Distance between 3'-terminus of neighbour sequence of sequence listing upward to telomere on chrosomal short arm and 5'-terminus of this base sequence : 189875
aagtatcttaaaggcagaaccttttattttttattctctgccctagctcacatctccagcaccaaggacagtgtccagcgcatagtaggtgctctctctctttctctctctctctctctctctctctctctctctctctctctctatatatatatatatatatatatatatatatatatatatatataaagagacagtaagagacaggctgtctgtctcactgcagcctcgaactcctggactcaagcaattctcctgcctcagtttcctgagtagctgggactacaggcatgcaccatcatgcccagttaatttttaaaatttttgtacagatgggatctcactatgttgcctaggc

SEQ ID NO: 25406 - DNA, 435 bp, Homo sapiens
  AL008638.1_129575
  Located on chromosome 22
  Distance between a terminus base of telomere on chromosomal short arm and 5'-terminus of this base sequence : 24337022
  Distance between 3'-terminus of neighbour sequence of sequence listing upward to telomere on chrosomal short arm and 5'-terminus of this base sequence : 91179
gaactcctgacctcagatgagccaccctccttggcctccgaaagtgctgggattacaggcgtgagccaccacacttggccattgtcacatttcttaatcattttctgattaaatttatcaccaaatatatagaagcttgctctctctatataggtatacacacacacacacacacacacacacacacacacacacacacacataagtatgtacataaattaaattttttctaaactatttgataaaattgtggttttgatgcttcatttccacagtgaccaattatcctggtttgcctggtattttcctagctctagcacagaaagccctacacattgggaaacccctcagcgtcctgagcaaaccgggacagttgctcaccctctcattaaatagttcagtgtgcagtttctaagtaccaaagcaaactcgtac

SEQ ID NO: 25407 - DNA, 428 bp, Homo sapiens
  AL008638.1_150748
  Located on chromosome 22
  Distance between a terminus base of telomere on chromosomal short arm and 5'-terminus of this base sequence : 24358006
  Distance between 3'-terminus of neighbour sequence of sequence listing upward to telomere on chrosomal short arm and 5'-terminus of this base sequence : 20549
atagcaagtatctcgtgaaatcacaatggcatagtttgctgcacacccatagcggtgccttattaaaaaaagatcatcagggcccttgaaattgatcataaactatttccatcaatgtcacacacaaccatgtttggggaagtttgctggcacatctgctaaactgaagggctttggggtttgagaacaaacaaataataaataaatgactatataataaaatgaagatggggggacaataccctttgagttgggagataagaaatcttaagagaaaggaaaatgatgtaccagcgttgtgtgtgcccaatatcaaacttgcgggaatgcccagtgagtgatgcaagaatgaatgaatgaatgaatgaatgaatgaatgaatgaagaatagcatatttaaaggacaatctgaaggcaactgtacctag

SEQ ID NO: 25408 - DNA, 191 bp, Homo sapiens
  D22S1144
  Located on chromosome 22
  Distance between a terminus base of telomere on chromosomal short arm and 5'-terminus of this base sequence : 24479200
  Distance between 3'-terminus of neighbour sequence of sequence listing upward to telomere on chrosomal short arm and 5'-terminus of this base sequence : 120766
gctgaaattgccaaagtttagaaagaaacaaaacttttgtctttaatttttgcggaaagcaactttggtaaatacgtgtgtgcgcaaatgcgtgcacacccacaaacacacacatgcttaaacatggtgctgaatacacacacacacacacacacacacacacacacacacacacagaggaccagaggctc

SEQ ID NO: 25409 - DNA, 172 bp, Homo sapiens
  AL020994.1_34650
  Located on chromosome 22
  Distance between a terminus base of telomere on chromosomal short arm and 5'-terminus of this base sequence : 24479315
  Distance between 3'-terminus of neighbour sequence of sequence listing upward to telomere on chrosomal short arm and 5'-terminus of this base sequence : -76
gcttaaacatggtgctgaatacacacacacacacacacacacacacacacacacacacacagaggaccagaggctctgtctgaagctggaaaagttcacagcacaaaacttcaacgcaacagttggttttcctcctgaataacagctctccttaattcctgttgtcagcatc

SEQ ID NO: 25410 - DNA, 298 bp, Homo sapiens
  AL020994.1_43077
  Located on chromosome 22
  Distance between a terminus base of telomere on chromosomal short arm and 5'-terminus of this base sequence : 24487665
  Distance between 3'-terminus of neighbour sequence of sequence listing upward to telomere on chrosomal short arm and 5'-terminus of this base sequence : 8178
taccaattgaaacgctaatgtctctacttttttcttattttctgtctctatccactcactctgaagtctgcaaaggcaggatctcaactgccttaccatggatggatggatggatggatggatggatggatggatggatggatggataatggttggatggataggagagagggaaggaggaaggataaaagtgggaaagaagggaagagtggaaaggaaggagaaaggaagaaaggaaaagagggagaaagaaaaaggcaataaaggaaatgaaaaaaacaagatggaaggatgaatg

SEQ ID NO: 25411 - DNA, 229 bp, Homo sapiens
  AL050402.16_80291
  Located on chromosome 22
  Distance between a terminus base of telomere on chromosomal short arm and 5'-terminus of this base sequence : 24644477
  Distance between 3'-terminus of neighbour sequence of sequence listing upward to telomere on chrosomal short arm and 5'-terminus of this base sequence : 156514
tggatgagcgaaaggatagatgtgtggatgcacggataaataagtggatggatggatggatggatggatggatggatggatggatggatgggtaggtgagtgggtagatggatggatgggtagatggataggctggtgaatgagtggtggatgggtgagtagatgggtagttgagggaggagttaggagaatgagtagatgaacggttggataaatagatggctagatg

SEQ ID NO: 25412 - DNA, 364 bp, Homo sapiens
  AL050402.16_19884
  Located on chromosome 22
  Distance between a terminus base of telomere on chromosomal short arm and 5'-terminus of this base sequence : 24704850
  Distance between 3'-terminus of neighbour sequence of sequence listing upward to telomere on chrosomal short arm and 5'-terminus of this base sequence : 60144
cctgcttgagtaagactgacagggggctggtgtgtgaatctggagagaaacaggggactgggtgccttcctttctttctctctctctctctctctctctctctctctctctctctctctctctcttcccagtctctgcctcatcatcttgtcacctgtatgtatctctctctttctctttgcagtgtcagcccagtctttttctctggaacaagtagggtgaagctggcaggatgtctgaaaaatccaacctgaccaaaaacttgctatgaaacccaaattaacataagacaccctgttctgtctatcacactgataaaaatggaaacatcaataatattcttcattaacaaaggtagagcaaa

SEQ ID NO: 25413 - DNA, 155 bp, Homo sapiens
  D22S1163
  Located on chromosome 22
  Distance between a terminus base of telomere on chromosomal short arm and 5'-terminus of this base sequence : 24714904
  Distance between 3'-terminus of neighbour sequence of sequence listing upward to telomere on chrosomal short arm and 5'-terminus of this base sequence : 9690
acaatgtgtgcgtgtgcctggtgtgtctgatgtgtgtgtgtgtgtgtgtgtgtgtgtgagagagagagagagagagagggagagagagagacaacagtctgttgacaatggttatctggagaaggaggtgggagagaggctgacctttgattttt

SEQ ID NO: 25414 - DNA, 370 bp, Homo sapiens
  AC004032.7_31236
  Located on chromosome 22
  Distance between a terminus base of telomere on chromosomal short arm and 5'-terminus of this base sequence : 24847677
  Distance between 3'-terminus of neighbour sequence of sequence listing upward to telomere on chrosomal short arm and 5'-terminus of this base sequence : 132618
gatgaaagaattgaagcatagaaggatggaagggaagaagggagggagagagggagggagggaagaagggctgaatgatgatggatggatatggatgggtggatggatagatgaaaggatgaaaggatggataggaggaagaaaggaagagaggaaggaaggggaaggaagtggggaaaagagggagggagagagggagaaagagttgaaggagtgatggatggatggatggatggatggatggatggatggatgggaggaaggaaggatgggtaggaggaatggtatactagagggacagatggatgaggggagggaggattaaaaaatgaatggatagatggatgaaatgattgaaggatgaaaggat

SEQ ID NO: 25415 - DNA, 110 bp, Homo sapiens
  HUMUT7995
  Located on chromosome 22
  Distance between a terminus base of telomere on chromosomal short arm and 5'-terminus of this base sequence : 24964906
  Distance between 3'-terminus of neighbour sequence of sequence listing upward to telomere on chrosomal short arm and 5'-terminus of this base sequence : 116859
ccatggatgctgctgtcactatcaccattgccatcatcatcatcatcatcatcatcatcatcataatcaagcagtgtggctggcagctgggggctagcagcctagtgcct

SEQ ID NO: 25416 - DNA, 424 bp, Homo sapiens
  chr22.fa.O7frz.24988955
  Located on chromosome 22
  Distance between a terminus base of telomere on chromosomal short arm and 5'-terminus of this base sequence : 25138811
  Distance between 3'-terminus of neighbour sequence of sequence listing upward to telomere on chrosomal short arm and 5'-terminus of this base sequence : 173795
cttgtaatgcaggtctactgacaataaattttcttggttttcttttatttgaaaatatctttattttaccttaactcttggagaatatttttactggatgtaaaattctggtttaattttttaaattcccatagaactttaaagatgtttcattgtcttctggcttttattgtttctgataaaaatctgaagacattttgaatcatccattcttccccgtatgttagagagagagagcgtgtgtgtgtgtgtgtgtgtgtgtgtgtgtgtgtgtgtgtgtgtgtgtgtgtgtttcctccagctgctttaaggattgttctctttaattcttgctttatcaccttggtccaggcatatgatgtgcccaggcaaagttttctttatatttatctttcttggggttcactgagcttacaagtttatg

SEQ ID NO: 25417 - DNA, 415 bp, Homo sapiens
  AL033538.1_108970
  Located on chromosome 22
  Distance between a terminus base of telomere on chromosomal short arm and 5'-terminus of this base sequence : 25261892
  Distance between 3'-terminus of neighbour sequence of sequence listing upward to telomere on chrosomal short arm and 5'-terminus of this base sequence : 122657
tccacggagtttgtatttctaggatttaaagcacaacactgaaccaaagtacgaagaagcagacaaggagaaaaatacaataaagtattagcctacactaaattgaaaggttgtacaaacacacacacacacacacacacacacacacacacacacacacaaatgccccttgttcttttccattgtactctggtattaacccaggttgctcattctgtgtcctcctttggaaataaattttttgcctgtatatagtcagacccattctagcaatgatcagaaaacgtctaagcttcagctttaacataattataaataaacagtgcttatatggggaaaaaaggtagaactacttcatgtaatcattcaatgaatattccctgaggcccagctacattccaggttctgtactgat

SEQ ID NO: 25418 - DNA, 201 bp, Homo sapiens
  AL035397.4_66385
  Located on chromosome 22
  Distance between a terminus base of telomere on chromosomal short arm and 5'-terminus of this base sequence : 25391330
  Distance between 3'-terminus of neighbour sequence of sequence listing upward to telomere on chrosomal short arm and 5'-terminus of this base sequence : 129023
attctggaatactatgcacagaagaaataaggtagaactacataaactgaattggaaatatccctaaggtatactggtaaatgcaaaaagcaagaagcaaaacaatacttaaagtataatgccacttacattaaaaattatatatatatatatatatatatatatatatatatatatgtaactattccaggagttcaaggt

SEQ ID NO: 25419 - DNA, 224 bp, Homo sapiens
  AL023281.1_99640
  Located on chromosome 22
  Distance between a terminus base of telomere on chromosomal short arm and 5'-terminus of this base sequence : 25502135
  Distance between 3'-terminus of neighbour sequence of sequence listing upward to telomere on chrosomal short arm and 5'-terminus of this base sequence : 110604
tggattacaagaataagtttccattacttctttctcacaattaacattccctaaaaatcaacagtgccaggcactgtgacacataacacacacacacacacacacacacacacacacacacacaaaaaacaagacaagagcaccctcaaggtgctcacagtcaagagggaaaaaatataaaaagctctaagtgtcttgactgctggctgcagtaaatgataact

SEQ ID NO: 25420 - DNA, 249 bp, Homo sapiens
  D22S693
  Located on chromosome 22
  Distance between a terminus base of telomere on chromosomal short arm and 5'-terminus of this base sequence : 25652556
  Distance between 3'-terminus of neighbour sequence of sequence listing upward to telomere on chrosomal short arm and 5'-terminus of this base sequence : 150197
tatgtacagacctgcaacttgcttttctgcccaaaagaatatctaggacatctcaggagctatctaatatgtatatatatatatgtatgtatgtatgtatgtacatacatataatagatggatagatgattaatggtagatagatagatagatagatagatagatagatagatagatagatagatagatagatagacagacagacagatagataggcaggcaggcagattgagatggggtctcactttg

SEQ ID NO: 25421 - DNA, 332 bp, Homo sapiens
  AL080241.14_46183
  Located on chromosome 22
  Distance between a terminus base of telomere on chromosomal short arm and 5'-terminus of this base sequence : 25664433
  Distance between 3'-terminus of neighbour sequence of sequence listing upward to telomere on chrosomal short arm and 5'-terminus of this base sequence : 11628
tatgaaccttaagcggtgaagaaatcattcttggggagataggaggcaaaacggacaggatagaagaactgcacttgatgacttgtcctgggtggtattaatagtttcatagacatttgcttactaatagattattgaattatacattttgttttgtataccttcatgtttctagattaatttttgacaaaaagaaaatgtgtatgtgtgtgtgtgtgtgtgtgtgtgtgtgtgtgtgtgtgtgtatcctcaaatatataaagaatgaaactgcaaccgtaaaataagaacaggttacttttaaattcgaagaccagttcaggcaagttata

SEQ ID NO: 25422 - DNA, 314 bp, Homo sapiens
  AL121825.19_1866
  Located on chromosome 22
  Distance between a terminus base of telomere on chromosomal short arm and 5'-terminus of this base sequence : 25785342
  Distance between 3'-terminus of neighbour sequence of sequence listing upward to telomere on chrosomal short arm and 5'-terminus of this base sequence : 120577
gaggttcgtgtttcagttgtagcttctctaattgtccaaaatgacttatatgacattcactcccctagctcttccaatattcatgcaagccctaattcccagactaaaacttattcccaaaatattttaaatgcctctttttgctgtcagttgcagactcttagcaaccagatagacagacaggtaggtagataggtagataggtaggtagctaggtaggtaggtaggtaggtaggtaggtaggtaggtaggtaggtaagtaggtggatcgatcaatcaatcgatagatgaagagtttagattgactgattggt

SEQ ID NO: 25423 - DNA, 183 bp, Homo sapiens
  AL121825.19_10174
  Located on chromosome 22
  Distance between a terminus base of telomere on chromosomal short arm and 5'-terminus of this base sequence : 25793807
  Distance between 3'-terminus of neighbour sequence of sequence listing upward to telomere on chrosomal short arm and 5'-terminus of this base sequence : 8151
tttagaagcacattctgcctagctaacccaagattcacagcagagtaaaccctagacacacacacacacacacacacacacacacacacacacagttctgggtatgtagctctctccagttttatatagcactaatgctgactgttatatgtgaaattattctaatgccaactcctattctga

SEQ ID NO: 25424 - DNA, 258 bp, Homo sapiens
  AL121825.19_112518
  Located on chromosome 22
  Distance between a terminus base of telomere on chromosomal short arm and 5'-terminus of this base sequence : 25896012
  Distance between 3'-terminus of neighbour sequence of sequence listing upward to telomere on chrosomal short arm and 5'-terminus of this base sequence : 102022
tgaataaaagctgtcaagtaggagcccagccatgctgccaaacaagggttatttaagctctgggcaactggaacctccaggcaattggaccccatggaacaagatcctaccatttttcaaaggaagaggaaaattctaattttataagaactctaaaacacacttgggtcgggggcagagagagagacagacagacacacacacacacacacacacacacacacacacacacacacctatggctgatagttcatgacc

SEQ ID NO: 25425 - DNA, 267 bp, Homo sapiens
  AL121825.19_114695
  Located on chromosome 22
  Distance between a terminus base of telomere on chromosomal short arm and 5'-terminus of this base sequence : 25898229
  Distance between 3'-terminus of neighbour sequence of sequence listing upward to telomere on chrosomal short arm and 5'-terminus of this base sequence : 1959
atctgaattagctgagtgtggtagcacgaacctgtagtcccagctgctcaggaggctgaggcaggagaaccacctgaacccgggagggagaggttgcactaagccgagatcacaccagtgtgctctagcctggcaacagagcaacactccagctcacacacacacacacacacacacacacacacaaagggacagtacacacagcattcaaggtaatggcattacctctgggtaggatggggaaaacataaacaggtagctcgagtc

SEQ ID NO: 25426 - DNA, 168 bp, Homo sapiens
  D22S275
  Located on chromosome 22
  Distance between a terminus base of telomere on chromosomal short arm and 5'-terminus of this base sequence : 25910932
  Distance between 3'-terminus of neighbour sequence of sequence listing upward to telomere on chrosomal short arm and 5'-terminus of this base sequence : 12436
ctccagcctgtgcaacagagcaagactctgacactaacacacacacacacacacacacacacacacacacacacaggaaataaaaaaagaaatatttggctgggcatggtggctcacgctactaatctcagcactttgggaggctaaggcaggaggatgggttgagcc

SEQ ID NO: 25427 - DNA, 230 bp, Homo sapiens
  Z67356
  Located on chromosome 22
  Distance between a terminus base of telomere on chromosomal short arm and 5'-terminus of this base sequence : 26109234
  Distance between 3'-terminus of neighbour sequence of sequence listing upward to telomere on chrosomal short arm and 5'-terminus of this base sequence : 198134
ccccacctgaatgctcccaggtcctcacctggcactcccacaggaaactaaggactgccaggatgtcttggggttccagtagagtccatgtcctttgcgatggagtggttggggataaaacacacacacacacacacacacacacacacacacacgacactaggtatgtgtgctcttgagagaagcccattctgatctaactgccaactcctcaggaggctgtgttgtca

SEQ ID NO: 25428 - DNA, 300 bp, Homo sapiens
  chr22.fa.O7frz.26062754
  Located on chromosome 22
  Distance between a terminus base of telomere on chromosomal short arm and 5'-terminus of this base sequence : 26212728
  Distance between 3'-terminus of neighbour sequence of sequence listing upward to telomere on chrosomal short arm and 5'-terminus of this base sequence : 103264
cgactgtatactcacatctactgacctggggtctgcctgcctcccagagtccaggtgggctctgttctgctggtctaacttacccattcatccagatttcattgagaggggctttgtttttgtgtgtgtgtgggtgtgtgtgtgtgtgtgtgtgtgtgtgtgtgtgtgtttgagacagagtctcgctctgttgcccaggctggagtgcagtggggcgatcttggctcactgcaagctccacttcctgggtttacgccattctcctgcctcagcctcctgagtagctaggattacaggcac

SEQ ID NO: 25429 - DNA, 220 bp, Homo sapiens
  D22S1150
  Located on chromosome 22
  Distance between a terminus base of telomere on chromosomal short arm and 5'-terminus of this base sequence : 26297505
  Distance between 3'-terminus of neighbour sequence of sequence listing upward to telomere on chrosomal short arm and 5'-terminus of this base sequence : 84477
ggaacagtttgtgcccctgcatgtgcatgagcgtgcgtgtgcgcacacacacacacatacacacacacacacacacacacacacacacacactctgatgaattccaagcaagttggtgttgctgaaacataaattttaagaagaaaggggcaggagatgaggtctgagaagtacacagggctagatgatgtcaggtcttatggtctgggtatgaagcctg

SEQ ID NO: 25430 - DNA, 218 bp, Homo sapiens
  Z66750
  Located on chromosome 22
  Distance between a terminus base of telomere on chromosomal short arm and 5'-terminus of this base sequence : 26387837
  Distance between 3'-terminus of neighbour sequence of sequence listing upward to telomere on chrosomal short arm and 5'-terminus of this base sequence : 90112
ctgacaagtggaaagcaggtcagtggtcgcccctttatctctgtttctaacactgtctccttctgtgtgtgtgtgtgtgtgtgtgtgtgtctccctatactactgtctgtctttctgtctttccctccccctctcttccttttcctccctccgaggggtcaagggaggacacaggacacagccaactttggctttgtgaggccccaacttgcagacgt

SEQ ID NO: 25431 - DNA, 368 bp, Homo sapiens
  AL031186.8_7943
  Located on chromosome 22
  Distance between a terminus base of telomere on chromosomal short arm and 5'-terminus of this base sequence : 26430051
  Distance between 3'-terminus of neighbour sequence of sequence listing upward to telomere on chrosomal short arm and 5'-terminus of this base sequence : 41996
gtttcctacaaggcagatctactgacaaaaattccctcactgtttgtttgtctgaaagtcttcatttccctttcatgcatgaaggataatttttcagggtaaagaattctaggttgatgtgtttttttcctctcaatacttggtatattactctccactctcttgcttgcatggtttctgcagagttggttgtaattattattgttgctcctctgcaggaaagatattttttccctctgttttcttttcagtatttttttatctttgattctctgaagtttttctaaaaattattattattattattattattattattattattattattattattagagataaggtcatactctgtcacctcagaa

SEQ ID NO: 25432 - DNA, 159 bp, Homo sapiens
  DISO7_10004538
  Located on chromosome 22
  Distance between a terminus base of telomere on chromosomal short arm and 5'-terminus of this base sequence : 26614847
  Distance between 3'-terminus of neighbour sequence of sequence listing upward to telomere on chrosomal short arm and 5'-terminus of this base sequence : 184428
gccgttggataaggacacacaggtacatggacggaaacacacacatacacacacacacacacactctctctctgctgtggggatgctgataggattgtgtgtcttctttcccctggaaacaaaaacataattattttagcacttggagctaatgttctt

SEQ ID NO: 25433 - DNA, 231 bp, Homo sapiens
  chr22.fa.O7frz.26712479
  Located on chromosome 22
  Distance between a terminus base of telomere on chromosomal short arm and 5'-terminus of this base sequence : 26862440
  Distance between 3'-terminus of neighbour sequence of sequence listing upward to telomere on chrosomal short arm and 5'-terminus of this base sequence : 247434
ccaccttatggaaattgtaatatgatggaaattagagaacaaattggccaagcttttcattgacttacaaggagaaaattggagaagaactttcactgttttattgcttgtctttgcattatctttttgagcttgtgtgtgtgtgtgtgtgtgtgtgtgtgtgtgtgtgtgtgtgtatttggcttaggatttagaaaaagcagcagtcttagaaaccttgtatgaccagag

SEQ ID NO: 25434 - DNA, 320 bp, Homo sapiens
  AC004819.1_6130
  Located on chromosome 22
  Distance between a terminus base of telomere on chromosomal short arm and 5'-terminus of this base sequence : 27058852
  Distance between 3'-terminus of neighbour sequence of sequence listing upward to telomere on chrosomal short arm and 5'-terminus of this base sequence : 196181
acttgatgttaggagtttgagaccagcctggccaacatggtgaaaccccgtctctacaaaaaatacaaaaattaactgggcgtggcagcgggtggctgtaatcccagctactcgggaggctgaggcaggagaatcgcttgaacccaagaggcaaaggttgcagtgagccgagatggcaccactgcatcccagcctgggcgacagaggaagactcagtctcaaaaaaataaaataaaataaaataaaataaaataaaataaaataaaataagtgcatgtgctatgcaaatgtgccctgcaaatgcactagtttcctagtcc

SEQ ID NO: 25435 - DNA, 214 bp, Homo sapiens
  AC004819.1_35962
  Located on chromosome 22
  Distance between a terminus base of telomere on chromosomal short arm and 5'-terminus of this base sequence : 27088792
  Distance between 3'-terminus of neighbour sequence of sequence listing upward to telomere on chrosomal short arm and 5'-terminus of this base sequence : 29620
cagtattaaatggcaaatttcaacagtgcaaaaactgcaattacatttgcaccaaactaataatataatttttttttagttaaaaattttatagtacagaataacaggcttgtctcacacacacacacacacacacacacacacacacatacacacacacaaatcccatatagaatctacaaagcctgtctgtctctgaattccacaaccttgg

SEQ ID NO: 25436 - DNA, 216 bp, Homo sapiens
  AC003071.1_63067
  Located on chromosome 22
  Distance between a terminus base of telomere on chromosomal short arm and 5'-terminus of this base sequence : 27263007
  Distance between 3'-terminus of neighbour sequence of sequence listing upward to telomere on chrosomal short arm and 5'-terminus of this base sequence : 174001
agataacctgaataggcctataataagcagagattgcattagtagttaaaaacaacaacaacaacaacaacaacaacaacaacaaaccttccacaaagaaaagcccaggaccacatggcttcactggtgaattctaccagatatataaagaagaattcacactcttcccaaaaaataaaaggggagagaacacttctcaatgccttctatgagatg

SEQ ID NO: 25437 - DNA, 244 bp, Homo sapiens
  AC003071.1_115691
  Located on chromosome 22
  Distance between a terminus base of telomere on chromosomal short arm and 5'-terminus of this base sequence : 27315606
  Distance between 3'-terminus of neighbour sequence of sequence listing upward to telomere on chrosomal short arm and 5'-terminus of this base sequence : 52383
aagcaatcctttcactttgacctcccaaagtgctgggattacaggtatgagacaccacactgggcctcagctaggtatttatttatttatttatttatttatttatttatttagggaaagagtcttgctctgttgtccaggcttgagtgctggagtgcagtagttgatcacagctcactgcagccttgaccttctgggcccaagtaatcctttcagctcagcctccagtgtagctgaaaccata

SEQ ID NO: 25438 - DNA, 431 bp, Homo sapiens
  AC003071.1_116304
  Located on chromosome 22
  Distance between a terminus base of telomere on chromosomal short arm and 5'-terminus of this base sequence : 27316048
  Distance between 3'-terminus of neighbour sequence of sequence listing upward to telomere on chrosomal short arm and 5'-terminus of this base sequence : 198
gaaagcaggacaacctaagaacgcatagttcaactaatagattaaataagaaatgtgataatccttctcaagcatacatttagttgaaactatatgtattatatggactttgtggtaaacttagttgattgaagtttctctctcagccagccaaacatatgagagaatttagtaagtctagtaaagtggttactgtcactttcccactaaggattcctttttgttttccttcatggaatacatggaacacacacacacacacacacacacacacacacacacatacatacatgtgtatacatatgtagaatctttatttcttttaaaaattttattttgagatatacatataatagactacataaaaatatgtacagtttaaagaataatgagaacatccatatgtcctccatttaggctaagatgtagaa

SEQ ID NO: 25439 - DNA, 316 bp, Homo sapiens
  AC002378.1_72283
  Located on chromosome 22
  Distance between a terminus base of telomere on chromosomal short arm and 5'-terminus of this base sequence : 27422206
  Distance between 3'-terminus of neighbour sequence of sequence listing upward to telomere on chrosomal short arm and 5'-terminus of this base sequence : 105727
ggtgagcagatcacttgaggccaggagtttgagaccagcctggccaacatggtgaaaccccatctctactaaaatactaaaaatacaataataacaataataataataataataataataataataaccaggcatggcggcggacacctgtaatcccagctacttaggaggctgaggcacgagaatcgcttgaacccaggaggcagaggttgcagtgagccaagatcccaccgctgcactccagcctgggcaagagagcaagattctgtctcaaaaaaaaaactgcagaaaagactgtcagactcatttgaaagtc

SEQ ID NO: 25440 - DNA, 178 bp, Homo sapiens
  HUMUT5900
  Located on chromosome 22
  Distance between a terminus base of telomere on chromosomal short arm and 5'-terminus of this base sequence : 27495284
  Distance between 3'-terminus of neighbour sequence of sequence listing upward to telomere on chrosomal short arm and 5'-terminus of this base sequence : 72762
acagcctgggtgacagagtgagaccctgtctcaaataaatagttagatagatagatagatagacagacagacagacagacagacagacagacagatagatagacagatagctatagagaataacaagcaagagcccaggtctgggtgagcctctcctctcatagcacagggcttcacc

SEQ ID NO: 25441 - DNA, 125 bp, Homo sapiens
  chr22.fa.O7frz.27427267
  Located on chromosome 22
  Distance between a terminus base of telomere on chromosomal short arm and 5'-terminus of this base sequence : 27613149
  Distance between 3'-terminus of neighbour sequence of sequence listing upward to telomere on chrosomal short arm and 5'-terminus of this base sequence : 117687
ggatgacaatcaggttatcttaaataaataaatagaaaacaggacatacacaaacacacacacacacacacacacacacacatattcacaggaattgtctgtcattcactgtatgtttgaaggaa

SEQ ID NO: 25442 - DNA, 263 bp, Homo sapiens
  AL079299.12_13749
  Located on chromosome 22
  Distance between a terminus base of telomere on chromosomal short arm and 5'-terminus of this base sequence : 27897209
  Distance between 3'-terminus of neighbour sequence of sequence listing upward to telomere on chrosomal short arm and 5'-terminus of this base sequence : 283935
tcacagacacttgtctgatctagaccttgcccaaggtcatctggcggcttggtttttgcaagtgactggggtacacttgccacatggaccccttcctccccagtatttttgttgttgttgttgttgttgttgttgttgagatggagttttgctcttgttacccaggttggagtgcagtggcgcgatctcagctcaccgcaacctccgcctcccgggtttaagcaattctcctgcctcagcctctcgagtagctggaattacag

SEQ ID NO: 25443 - DNA, 272 bp, Homo sapiens
  AL022336.1_121766
  Located on chromosome 22
  Distance between a terminus base of telomere on chromosomal short arm and 5'-terminus of this base sequence : 27922660
  Distance between 3'-terminus of neighbour sequence of sequence listing upward to telomere on chrosomal short arm and 5'-terminus of this base sequence : 25188
ttgaatggaagttccatataagactaagtactttgctccagagtggtagcttttggtctttctgtgcatctggattcagattcgctgccctgtctctctctctctctctctctctctctctctctctctctctctctctctctctctctctatatatatatatatatatatatatatatatataattttttttttttttcccatggacatttttggggaagggcttctggaaaacatagcccaaggcagggattaaagagctaatgctggcc

SEQ ID NO: 25444 - DNA, 376 bp, Homo sapiens
  chr22.fa.O7frz.27904963
  Located on chromosome 22
  Distance between a terminus base of telomere on chromosomal short arm and 5'-terminus of this base sequence : 28090648
  Distance between 3'-terminus of neighbour sequence of sequence listing upward to telomere on chrosomal short arm and 5'-terminus of this base sequence : 167716
aaccatcagatctagtgagaactcactcactatcacaagaatagcatgggggaaaccacccccatggtccaatcacctcccacccggtccctcccctgacatgtggggattacaatttgagatgagatttgggtagggacacagccaaaccctattatcccagcactttggaaggctgaggcgggaggattgcttgagttgaagaatttgagaccagcctgggcaatatggcaagatatcatctttatattaataataataataataataataataaaagcagaaatcaattaaaaaaacaaagccaaaagttgattctttgaggcataaaaaaactgtcaaaatagaaaactactgacaagactgatcaagatag

SEQ ID NO: 25445 - DNA, 318 bp, Homo sapiens
  chr22.fa.O7frz.28234121
  Located on chromosome 22
  Distance between a terminus base of telomere on chromosomal short arm and 5'-terminus of this base sequence : 28419837
  Distance between 3'-terminus of neighbour sequence of sequence listing upward to telomere on chrosomal short arm and 5'-terminus of this base sequence : 328813
gcaagttaatctttggaatttctggattctcttagagctaaaaaacttcagaactagaagaaaccacccactatatggtataacccattcatatcacagatgaggcctgaaaccaaaaagacttgctcaggccatggatgacaagagctggccctagcactgaactcttgggtcatttgtaggtctagtcagatgctagcttgttagctctgtgcgtgcgtgtgtgtgtgtgtgtgtgtgtgtgtgtgagatagagacagaaagataacatatgtacacaaatacataaagaggaagtagacacgttagcatggtaga

SEQ ID NO: 25446 - DNA, 378 bp, Homo sapiens
  AC002073.1_1272
  Located on chromosome 22
  Distance between a terminus base of telomere on chromosomal short arm and 5'-terminus of this base sequence : 28497498
  Distance between 3'-terminus of neighbour sequence of sequence listing upward to telomere on chrosomal short arm and 5'-terminus of this base sequence : 77343
gttgagtctggttagtactcagatgggagaaacctagtacctgttggcagccactcttcattttcctttctcctcaccctctggcaacctctgatctccttcttttttaaataataataataataattattattattattattattattattgttattattattttgagacggagtctcgctctgtcagccaggctggagtgcagtggcatgatctcggctcactgcaagctccgcctcccaggttcacgccattctcctgcctcagcctcccgagtagctgggactacaggcgcccgccagcgtgcccggctaattttttgtatttttagtagagacggggtttcaccacggtctcgatctcctgaccttatgatcc

SEQ ID NO: 25447 - DNA, 469 bp, Homo sapiens
  chr22.fa.O7frz.28456944
  Located on chromosome 22
  Distance between a terminus base of telomere on chromosomal short arm and 5'-terminus of this base sequence : 28642730
  Distance between 3'-terminus of neighbour sequence of sequence listing upward to telomere on chrosomal short arm and 5'-terminus of this base sequence : 144854
tacctttaacaagatttattggagacacacacacacacacacacactcatatatacacacatacatatatacatacatatatacacacacatatacacatatacatacacatacatatacacacatacatacacacatatatatatactacacacacacacacacacacacacacacacacacacacacacacacacacaaaagagacagggtcttgttctgttgcccagtctggagtgcagtggtgcaatcatggcttgctgcagccttgacctctcagacacaagcgatcctctcatctcagcctcctgagtagctgggactacaggtgtatgccaccacacccaactaatttttatattttttgtagagatggggttttgccacgttgcccaggctggtcttgaactcctgggctcaagcaatcctctggccttggcctcccaaagtgctggctaaattatagacg

SEQ ID NO: 25448 - DNA, 240 bp, Homo sapiens
  AL096701.14_124696
  Located on chromosome 22
  Distance between a terminus base of telomere on chromosomal short arm and 5'-terminus of this base sequence : 28717609
  Distance between 3'-terminus of neighbour sequence of sequence listing upward to telomere on chrosomal short arm and 5'-terminus of this base sequence : 74410
caggtggtagcatgtacttgtagttgcagctcctcaggaggctgaggtgggaagatcacctgaatctgggaggtcaaggatgcagtgagccgtgattgcatcactgtattccagtggggcaacagaatgagactctgtcattcatagatagatagatagatagatagatagatagatagatagatagatagataaagtagcttaataacttgatactctctgttctgttccattggccta

SEQ ID NO: 25449 - DNA, 85 bp, Homo sapiens
  D22S1176
  Located on chromosome 22
  Distance between a terminus base of telomere on chromosomal short arm and 5'-terminus of this base sequence : 29022650
  Distance between 3'-terminus of neighbour sequence of sequence listing upward to telomere on chrosomal short arm and 5'-terminus of this base sequence : 304801
ggggtatgcgtgtacgtgtgtgtgtgtgtgtgtgtgtgtgtgtgtgtgtgtgtgtaggtaggtgtgtccactagagatggcacag

SEQ ID NO: 25450 - DNA, 195 bp, Homo sapiens
  D22S273
  Located on chromosome 22
  Distance between a terminus base of telomere on chromosomal short arm and 5'-terminus of this base sequence : 29048109
  Distance between 3'-terminus of neighbour sequence of sequence listing upward to telomere on chrosomal short arm and 5'-terminus of this base sequence : 25374
gactacagcccagacccagtgacagcctcaggagatcccactggaacagccctcagagatgtgctgagttgggccaacgcgcacacacacacacacacacacacacacacacacacttcattgcctatgacacacacacacacacttcattgcctatgacacacacacacacacacacacttcattgcctatggc

SEQ ID NO: 25451 - DNA, 252 bp, Homo sapiens
  Z83849.1_11130
  Located on chromosome 22
  Distance between a terminus base of telomere on chromosomal short arm and 5'-terminus of this base sequence : 29283170
  Distance between 3'-terminus of neighbour sequence of sequence listing upward to telomere on chrosomal short arm and 5'-terminus of this base sequence : 234866
cagatacatgatttgcacgtattttctcccagtctgtggatggcttactttcttgagagccccatcttttgaataatagtttaaatctctttctgttatatcataaatatttcaggtgagagaccttataaaaatcccctcagatggaaacacacatacacaaacacacacacacacacacacacacacacacacacacacacacaccccaccaccttcatcatcgtccagttgcaaagtattcacctcaag

SEQ ID NO: 25452 - DNA, 310 bp, Homo sapiens
  chr22.fa.O7frz.29170965
  Located on chromosome 22
  Distance between a terminus base of telomere on chromosomal short arm and 5'-terminus of this base sequence : 29356654
  Distance between 3'-terminus of neighbour sequence of sequence listing upward to telomere on chrosomal short arm and 5'-terminus of this base sequence : 73232
gtgtttagtgaacagattgcaccaatgtcaatttcctgactctgctaatgcactatagttatacaaagtgtcatattggggaagccggggagggttctggggattctacttattgttgttgcaacttcctctgagtctataattgtttcaaaataaaggtttttaaaaggagaaaaaaaaagaaaacctctcctgagctctgcttcttcagtgggcagcctgtgtctggatggaggggagggatgcgtgtgtgtgtgtgtgtgtgtgtgtgtgtttgtgtgtgtgtgtgtttctgaactggacatctttt

SEQ ID NO: 25453 - DNA, 220 bp, Homo sapiens
  AL021937.1_138636
  Located on chromosome 22
  Distance between a terminus base of telomere on chromosomal short arm and 5'-terminus of this base sequence : 29642095
  Distance between 3'-terminus of neighbour sequence of sequence listing upward to telomere on chrosomal short arm and 5'-terminus of this base sequence : 285131
gctgagcagtggaattgttgggtcaaagagcatacacacacacacacacacacacacacacacacacacacacacacacacatatatacacatatatacacacatatatataagattatatactgtatttttactgtcccttttctatgactagatatgcttagatacaaaagtacttaccattgtattacaattgcttacagtattcagtgcagtctca

SEQ ID NO: 25454 - DNA, 366 bp, Homo sapiens
  AL021937.1_153189
  Located on chromosome 22
  Distance between a terminus base of telomere on chromosomal short arm and 5'-terminus of this base sequence : 29656380
  Distance between 3'-terminus of neighbour sequence of sequence listing upward to telomere on chrosomal short arm and 5'-terminus of this base sequence : 14065
agacctgaagtttgttcatgagtcttacctcaagcagaggaagtgtccaaagctggagagcaccttcgattctctctgcctttgaagctgatgtgttctccaccttgcgccttaaactcagctgctaaaaagccaagataattaagtctgactcatctcagtggtgaatttttttaatgcctctttcaaaatgtgatacataattgcttcactacaattacccaatggcatgaatgagcactacagtatctacctagataaacagacagtgccacctatgcaataattatcttcctgcaaaacacacacacacacacacacacacacacacacacaccacttgtgaaattgtgatggctactttac

SEQ ID NO: 25455 - DNA, 220 bp, Homo sapiens
  D22S280
  Located on chromosome 22
  Distance between a terminus base of telomere on chromosomal short arm and 5'-terminus of this base sequence : 30005419
  Distance between 3'-terminus of neighbour sequence of sequence listing upward to telomere on chrosomal short arm and 5'-terminus of this base sequence : 348673
gctccagcctatcaggatgtgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgggccagattcagccttgtgggtcaccagttttgtgatctggaatc

SEQ ID NO: 25456 - DNA, 234 bp, Homo sapiens
  Z17028.1_102
  Located on chromosome 22
  Distance between a terminus base of telomere on chromosomal short arm and 5'-terminus of this base sequence : 30005438
  Distance between 3'-terminus of neighbour sequence of sequence listing upward to telomere on chrosomal short arm and 5'-terminus of this base sequence : -201
tgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgggccagattcagccttgtgggtcaccagttttgtgatctggaatccattttatttctagaatctcctttcaattctcg

SEQ ID NO: 25457 - DNA, 223 bp, Homo sapiens
  Z83846.1_58692
  Located on chromosome 22
  Distance between a terminus base of telomere on chromosomal short arm and 5'-terminus of this base sequence : 30220551
  Distance between 3'-terminus of neighbour sequence of sequence listing upward to telomere on chrosomal short arm and 5'-terminus of this base sequence : 214879
atttatagcctgtaatttccagtctccaggctggatgatccatgacgcttgctgggcagaggaagggattaagcagcaaggaggggctggcacagcccactaggaagtataataagaaccatgatggtggtggtggtggtggtggtggtggtggtggtggtggtggtggtgatggtggtggtggtggtggtggtggggttgctaccattaactgagcctcttt

SEQ ID NO: 25458 - DNA, 282 bp, Homo sapiens
  Z82198.2_103259
  Located on chromosome 22
  Distance between a terminus base of telomere on chromosomal short arm and 5'-terminus of this base sequence : 30395061
  Distance between 3'-terminus of neighbour sequence of sequence listing upward to telomere on chrosomal short arm and 5'-terminus of this base sequence : 174287
tgacaggcaagatagaacctagaaaaatagaatctaaactctctctctctctctctctctctctctctctctctgtgtgtgtgtgtgtgtgtgtgtgcaagagagaatgagagagaaagagagagacagacagacagacagagagaggctggtgattcaaggtcccagtgcagataaacagactcactctttctcctccccaaacaaaactagatttttttatttgtcacacttgaagctcatctgctttcccactccctcattaaaattctgagctactgc

SEQ ID NO: 25459 - DNA, 274 bp, Homo sapiens
  AL008630.1_32967
  Located on chromosome 22
  Distance between a terminus base of telomere on chromosomal short arm and 5'-terminus of this base sequence : 30470397
  Distance between 3'-terminus of neighbour sequence of sequence listing upward to telomere on chrosomal short arm and 5'-terminus of this base sequence : 75054
agtcattccatgcctgaatctctgatccctagagactgtgagatcacaaatttgtttcaagctgctatgtttgtggtaatttgttatacagtagtagcaaatgaatacaatcatataaccacaataagaagcagctaatattagttaaccacttactgtgtactgggactattttaaatctctctctctcacacacacacacacacacacacacacacacacacgcagatattgttttaaattcttataacttaccaaatgtcaaagtacaagt

SEQ ID NO: 25460 - DNA, 264 bp, Homo sapiens
  D22S1172
  Located on chromosome 22
  Distance between a terminus base of telomere on chromosomal short arm and 5'-terminus of this base sequence : 30470453
  Distance between 3'-terminus of neighbour sequence of sequence listing upward to telomere on chrosomal short arm and 5'-terminus of this base sequence : -218
tcaagctgctatgtttgtggtaatttgttatacagtagtagcaaatgaatacaatcatataaccacaataagaagcagctaatattagttaaccacttactgtgtactgggactattttaaatctctctctctcacacacacacacacacacacacacacacacacacgcagatattgttttaaattcttataacttaccaaatgtcaaagtacaagtagtcagtggtggagttgtgattcaaacccgggaagccttgctcaaa

SEQ ID NO: 25461 - DNA, 456 bp, Homo sapiens
  chr22.fa.O7frz.30402561
  Located on chromosome 22
  Distance between a terminus base of telomere on chromosomal short arm and 5'-terminus of this base sequence : 30588303
  Distance between 3'-terminus of neighbour sequence of sequence listing upward to telomere on chrosomal short arm and 5'-terminus of this base sequence : 117586
tcttattcataatccaacagaaagtaagtttattaaaaaccacttaatttaaaatcccctgctgattttacctgggactcacttttgatcatataaatgaaaaggttctgtaatccagcttttgctttttaaattatttcttcctgaaagctttttgagagagaaagacagagtgagagacagagagagtgacagagagagagagagagagagagagagagagagagatagggaaggagggaggggtgggagagaaagtggaaatccttccatctcaaaccttccctaacttggctgggtttttctcaagtgtgaatggaatggggtgtggtcattcactcactcattcattcaataaatatatattttagcaacacagagacaaagaacacagtcgtccctgcccgagagagcttggaggtgttatgggcaaatagaggtatgttctaggcagac

SEQ ID NO: 25462 - DNA, 404 bp, Homo sapiens
  Z73421.1_357
  Located on chromosome 22
  Distance between a terminus base of telomere on chromosomal short arm and 5'-terminus of this base sequence : 30705677
  Distance between 3'-terminus of neighbour sequence of sequence listing upward to telomere on chrosomal short arm and 5'-terminus of this base sequence : 116918
attgcaacaggactgatagaacccttgagttggaagagacaagagttcatttttctaatcccggaacgctcccacatgtgaaaaagcagcatctctcagggattggaatgctggctgagagactgcaatgccagatacagaaagctctagagacttaagagctgatgtacacacacacacacacacacacacacacacacacgagtcatgtgccacataatgatgttttggtcaacaacagacagtatagtgttgtggtcccataagattatgacgttgcatttttactgtcccttttctatgttgagatacacaaatacttaccattttgttacaactgcctacagtattcagtatagtgacatgctgcccaggctgtagcctagaagcaacaggctatacca

SEQ ID NO: 25463 - DNA, 435 bp, Homo sapiens
  AL133451.1_31621
  Located on chromosome 22
  Distance between a terminus base of telomere on chromosomal short arm and 5'-terminus of this base sequence : 30741888
  Distance between 3'-terminus of neighbour sequence of sequence listing upward to telomere on chrosomal short arm and 5'-terminus of this base sequence : 35807
cgatagtttgctcagaatgaaggtttcccatcattctgttgcttcatccatgttgctacaaaggacacgaactcaccctttgtttacggctgcatagtattccatggtgtacatgtgccacattttcttaatccagtccacagggtcaggggatgggggagggttagcattaggagaaatacctaatgtaaatgattagttaatgggtgcagcaaaccaacacagcacatgtatacatatgtaacaaacctgcacattgtgcacatgtaccctagaacttaaagtatacacacacacacacacacacacacacacacacacatatatatatatgtatgtatgtatatatatatagaagttgtggaaggtttagatttcatttcttgggccagtcgctattaaccacttaaaactaccaagtccactacatattcc

SEQ ID NO: 25464 - DNA, 279 bp, Homo sapiens
  Z69713.2_29570
  Located on chromosome 22
  Distance between a terminus base of telomere on chromosomal short arm and 5'-terminus of this base sequence : 30905831
  Distance between 3'-terminus of neighbour sequence of sequence listing upward to telomere on chrosomal short arm and 5'-terminus of this base sequence : 163508
atttaatattagccagctatggtggcatgtgcctgtgttcccagctatttaggaggctgaggtgagaggattacttgagtttgggaggttgaggctgcagtgagccaggatggtgctgctgcactccagcctgggtgacagcaagaccctgtctcaaagaaaaagtaaataacgtaacataacgtaacataacataacataacataacataacataacataacataacataacataaaacaaaatgagtacccagtggtcaataatgaaagcagaatca

SEQ ID NO: 25465 - DNA, 290 bp, Homo sapiens
  Z54073.2_9302
  Located on chromosome 22
  Distance between a terminus base of telomere on chromosomal short arm and 5'-terminus of this base sequence : 31008602
  Distance between 3'-terminus of neighbour sequence of sequence listing upward to telomere on chrosomal short arm and 5'-terminus of this base sequence : 102492
agatttcagcatacaaattctgagggggtgtaaacattcagaccatagcaggcaggcaggcgggagggcgggtggacatacagacagacggatgcacggatggatggatagatagatagatagacagacagacagacagacagacagacagacagacagacagacagatacagaaagacagatacagacagacaatgtttttggggccaagattcaaattcaggcatatctggccaccaaaattaatatccttttcacaacgcagtgttcattctcaatcatttcaaatt

SEQ ID NO: 25466 - DNA, 190 bp, Homo sapiens
  Z54073.2_24363
  Located on chromosome 22
  Distance between a terminus base of telomere on chromosomal short arm and 5'-terminus of this base sequence : 31023677
  Distance between 3'-terminus of neighbour sequence of sequence listing upward to telomere on chrosomal short arm and 5'-terminus of this base sequence : 14785
ataactggacaagaacttgcagtttgcaaactcagacatagacataccactagcaaacagtggaagctacagggtcaggtcctaacacaacacacacacatgcatgtacacacacacacacacacacacacacacacacacatacacatacacagacttgagcctccaaagaggataacgttcaagctgc

SEQ ID NO: 25467 - DNA, 370 bp, Homo sapiens
  Z54073.2_35523
  Located on chromosome 22
  Distance between a terminus base of telomere on chromosomal short arm and 5'-terminus of this base sequence : 31034814
  Distance between 3'-terminus of neighbour sequence of sequence listing upward to telomere on chrosomal short arm and 5'-terminus of this base sequence : 10947
tcaactcatttaaagtagccacatgccgctaatggctactgatctagagggcagctgggatgttactcttgagaatgtctccagcattttacctgttgctctctctcactcacatttcccattctagcacaaacaaaacaaaacaaaacaaaacaaaacaaaacaaaacaaaacaaaaaaaccacaacacctacagttctccaaacagggcatctgttttgttcctctgggggggtcctgtctatgttgttcacgtggccctggatttccatactcctagccttcctggaagacatccttttcatcctcacaacccaacccaggctttatctcttctgtgaagctgtccttgattttccgttctatcttc

SEQ ID NO: 25468 - DNA, 257 bp, Homo sapiens
  Z69715.2_20380
  Located on chromosome 22
  Distance between a terminus base of telomere on chromosomal short arm and 5'-terminus of this base sequence : 31062416
  Distance between 3'-terminus of neighbour sequence of sequence listing upward to telomere on chrosomal short arm and 5'-terminus of this base sequence : 27232
ccacaattctatgaagacaagtactgacacagttgggttttacacatgaagtcactaaatcttcattaacaacaaataccagtgacaggtatcaacatggtaccaagtgctttacagacaaactcattttattcccacaacaaccctaaccccacaacatccccatgactgtctgtgttgttgttgttgttgttgttgttgttgtttgagaccgtctcgttctgttgcccaggctggagtacagtagcgcaatctcg

SEQ ID NO: 25469 - DNA, 395 bp, Homo sapiens
  Z69715.2_22183
  Located on chromosome 22
  Distance between a terminus base of telomere on chromosomal short arm and 5'-terminus of this base sequence : 31064237
  Distance between 3'-terminus of neighbour sequence of sequence listing upward to telomere on chrosomal short arm and 5'-terminus of this base sequence : 1564
cagtaagaatgcagactctgacgtgacactgccttcattatttgcactgtgaaatgggcacgccagcatccacttcacagagtcattctcaggttgagtgtaccagaagtgctgagaaccttccatggcacagagcagacacgcagtaaatgctatctattattattattattattattattattattattattattactagcacgatctttgccattaaagaatttaacacggctcctaagaaaatacacagcagctgctatccatcgtcatcaccagtgtcatcatcgccatccccatcatcaccaccaacaccgccacccccccagcgacacactagctgtggacacatcctttacgcccttgaacctgagtttctacagctatgaagcaag

SEQ ID NO: 25470 - DNA, 155 bp, Homo sapiens
  D22S1162
  Located on chromosome 22
  Distance between a terminus base of telomere on chromosomal short arm and 5'-terminus of this base sequence : 31106990
  Distance between 3'-terminus of neighbour sequence of sequence listing upward to telomere on chrosomal short arm and 5'-terminus of this base sequence : 42358
tgtctcccaatcaacatagggatggatgatagagacaagacaaacatacaaacacaaacacacacacacacacacacacacacacacagagagagagagagagagagaggcttctaacttttattcccattatccttctggctgctgtttctaaa

SEQ ID NO: 25471 - DNA, 396 bp, Homo sapiens
  Z68223.1_3554
  Located on chromosome 22
  Distance between a terminus base of telomere on chromosomal short arm and 5'-terminus of this base sequence : 31132627
  Distance between 3'-terminus of neighbour sequence of sequence listing upward to telomere on chrosomal short arm and 5'-terminus of this base sequence : 25482
ataaactcatatgctagcatgctctgagctgggagttcgattaaaaaccgtagtcttagtgaaaaagggtcagttgcaagataattttgatctgggcacatattctttagactcaatccagtgtactagctcaaacaactgcaagtcgttctaattgatggcttggttggttgactaaaatgtatacacaagtgcacacgcacgcacacacacacacacacacacacacacacacacgcaagactggaccccaaatgattttgaagacacaaataaattgcatccatcccttgctcaggttccgagtatacttatgccttttactctgctgccattccacatctatgacatcatgggattttccagtaacagaaaaggaaacctttgagttaggtg

SEQ ID NO: 25472 - DNA, 141 bp, Homo sapiens
  D22S281
  Located on chromosome 22
  Distance between a terminus base of telomere on chromosomal short arm and 5'-terminus of this base sequence : 31132755
  Distance between 3'-terminus of neighbour sequence of sequence listing upward to telomere on chrosomal short arm and 5'-terminus of this base sequence : -268
gctcaaacaactgcaagtcgttctaattgatggcttggttggttgactaaaatgtatacacaagtgcacacgcacgcacacacacacacacacacacacacacacacacgcaagactggaccccaaatgattttgaagaca

SEQ ID NO: 25473 - DNA, 259 bp, Homo sapiens
  Z17064.1_78
  Located on chromosome 22
  Distance between a terminus base of telomere on chromosomal short arm and 5'-terminus of this base sequence : 31132764
  Distance between 3'-terminus of neighbour sequence of sequence listing upward to telomere on chrosomal short arm and 5'-terminus of this base sequence : -132
actgcaagtcgttctaattgatggcttggttggttgactaaaatgtatacacaagtgcacacgcacgcacacacacacacacacacacacacacacacacgcaagactggaccccaaatgattttgaagacacaaataaattgcatccatcccttgctcaggttccgagtatacttatgccttttactctgctgccattccacatctatgacatcatgggattttccagtaacagaaaaggaaacctttgagttaggtg

SEQ ID NO: 25474 - DNA, 319 bp, Homo sapiens
  AC025639.3_157417
  Located on chromosome 22
  Distance between a terminus base of telomere on chromosomal short arm and 5'-terminus of this base sequence : 31153706
  Distance between 3'-terminus of neighbour sequence of sequence listing upward to telomere on chrosomal short arm and 5'-terminus of this base sequence : 20683
gaaacatataccatgttcaaggattggcactctcaaacttatatgtttttgtttatatgtttattatctgcatctccccataggatacaagctctttgagggcaggaatttttttctgtttcatttattgatgtatcttcagtgtctattaatagtgtctggcacatagtagttgctcattaaatatttcttgaatgaataaccatcctgggtcccaaagtagctttgattttgctcacatctcaaggaaaacaaacaaacaaacaaacaaacaaacaaacaaacagaaacctgtctgtcttgttcctatctaaaacca

SEQ ID NO: 25475 - DNA, 285 bp, Homo sapiens
  Z74581.1_21597
  Located on chromosome 22
  Distance between a terminus base of telomere on chromosomal short arm and 5'-terminus of this base sequence : 31236378
  Distance between 3'-terminus of neighbour sequence of sequence listing upward to telomere on chrosomal short arm and 5'-terminus of this base sequence : 82353
gtatctggcatttggtaaacactatatatgttttagacacatatatagtcaacactatgtatgtgtttactaaataaatgtatagtgtttactaaataatatcatcatcatcaccacggttttaatgccattgattttttgactggctcattcattcatttattcattcaattcaattcattcattcattcattcattcagcatttgccatgtgccaagccctgcacaaggcattaacggtacagagataggaaagtgggggtcttgttctcaagctcatgaagt

SEQ ID NO: 25476 - DNA, 440 bp, Homo sapiens
  Z68323.2_21277
  Located on chromosome 22
  Distance between a terminus base of telomere on chromosomal short arm and 5'-terminus of this base sequence : 31391481
  Distance between 3'-terminus of neighbour sequence of sequence listing upward to telomere on chrosomal short arm and 5'-terminus of this base sequence : 154818
gacttggactggaatctatacctaaatctgcaagctctccagctctcagactttacctaaatctgtctcagaccatacctaaatctctctctctctttctctctgtctctccctctccctctcttacagggcagttgtttatagaatatatctcaatttgagtttgatgtttttgagagacagaatatctatctgtctgtctatctatccatccatccatctatcatctatttattatctatctatctatctatctatctatctatctatctatctatctatcctgcttttctagagaacacagactaatgtaggtgataactaggatcccttccccactaagaattgttcagggccctgcaccccagaggaagaacctatttcctttctttcccctggatccactgctcaccttttcttctgcctacaatcctagaagt

SEQ ID NO: 25477 - DNA, 187 bp, Homo sapiens
  D22S685
  Located on chromosome 22
  Distance between a terminus base of telomere on chromosomal short arm and 5'-terminus of this base sequence : 31391639
  Distance between 3'-terminus of neighbour sequence of sequence listing upward to telomere on chrosomal short arm and 5'-terminus of this base sequence : -282
tgagtttgatgtttttgagagacagaatatctatctgtctgtctatctatccatccatccatctatcatctatttattatctatctatctatctatctatctatctatctatctatctatctatcctgcttttctagagaacacagactaatgtaggtgataactaggatcccttccccactaagaa

SEQ ID NO: 25478 - DNA, 181 bp, Homo sapiens
  Z50860.1_11383
  Located on chromosome 22
  Distance between a terminus base of telomere on chromosomal short arm and 5'-terminus of this base sequence : 31551073
  Distance between 3'-terminus of neighbour sequence of sequence listing upward to telomere on chrosomal short arm and 5'-terminus of this base sequence : 159247
gcagacttactcctgcacatacacacacacacacacacacacacacacacacacacagacctacagatgcacactccaaatctagcaaaagatgaaatgataatatgaccaagttgagtttcttccagggatgcctggtggattcaaaattagaaatattatagccactacatttcaagcc

SEQ ID NO: 25479 - DNA, 239 bp, Homo sapiens
  22_31485402
  Located on chromosome 22
  Distance between a terminus base of telomere on chromosomal short arm and 5'-terminus of this base sequence : 31671661
  Distance between 3'-terminus of neighbour sequence of sequence listing upward to telomere on chrosomal short arm and 5'-terminus of this base sequence : 120407
ggcagtcaggatgaaataaggttccaatttcacatgggcattctgaatatgtcaaattggagcctcttctgcaaaatgagaataataatgccatcaaccacacagggatgttataaagaccaaacatagtaagatttgcatagttactttctgattatctgtctttgtttgtatctgtctatctatctatctatctatctatctatctatcaatggaggagcgtggtaagaaccataca

SEQ ID NO: 25480 - DNA, 309 bp, Homo sapiens
  AL021877.1_43567
  Located on chromosome 22
  Distance between a terminus base of telomere on chromosomal short arm and 5'-terminus of this base sequence : 31752640
  Distance between 3'-terminus of neighbour sequence of sequence listing upward to telomere on chrosomal short arm and 5'-terminus of this base sequence : 80740
acgattccttcattgactgtagaaaatcattactcatcatatctttaattgccaaatcccctttctctccatttctttctctccatttctttcctagaaatttgaatacaggtgcattgaaaattcctcctagatgttgtcagtgttctgaattttggccattccaaaagctgtgtagtggcatctcgttgttttaatttgcatttatatatgatggcatgcaatatggagaatcttttcatattttatttgctatatatatatatatatatatatatatatatattctttggtgaggtgtctgttaag

SEQ ID NO: 25481 - DNA, 167 bp, Homo sapiens
  D22S1147
  Located on chromosome 22
  Distance between a terminus base of telomere on chromosomal short arm and 5'-terminus of this base sequence : 31807421
  Distance between 3'-terminus of neighbour sequence of sequence listing upward to telomere on chrosomal short arm and 5'-terminus of this base sequence : 54472
acgacacactacatggagatatatatacacatacacacacacacacacacacacacacacacacacacacacacacacatatatatatatatttatttataatccagttctacttccatgattctaagcatgaccaatacgtcagcaaggggcactctgctctttaa

SEQ ID NO: 25482 - DNA, 271 bp, Homo sapiens
  D22S1152
  Located on chromosome 22
  Distance between a terminus base of telomere on chromosomal short arm and 5'-terminus of this base sequence : 31935156
  Distance between 3'-terminus of neighbour sequence of sequence listing upward to telomere on chrosomal short arm and 5'-terminus of this base sequence : 127568
tgggtcctctcaaagcaaagggttattgtcttgatgaaaaattaatggagagaatcatttctcgtgtgtgtgtgtgtgtgtgtgtgtgagcgtgcatgcgtgtagtgttagcatgtgcataaatgactgaataacttaacctaaggagggatgtgaatgggtatagaacaatggctagagaatgccaagcatttgccttggaaacaaggaaggctgcaccttatagggccgatctggcttttccagattggttattccaaggcaccctgag

SEQ ID NO: 25483 - DNA, 248 bp, Homo sapiens
  Z82194.1_6971
  Located on chromosome 22
  Distance between a terminus base of telomere on chromosomal short arm and 5'-terminus of this base sequence : 32090737
  Distance between 3'-terminus of neighbour sequence of sequence listing upward to telomere on chrosomal short arm and 5'-terminus of this base sequence : 155310
aggtatgagctatggtagattgattgtagcgatgcccccaattaaaggccttcctgtatctatgccctttcaaatgggatattgaactccccaccacccgaccacacacacacacacacacacacacacacacacacacacacacacacacacatctaaagatggtgtccatttttcttacctccttgaatctgggctggctgtgtgaattgctttggcaaatagaatgtgatagaagcataggccta

SEQ ID NO: 25484 - DNA, 279 bp, Homo sapiens
  Z82194.1_102134
  Located on chromosome 22
  Distance between a terminus base of telomere on chromosomal short arm and 5'-terminus of this base sequence : 32185976
  Distance between 3'-terminus of neighbour sequence of sequence listing upward to telomere on chrosomal short arm and 5'-terminus of this base sequence : 94991
ttcatggagcttacattagaagtagaagtagtagtagtagtagtagtagtagtagaagggaggataaataatgaacatgtttataagtaagtgaagaaaataacatcagaagtgatacatgtgatacagagtcaccgcaggattaagtagggcatgcctgctttggacaagcctttttgaggaggtgacattaagccgagcctttaaggatgaagaggagtcattcatgtaaagagaagacagaagagtatcccaaactgttaagtacaaaggctcaga

SEQ ID NO: 25485 - DNA, 340 bp, Homo sapiens
  Z82194.1_144467
  Located on chromosome 22
  Distance between a terminus base of telomere on chromosomal short arm and 5'-terminus of this base sequence : 32228080
  Distance between 3'-terminus of neighbour sequence of sequence listing upward to telomere on chrosomal short arm and 5'-terminus of this base sequence : 41825
agctataagcctatgaatgtcaaggattgctgggaacactaggagctaagggaaaggcacagaatagatccctacttacagtcttgctatggtttgaatgtttttatctcctctaaaactcaggttgaaacctaatccccaatgcaactgtgttgggaggtgggacctaatggatgctgtttaggtcatgaaggcagaagcctcatggattaatgcttctataaaaagggctttcaggagggaatttctctctccctctctctctctctctctctctctctctctctgtctctctcttctgccatgtgaagactcagggtttatccttctaccttccacc

SEQ ID NO: 25486 - DNA, 194 bp, Homo sapiens
  AL024494.1_4882
  Located on chromosome 22
  Distance between a terminus base of telomere on chromosomal short arm and 5'-terminus of this base sequence : 32269571
  Distance between 3'-terminus of neighbour sequence of sequence listing upward to telomere on chrosomal short arm and 5'-terminus of this base sequence : 41151
aattcctcaccagtatgaattttaggcacccctccttattccaagagaggccactaaaactgtgagacacaagcacaacatcatcatcatcatcatcatcatcatcatcacctctcaaggacaaacatttatcctgagaatgtgtagttcaaagctaatgagaaaacatatttttctcaccaggctatgacttg

SEQ ID NO: 25487 - DNA, 345 bp, Homo sapiens
  Z99755.1_54032
  Located on chromosome 22
  Distance between a terminus base of telomere on chromosomal short arm and 5'-terminus of this base sequence : 32348177
  Distance between 3'-terminus of neighbour sequence of sequence listing upward to telomere on chrosomal short arm and 5'-terminus of this base sequence : 78412
aatggtgacatgacgattctagattttggaatactttgaaagcgaggtagttttaaagtgcccagcatacatcctttccttgtcccatttttctggcaacagagcggcttttcaggaaaatcccatccatccatgccagcctgaacaataccctacacacacacacacacacacacacacacacacacacacacacactggcaacagagcggcttttcaggaaaatcccatccatccatgccagcctgaacaataccctacacacacacacacacacacacacacacacacacacacacacacacactctctctctctctctcttacttttcaaggaatagccgt

SEQ ID NO: 25488 - DNA, 381 bp, Homo sapiens
  AL031300.1_31673
  Located on chromosome 22
  Distance between a terminus base of telomere on chromosomal short arm and 5'-terminus of this base sequence : 32424012
  Distance between 3'-terminus of neighbour sequence of sequence listing upward to telomere on chrosomal short arm and 5'-terminus of this base sequence : 75490
agtacctacttcagaggatggttgtaaaaattaaatgagatgactcacttttatgatgtctctaaaattaattttaaatagactcacttataagtgctttatacaaagggcactttgatgtgtaatttttattattattattattattattattattattgagacagagtctctctgttgcccaggctgagtgcagtggcgcgatctcggcttactgcaacctccatctcccaggttcaagcgattctcctgcctcagcctcccgagtagctgggactacaggcgcctgccaccacgcctggctaatttttgtatttttagtagagacggggtttcaccatgtaagttattttttaaggaaaatgtattcacctggccata

SEQ ID NO: 25489 - DNA, 389 bp, Homo sapiens
  AL008635.1_7532
  Located on chromosome 22
  Distance between a terminus base of telomere on chromosomal short arm and 5'-terminus of this base sequence : 32439471
  Distance between 3'-terminus of neighbour sequence of sequence listing upward to telomere on chrosomal short arm and 5'-terminus of this base sequence : 15078
agctgatcactatttgctgaagatgcaagagggactctcacaagagctggaactgtctttccagttagcgctctcctcttccatgctctgcgtgtgaatgccagccactttggcctccccaaactccccactccatctcctcaactcagagataccatggggctccaaagagatcaataaactgttctggaaactctccaggcattaagccaaggcagccatagtttgtctccctgtctcggaggtcactcccttgtgctgcccgatgcataatgtctgaaaaccattttagacttttttttgctggtttgtttgtttgtttgtttgtttgttttcattatcccaggcagcaggggaaatctggtccctgttactccaacttagctgga

SEQ ID NO: 25490 - DNA, 156 bp, Homo sapiens
  D22S424
  Located on chromosome 22
  Distance between a terminus base of telomere on chromosomal short arm and 5'-terminus of this base sequence : 32495079
  Distance between 3'-terminus of neighbour sequence of sequence listing upward to telomere on chrosomal short arm and 5'-terminus of this base sequence : 55219
ttgacatccctcagatggtgattctaatgatgctaatcaggaatgagtgtcagtcactggaatcacaaagttctcatccacctcccctcccaacacacacacacacacacccctttgtgcttgctggtccctctgcctgggttgcttgctcctgtg

SEQ ID NO: 25491 - DNA, 191 bp, Homo sapiens
  Z67524
  Located on chromosome 22
  Distance between a terminus base of telomere on chromosomal short arm and 5'-terminus of this base sequence : 32652750
  Distance between 3'-terminus of neighbour sequence of sequence listing upward to telomere on chrosomal short arm and 5'-terminus of this base sequence : 157515
ccagggcgacaaagtgagatcttgtctctaacgagagagagagagagagagagatagtgtgtgtgtgtgtgtgtgtgtgtgtgtgtgtgtgtgtactatagtgacaggcagggacaaatgctatgaagaaaaataaatcagggcaaggggatagagagtgataggagatgcaattttagagaggatcatca

SEQ ID NO: 25492 - DNA, 321 bp, Homo sapiens
  AL022334.1_82865
  Located on chromosome 22
  Distance between a terminus base of telomere on chromosomal short arm and 5'-terminus of this base sequence : 32715661
  Distance between 3'-terminus of neighbour sequence of sequence listing upward to telomere on chrosomal short arm and 5'-terminus of this base sequence : 62720
aggcaaggagtactaagaacctagaactgtactgagtcagcactcaaacaatcatttttataataatgaggaagaaggtcatggacccccagaaggtctgatgaaaggtaaggaccttcctggtggaagatttcacacacacacacacacacacacacacacacacacacacacaccccaaacactgcctgcaatttcatggggcccctgctccagaagtcaacccatcagtccccctggggaaactctgctcaagtcagccccattatttcctaaggaagggagaggagagggtccacatgtacgttccttcatttgatc

SEQ ID NO: 25493 - DNA, 415 bp, Homo sapiens
  AL022334.1_105593
  Located on chromosome 22
  Distance between a terminus base of telomere on chromosomal short arm and 5'-terminus of this base sequence : 32738273
  Distance between 3'-terminus of neighbour sequence of sequence listing upward to telomere on chrosomal short arm and 5'-terminus of this base sequence : 22291
atctgaggtcaggagttcaagaccagcctggccaacatggtgaaaccctgtctctactaaaactacaaaacattagccgggcatggtggtgggcacctgtaatcccagctactcaggaggacgaggcaggagaattgcttgaacccaggaggcagaggttgcagtgagctgccattgcactccaggctgggcaacaagagtgaaactctgtcaaaagaaagaaagagagagagagggagggagggagggaggaaggaaggaaggaaggaaggaaggaaggaaggaaggaagggcagatttcaggtgcaaatcccaacttgccttctttttagttggtggtcttgggcaaattactcaaactctctctgttttagtttcctcatctgtaaaatgaggatcattgtggaagttagtg

SEQ ID NO: 25494 - DNA, 224 bp, Homo sapiens
  AL049748.2_4875
  Located on chromosome 22
  Distance between a terminus base of telomere on chromosomal short arm and 5'-terminus of this base sequence : 32829279
  Distance between 3'-terminus of neighbour sequence of sequence listing upward to telomere on chrosomal short arm and 5'-terminus of this base sequence : 90591
actccagcctggagtataagaccctgtcgaaagaaagaacaaagaaagaaagagaaagaaagaaagagagagagagagagagaaggaaggaaggaaggaaggaaggaaggaaggaaggaaggaaggaaggaaggaagggaaagaggccctgagccgactagctatggccatgtaactgaaacagaattgatcctgatttcccctcaaatgctggttctaatcac

SEQ ID NO: 25495 - DNA, 368 bp, Homo sapiens
  AL079295.1_9800
  Located on chromosome 22
  Distance between a terminus base of telomere on chromosomal short arm and 5'-terminus of this base sequence : 32942349
  Distance between 3'-terminus of neighbour sequence of sequence listing upward to telomere on chrosomal short arm and 5'-terminus of this base sequence : 112846
ggctaaccattaagctaggaagacacgggtgcctcctagccaggctaaaaacaataaaacaacaaatgaaaatcaataagcagaaacactagtggccgtatactgtgtgggagtcacatgtcatagtttaagtatgggcaaattacttaaaacacacacacacacacacacacacacacacacatgcccatcacagaaaaataaataacaccccacagtcactacaatgcattactaaaatgtccaattttcattaaaaaattacaagcatgcaaagaaacagaaaagtgacccagattcaagaaaataagcagtaactagaaacagactaaggcccagatgttggatttagcagacaacgttaaagc

SEQ ID NO: 25496 - DNA, 257 bp, Homo sapiens
  AL079295.1_16841
  Located on chromosome 22
  Distance between a terminus base of telomere on chromosomal short arm and 5'-terminus of this base sequence : 32949387
  Distance between 3'-terminus of neighbour sequence of sequence listing upward to telomere on chrosomal short arm and 5'-terminus of this base sequence : 6670
gactttgaatccttgttacgtaactatttttaaagtgagtatatggaattctctgaatattctctcactgcataggtaaaatggaatgcttattgctccaggattggagaaaatattattacacatacacacatagatatatgtatgtggacagacacacacacacacacacacacacacacacacacactcacttttgttaatgtgtagttactagacaggcccacaaccatatttaagtggactagatgccaaag

SEQ ID NO: 25497 - DNA, 417 bp, Homo sapiens
  AL079295.1_56846
  Located on chromosome 22
  Distance between a terminus base of telomere on chromosomal short arm and 5'-terminus of this base sequence : 32989357
  Distance between 3'-terminus of neighbour sequence of sequence listing upward to telomere on chrosomal short arm and 5'-terminus of this base sequence : 39713
acacggtaggaagtctaaggtatccaggagccaaaataatatatatgttccaggctttaagtgcgtcagagaatactcccaatccaggacacagaaaggcagatgggactggtattactactctattctttcttgggcggggagcatgtacccgtgtgcacgcatgcgcattctctgtctctctctcatacacacacacacacacacacacacacacacacacacacacacccttctcactgtctccggcagagacaggtgttaggattaacagtataaaacctttctgccacggaaaggaatgggagaaaaaagtcacactgatacacgcagtaaggggatccctttcatgacactgtatgtttttgtatcatttaacacctccctcgctgtgctttaacagaggttaggacagct

SEQ ID NO: 25498 - DNA, 166 bp, Homo sapiens
  D22S277
  Located on chromosome 22
  Distance between a terminus base of telomere on chromosomal short arm and 5'-terminus of this base sequence : 33014905
  Distance between 3'-terminus of neighbour sequence of sequence listing upward to telomere on chrosomal short arm and 5'-terminus of this base sequence : 25131
tacccactccccaaactatgcaccatcaactgcgaattaataaatgctcacaagggtgtgtgtgtgtgtgtgtgtgtgtgtgtgtgtgtgtgtgtgtgtgtgtgtgtgtgtgtgtcttgtagcccatatggtaaatatacagactacccagactaccacacaagaa

SEQ ID NO: 25499 - DNA, 357 bp, Homo sapiens
  AL079295.1_83354
  Located on chromosome 22
  Distance between a terminus base of telomere on chromosomal short arm and 5'-terminus of this base sequence : 33015837
  Distance between 3'-terminus of neighbour sequence of sequence listing upward to telomere on chrosomal short arm and 5'-terminus of this base sequence : 766
gcagtaccacagctcatcttacagatgaaagacccttaaagcctcaaaacaaaactcctttaaacggatgcctaaatgggttcacttcctctgctctgaaaaagggtattgtagtcattctataatctatctaaaatttacaaaataagtcatattctaaaaatgcatttttatttcagttttttagaactctgatcacattctcccattaaaagaaacacacacacacacacacacacacacacacacacacacagatttataaatgatggctgtgtttctagaccagatatcacaagaacctagtaatcatggggaaaacgtttgagcacactgtaccagtaatgtacctgaact

SEQ ID NO: 25500 - DNA, 387 bp, Homo sapiens
  Z82217.1_43339
  Located on chromosome 22
  Distance between a terminus base of telomere on chromosomal short arm and 5'-terminus of this base sequence : 33125138
  Distance between 3'-terminus of neighbour sequence of sequence listing upward to telomere on chrosomal short arm and 5'-terminus of this base sequence : 108944
acaagtgttccaatcagatcacagaaggtgggaggatcactggagcccagaagttcaaggccagcctgggcaacaaagcaggaaagactccatctctagatagatagatagatagatggatagatagatagatagatagatagatagatagatagatagatagatagatagagtcttcctcataattcctcaggcagcaaacccttgttgctcagaaagaaaatgcaaaatgcagcctggataatgaaaagaccaattctaacctctccctcagattataaaagcagccagtccgctatatttttagtaatcttgggctgaactgttgtgcttctgcccacacgagcttaataaataccactattataggcaatcaggtatgcttaa

SEQ ID NO: 25501 - DNA, 238 bp, Homo sapiens
  D22S278
  Located on chromosome 22
  Distance between a terminus base of telomere on chromosomal short arm and 5'-terminus of this base sequence : 33149958
  Distance between 3'-terminus of neighbour sequence of sequence listing upward to telomere on chrosomal short arm and 5'-terminus of this base sequence : 24433
ctccgaaaggcacattttatttcatatctttaaatgtggaagtctataaagattaactgtgctagagtcaagcctaagtttgatatcattaactccacatctgaatcagaatccaattactgttcagtacacacacacacacacacacacacacacacacacacacacacacacgtgtgtttatattctctatttgttgagccaaatctacttacttcccatcaagtctcagttacgg

SEQ ID NO: 25502 - DNA, 314 bp, Homo sapiens
  Z82217.1_68169
  Located on chromosome 22
  Distance between a terminus base of telomere on chromosomal short arm and 5'-terminus of this base sequence : 33150054
  Distance between 3'-terminus of neighbour sequence of sequence listing upward to telomere on chrosomal short arm and 5'-terminus of this base sequence : -142
acatctgaatcagaatccaattactgttcagtacacacacacacacacacacacacacacacacacacacacacacacgtgtgtttatattctctatttgttgagccaaatctacttacttcccatcaagtctcagttacggagaggccataccctagggaagaagagcattcactcaatcctggggctttccacagacagaggggttaagggtagccagtggcaattatggctgctgagatggaacacctattagaaactaaaccttcctttctcacaattcaacacaaaacttagttcactgaacagcatcc

SEQ ID NO: 25503 - DNA, 246 bp, Homo sapiens
  Z67408
  Located on chromosome 22
  Distance between a terminus base of telomere on chromosomal short arm and 5'-terminus of this base sequence : 33165744
  Distance between 3'-terminus of neighbour sequence of sequence listing upward to telomere on chrosomal short arm and 5'-terminus of this base sequence : 15376
gaagtccctacacactgctccatttccaaatatcactatctttagccagtttgaaggcaaccaacagataataggccccaggagtaaatgagggaaagggacgggggtctcactattaactaggattgacagaaatgataaatgaatacatacacacacacacacacacacacacacacacaccaagtagaacctgctcaccagcacctacatccagtcttccctccttatcatccaatattagct

SEQ ID NO: 25504 - DNA, 173 bp, Homo sapiens
  Z95114.19_11051
  Located on chromosome 22
  Distance between a terminus base of telomere on chromosomal short arm and 5'-terminus of this base sequence : 33165776
  Distance between 3'-terminus of neighbour sequence of sequence listing upward to telomere on chrosomal short arm and 5'-terminus of this base sequence : -214
tcactatctttagccagtttgaaggcaaccaacagataataggccccaggagtaaatgagggaaagggacgggggtctcactattaactaggattgacagaaatgataaatgaatacatacacacacacacacacacacacacacacacaccaagtagaacctgctcaccagc

SEQ ID NO: 25505 - DNA, 178 bp, Homo sapiens
  D22S683
  Located on chromosome 22
  Distance between a terminus base of telomere on chromosomal short arm and 5'-terminus of this base sequence : 33257232
  Distance between 3'-terminus of neighbour sequence of sequence listing upward to telomere on chrosomal short arm and 5'-terminus of this base sequence : 91283
aacaaaacaaaacaaaacaaacaatctatatctatatctatatctatctatctatctatctatctatctatctatctatctatctatataaagcagacagcatgtccacattctctcaaggtgaccccctctttctaacatcagaactttccttttttctacatgaggcatttccacc

SEQ ID NO: 25506 - DNA, 197 bp, Homo sapiens
  Z66870
  Located on chromosome 22
  Distance between a terminus base of telomere on chromosomal short arm and 5'-terminus of this base sequence : 33375071
  Distance between 3'-terminus of neighbour sequence of sequence listing upward to telomere on chrosomal short arm and 5'-terminus of this base sequence : 117661
aatgagccaccgggaggaagaaagggtgggtgggtgggtgtgtgtgtgtgtgtgtgtgtgtgtgtgtgtatgtgttgtgcatccatggagggcaggtggggataaccaagaaagaaaaagacatgggatccagaaaacaggaaaatcaacccagagagaagggaatctgaggatcacagtgggacatgcagtaggcc

SEQ ID NO: 25507 - DNA, 262 bp, Homo sapiens
  D22S1173
  Located on chromosome 22
  Distance between a terminus base of telomere on chromosomal short arm and 5'-terminus of this base sequence : 33379930
  Distance between 3'-terminus of neighbour sequence of sequence listing upward to telomere on chrosomal short arm and 5'-terminus of this base sequence : 4662
cagattgttacggatgccattattcccttcctttttacagctgagtaatattccatggcatatacatatataggggtgtgtgtgtgtgtgtgtgtgtgtgtatatacacacacattttcttcatccacttgttggctgatgagcatttaggttggttccatattttttcggttgcaaattatgcagctataaacatgcatgtgcgagtatcttttttatataataacttttctcctctgggtagatacccggtagtgggatt

SEQ ID NO: 25508 - DNA, 134 bp, Homo sapiens
  D22S283
  Located on chromosome 22
  Distance between a terminus base of telomere on chromosomal short arm and 5'-terminus of this base sequence : 33494254
  Distance between 3'-terminus of neighbour sequence of sequence listing upward to telomere on chrosomal short arm and 5'-terminus of this base sequence : 114062
accaaccagcatcatcatctaccacttaaaaaaacaaaaaaacaaaaaacaaaacacacacacacacacacacacacacacacacacacacacacacagaggaaagatctccgtggctcagaaagtcccgagct

SEQ ID NO: 25509 - DNA, 357 bp, Homo sapiens
  Z82215.1_128326
  Located on chromosome 22
  Distance between a terminus base of telomere on chromosomal short arm and 5'-terminus of this base sequence : 33499235
  Distance between 3'-terminus of neighbour sequence of sequence listing upward to telomere on chrosomal short arm and 5'-terminus of this base sequence : 4847
agataaatgcttgtaatgtaccacaatggagtttatggctttggggccagacagacctggattggagtcccaggtcccctgctcacaattcctgtgaccttgaagctgttagcaccccaatttcctagctttagaatgaggacaaacaccaccaccaccaccaccaccaccaccaccaccaccaccaccacctaacatcagaagagttgtagctcaagctcccagtggagaatggcatgataggaatttccctcccaactcctctatcttgtgattctgagctatttaatccccattcttcctaggaatgacacctgggccctctgaaaatcagttaccaggagtctagtgactctt

SEQ ID NO: 25510 - DNA, 290 bp, Homo sapiens
  AL022313.1_54466
  Located on chromosome 22
  Distance between a terminus base of telomere on chromosomal short arm and 5'-terminus of this base sequence : 33612616
  Distance between 3'-terminus of neighbour sequence of sequence listing upward to telomere on chrosomal short arm and 5'-terminus of this base sequence : 113024
caatggctgtaatctcagctactcaggagactgaggcaggagaatcgcttgaacctaggaggcagaggttgcagtgagccgagattatgccattgcactccagcctgggcaacagagtaagactctgtctcaaacaaacaaacaaacaaacaaacaatgaagtcaggccaggcacagtggctcacgcctgtaatcctagcactttgggaggccgatggaaaggagggtctggacaggcacaccagcttctcctttgtctttctgcaccctggtcagaagacaagtgaaag

SEQ ID NO: 25511 - DNA, 200 bp, Homo sapiens
  Z70289.1_40428
  Located on chromosome 22
  Distance between a terminus base of telomere on chromosomal short arm and 5'-terminus of this base sequence : 33723647
  Distance between 3'-terminus of neighbour sequence of sequence listing upward to telomere on chrosomal short arm and 5'-terminus of this base sequence : 110741
gcctttactatgctaactgcattgtcaaactctaatgtgggaatatagtgctcaatgtttccaaaagttcatttcattacaggctctctgtgtgtgtgtgtgtgtgtgtgtgtgtgtgtgtgcatgtgtgtctttcatctcacggggctacaatctttggatcactctttggggaacactgcagtaaatgaatcttggat

SEQ ID NO: 25512 - DNA, 219 bp, Homo sapiens
  D22S426
  Located on chromosome 22
  Distance between a terminus base of telomere on chromosomal short arm and 5'-terminus of this base sequence : 33737744
  Distance between 3'-terminus of neighbour sequence of sequence listing upward to telomere on chrosomal short arm and 5'-terminus of this base sequence : 13897
cccatctaggaccccatctaggacctgggggaaggaggaaggagtgggtaggggtggagcctatgtgcctggaatagtgggaggtgaaagtgggaagtggatgagagtggggacgtgtgtgtgtgtgtgtgtgtgtgtgtgtgtgtgtgtgtgtgtagagggagagaaaatgaatgagagaatcagggtagatacataattaggtgttgtttggtttca

SEQ ID NO: 25513 - DNA, 433 bp, Homo sapiens
  AL049749.2_45719
  Located on chromosome 22
  Distance between a terminus base of telomere on chromosomal short arm and 5'-terminus of this base sequence : 33809523
  Distance between 3'-terminus of neighbour sequence of sequence listing upward to telomere on chrosomal short arm and 5'-terminus of this base sequence : 71560
tgtttcctttaggtgacaacagaggctaatatcctgagcagcaagctaccaggcagcctagagacaccttgcttgaacaagctgttttcgcatcttgttgtagatttcattgaactcttctctgagagggccaattcatctttccatgcagagactcttaattcagctttcttgaaaagttcatgaacttctgtctctctccacctacctgtatccacatacacactgtcatctcccacccacgctcctcgaatccccctaaggacaccagcctgctggggatttcaagttcacacacacacacacacacacacacacacacacacacacagacttttcagtctgcagaggaagaaaataagggtggtggttttttccctggcccttctccctctccccctgtgcctgtctctaacaggtggtcatgtatctt

SEQ ID NO: 25514 - DNA, 442 bp, Homo sapiens
  AL049749.2_52708
  Located on chromosome 22
  Distance between a terminus base of telomere on chromosomal short arm and 5'-terminus of this base sequence : 33816615
  Distance between 3'-terminus of neighbour sequence of sequence listing upward to telomere on chrosomal short arm and 5'-terminus of this base sequence : 6659
ggagtgatcacagtaaggattaaattgtagacgtgaagtgcctgacacatagtatgcactcaataagtgtgggttttctctcatttctcctcccctcttttacatccaaattggcctcctcctccttctcctcctcctcctctcctcctcctcctcctccttcttcttctccttcttctttttcttcctcttcttcttcttcttcttcttcttcttcttcttctttcttcctcttcttcctcttcttcctcatggggtctccttgtatcacccaggctggagtgcagtggcatgatcttggctcacccacaccctcgcctcctgggttcaagtgattctcctgtctcagcctcccgagtgactgggattacaggtgcctgccaccttgcccagccaatttttggaatttttagtacagccaggatttcaccatgttggctag

SEQ ID NO: 25515 - DNA, 243 bp, Homo sapiens
  chr22.fa.O7frz.33756374
  Located on chromosome 22
  Distance between a terminus base of telomere on chromosomal short arm and 5'-terminus of this base sequence : 33942230
  Distance between 3'-terminus of neighbour sequence of sequence listing upward to telomere on chrosomal short arm and 5'-terminus of this base sequence : 125173
gtgctcattaagtatcaatgattcttcttgttgttgataataatgattacaatgattcttcttcttcttgttaatatgattcttcttcttcttcttcttcttcttcttcttcttcttcttcttcttcttcttcttctcttcttcttcttcctcttcttcttcttcttcttcttcttcttcttcttcttcttgttgatatgattacaacatgtttgttgcctaaattaggtcatgaactcactg

SEQ ID NO: 25516 - DNA, 183 bp, Homo sapiens
  D22S1177
  Located on chromosome 22
  Distance between a terminus base of telomere on chromosomal short arm and 5'-terminus of this base sequence : 33977636
  Distance between 3'-terminus of neighbour sequence of sequence listing upward to telomere on chrosomal short arm and 5'-terminus of this base sequence : 35163
gctgtgagccaagcaggtgaaaatcctgctctcttagaactaagagtcgtgtgtgtgtgtgtgtgtgtgtgtgtgtgtgtgcgcttggatgaacaggcagtaaataaaaaagtaagacaagaaaaatatcagctggtgatagcacaactgagaggatgaaagttggatggtgccagagtggcc

SEQ ID NO: 25517 - DNA, 340 bp, Homo sapiens
  HUMUT5006
  Located on chromosome 22
  Distance between a terminus base of telomere on chromosomal short arm and 5'-terminus of this base sequence : 34023422
  Distance between 3'-terminus of neighbour sequence of sequence listing upward to telomere on chrosomal short arm and 5'-terminus of this base sequence : 45603
attctgctggccctgctgtgctcagggagccactcattcattcattcattcattcattcattcattcattcatctattcatttgcacacagtcaaaggtgcaatttctcctctgtaccaggccatgtgctaggtatttgggagggaagtgcaagccggacacaagccagcactgaagatagtgtcagaagaaagacagccatgaacacacatgaccatatgacacatggtggggtggggcggcagggcaaagaggacatcggggaaatcaacatgccaccagctaccacttgtagggggttctcctgtggccagctctgagctaaggtcttcctgcacag

SEQ ID NO: 25518 - DNA, 335 bp, Homo sapiens
  chr22.fa.O7frz.33839028
  Located on chromosome 22
  Distance between a terminus base of telomere on chromosomal short arm and 5'-terminus of this base sequence : 34024894
  Distance between 3'-terminus of neighbour sequence of sequence listing upward to telomere on chrosomal short arm and 5'-terminus of this base sequence : 1132
gaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttggggcccaggtgtgtgtgttctgtacccaagtatgctggctgggtgggtgggtatctggggtgcctgcttcagggtgtgtgcaggtgtgtgtactggccctgagaatgaaagggcaggtgtttcactgggaccttgtcagacaggtgctagcgacaagctgcatat

SEQ ID NO: 25519 - DNA, 274 bp, Homo sapiens
  AL022314.1_26027
  Located on chromosome 22
  Distance between a terminus base of telomere on chromosomal short arm and 5'-terminus of this base sequence : 34183876
  Distance between 3'-terminus of neighbour sequence of sequence listing upward to telomere on chrosomal short arm and 5'-terminus of this base sequence : 158647
agctgtatgaatcaatggacagacggtgattggagaccagaagatggatggatggatggatggatggatggatggatggatggatggatgaatggacagacatacagatgtaaatacagaggggttggtgggtgttgagaggagaagctagaaacttttgctgaagcatgtagcaggcctagactgcctttggtgtccctccagacactcggctaggcctgccctaccttcctggcactgctcttcgtcgctgccgttgagacaatcaggctgc

SEQ ID NO: 25520 - DNA, 323 bp, Homo sapiens
  AC008048.11_137054
  Located on chromosome 22
  Distance between a terminus base of telomere on chromosomal short arm and 5'-terminus of this base sequence : 34183876
  Distance between 3'-terminus of neighbour sequence of sequence listing upward to telomere on chrosomal short arm and 5'-terminus of this base sequence : -274
agctgtatgaatcaatggacagacggtgattggagaccagaagatggatggatggatggatggatggatggatggatggatggatggatgaatggacagacatacagatgtaaatacagaggggttggtgggtgttgagaggagaagctagaaacttttgctgaagcatgtagcaggcctagactgcctttggtgtccctccagacactcggctaggcctgccctaccttcctggcactgctcttcgtcgctgccgttgagacaatcaggctgcccatcacagaccttgggcagtgagatgcatgtgctgtcctctttgcact

SEQ ID NO: 25521 - DNA, 376 bp, Homo sapiens
  AL022314.1_47224
  Located on chromosome 22
  Distance between a terminus base of telomere on chromosomal short arm and 5'-terminus of this base sequence : 34204881
  Distance between 3'-terminus of neighbour sequence of sequence listing upward to telomere on chrosomal short arm and 5'-terminus of this base sequence : 20682
ggaccttaaccaggtttgtatctaacttggtaatcttattctagcaattctctttttccattaatgattgatgatagatagatagatagatagatagatagatagatagatagatagatataaacagacagctagctagctagacagacagagacagagagacagacagatagataatagacagctagctagttagataactagatagacaagcagacagatatcaacagagatgatagatagatagatagatagatagacaaatagatcagtttcttgcattctttaccattctactcgttcccccattaatcagccaaataaatatttgacacatggtcactctatctttgtatgagaatcatgatttcacctc

SEQ ID NO: 25522 - DNA, 267 bp, Homo sapiens
  AL022314.1_78197
  Located on chromosome 22
  Distance between a terminus base of telomere on chromosomal short arm and 5'-terminus of this base sequence : 34235951
  Distance between 3'-terminus of neighbour sequence of sequence listing upward to telomere on chrosomal short arm and 5'-terminus of this base sequence : 30694
tgattagtaatgtctgccatgagtgtggctttatgaatgccaggaattgccatccctggtctggtccaacttttatcaggacactatctatctatcatctatctacctatctggagggagggggatagagggggggggagagagagagagagagagagagagagagagagagagagagagagagagagaggagagagagagagattcgtcatcaagtgcaatatttccccaggcatagacttgtgggatatggccatgagctgatac

SEQ ID NO: 25523 - DNA, 305 bp, Homo sapiens
  AL022314.1_92967
  Located on chromosome 22
  Distance between a terminus base of telomere on chromosomal short arm and 5'-terminus of this base sequence : 34250744
  Distance between 3'-terminus of neighbour sequence of sequence listing upward to telomere on chrosomal short arm and 5'-terminus of this base sequence : 14526
aacctgatcgttggaattccccaaactggccagttcctctccaccctatagaccctgtcctagccttcttatagctgctatgggggctagattttccccgatgatagtagtctcattattattattattattattattattattattattattattactattattgttataaaaatattgccaatcatacattcgcgtgatcactcacactgtgccgggcactcttgagagcactttacatatattgtctcatttaattctctcaacttgggcacaggcactgtcactatttccattctacagct

SEQ ID NO: 25524 - DNA, 353 bp, Homo sapiens
  AC008048.11_39872
  Located on chromosome 22
  Distance between a terminus base of telomere on chromosomal short arm and 5'-terminus of this base sequence : 34280484
  Distance between 3'-terminus of neighbour sequence of sequence listing upward to telomere on chrosomal short arm and 5'-terminus of this base sequence : 29435
gcataggaggtgcttagtcattgtgatgtggatagaagggtggttaatgggtgaatggaaaatggactgatggatgaacagaagaaggatgaatggggggatcatggagggaatgatggagggagagaaggaatgatgggggagaaggaaggaaggatgggggagaaggaaggaagaatggatggatggatggatggatggatggatggatggatggatgaagggatgaacagacagacggatggacagacagtggatgtggatggacagaataataagactctttcaggaaggccagaacacagcagaaaggccctgaagaaaaccaaagcagctgcaggaagtttggtgtt

SEQ ID NO: 25525 - DNA, 390 bp, Homo sapiens
  chr22.fa.O7frz.34206012
  Located on chromosome 22
  Distance between a terminus base of telomere on chromosomal short arm and 5'-terminus of this base sequence : 34391891
  Distance between 3'-terminus of neighbour sequence of sequence listing upward to telomere on chrosomal short arm and 5'-terminus of this base sequence : 111054
aaggaggtgaacttgtagctagctttcacatcggccgtgatctcttccatgttcccttcattcattcattcattcattcatttgttcattcattccacacttgcacaccctctatgtccccagcattttaccacacaccagaacacaaaaggtaaccttgccctcatggggcctggagagtaatggggaaacagatgaataactctgcatgtgtcctgaagttatagggaattcacatttaatttatacctgtttctttacagcaaagctttttgcagaaaggatttgaaccaacctgccagaaaaggcacaaggaataacatgatacattttaaccaaagaagataattaaaatcaaaggagaaagtgtttattgagcacctactatgt

SEQ ID NO: 25526 - DNA, 470 bp, Homo sapiens
  chr22.fa.O7frz.34319743
  Located on chromosome 22
  Distance between a terminus base of telomere on chromosomal short arm and 5'-terminus of this base sequence : 34505278
  Distance between 3'-terminus of neighbour sequence of sequence listing upward to telomere on chrosomal short arm and 5'-terminus of this base sequence : 112997
tcatacgctgtaaatgaagaactcttcactcctcgcctgggactgagcactgggttggctgccgcaaactcaacaccaacccccgaccttacagggtgtcaagataaagatcgtcaggccaggcgcaatggctcacgcctgtaatcccaacactttaggaggccgaggcgggcggatcacgaggtcaggagttcgagaccagcctggccaacatagcgaaaccccgtctctactaaaaatacaaaaattagctgggaaagggggcacacgcctgtagtcccagctactcgggaggctgagaggcaggagaatcacttgaacccaggaggcagaggttgcagtgggccaagatcacgccactgcactccagcctgggtgacagagtgagactctgtctcaaaaataaataaataaataaataaataaataaataaataaataaatattgttggattaatttctcagatgag

SEQ ID NO: 25527 - DNA, 228 bp, Homo sapiens
  AL022315.1_14827
  Located on chromosome 22
  Distance between a terminus base of telomere on chromosomal short arm and 5'-terminus of this base sequence : 34622880
  Distance between 3'-terminus of neighbour sequence of sequence listing upward to telomere on chrosomal short arm and 5'-terminus of this base sequence : 117132
acaatgacttctggtgctacagtcaggcatgcaatatttggtgccctaggagtcccctggcctctcttggaaagtgacttgctagttccccagccttgagaggttagaatggcagccccccctccacacacacacacacacacacacacacacacacacacacacacacacacacacacgggtctggaggctgggtcaggcaattctacaaattaacagtccactcct

SEQ ID NO: 25528 - DNA, 266 bp, Homo sapiens
  Z97630.11_2537
  Located on chromosome 22
  Distance between a terminus base of telomere on chromosomal short arm and 5'-terminus of this base sequence : 34905050
  Distance between 3'-terminus of neighbour sequence of sequence listing upward to telomere on chrosomal short arm and 5'-terminus of this base sequence : 281942
ctttctgttcatttgacttctaacccacatgggatgggttttcctaacttgggagaagcaggtgagaggtcagcctccacagggtgaggctgtcaaggaggaggggggaaccaggacagccagtggccagggcaggacaaaagaaggccggccatctttgttttgttttgttttgttttgttttgttttgttttgttttgttacgaggcagagtcttgctgtgcctcacccaggctggagtgcaataatgagatcacagctcattg

SEQ ID NO: 25529 - DNA, 156 bp, Homo sapiens
  D22S1156
  Located on chromosome 22
  Distance between a terminus base of telomere on chromosomal short arm and 5'-terminus of this base sequence : 35096302
  Distance between 3'-terminus of neighbour sequence of sequence listing upward to telomere on chrosomal short arm and 5'-terminus of this base sequence : 190986
tgaggtagtcacacgaggcagaggcatgttgggggtggggggagcagacactggaacacacacacacacacacacacacacacacacacatgctcacacacacaaccagccagacaatcgggccagtgtgtctggggcctcggagcccagtgaatt

SEQ ID NO: 25530 - DNA, 228 bp, Homo sapiens
  AL022322.1_60441
  Located on chromosome 22
  Distance between a terminus base of telomere on chromosomal short arm and 5'-terminus of this base sequence : 35256190
  Distance between 3'-terminus of neighbour sequence of sequence listing upward to telomere on chrosomal short arm and 5'-terminus of this base sequence : 159732
gtctgtagagccaggacagaggagcaagacccgaaatgagtaaggcgggaccctcggcccacatccctgctggaatcagaaggtccccaggctgcggcctggccagctccagcccgactcccctcccaagcaaacacacacacacacacacacacacacacacacacacacacacacacacacccctatacacatgtaaatgacataatggcgtttaggttagacttt

SEQ ID NO: 25531 - DNA, 418 bp, Homo sapiens
  AL022322.1_94797
  Located on chromosome 22
  Distance between a terminus base of telomere on chromosomal short arm and 5'-terminus of this base sequence : 35290458
  Distance between 3'-terminus of neighbour sequence of sequence listing upward to telomere on chrosomal short arm and 5'-terminus of this base sequence : 34040
gacggcacttaaagaaataagactggatgagatcaccatccgaaaacgagaagaggcatttaagacatgaccctatcaaaatccactgtgaaagacacagaacatattctcccagggagccaccctctacaaagtgaagtttgtaacacactcttcactacggccccttactccttgcctacctacttcccccagcacacacacccaatagatgtctgcagacacacacacacacacacacacacacacacacacacacacacagagtatttaaatttctcctttctgtatctcttagtgatgtcattctgctgagtaagagggaaactcccttttggggagtctctcatgtaacaagaaagtaatccacggaaggaacaagaagtgtcctaaacagtagcaaaccttacacatcagg

SEQ ID NO: 25532 - DNA, 329 bp, Homo sapiens
  Z98749.11_3441
  Located on chromosome 22
  Distance between a terminus base of telomere on chromosomal short arm and 5'-terminus of this base sequence : 35443088
  Distance between 3'-terminus of neighbour sequence of sequence listing upward to telomere on chrosomal short arm and 5'-terminus of this base sequence : 152212
ctgacatcaggatttcaagaccagcctggccaacatggtgaagccccatctctacaaaaatacaaaaattagctgggcatgatggctggtgcctataatcgcagctacttgggaggctgaggcaggagaatcgcttgaaccctggaggcggaggttcctgtgagctgggatcgtgtcactgcactccagcccaggcgacaaagtcagactccatctcaaaataataataataataataataataataaatcaaagagctgctgtgcataaagcccgtagctcagagcctggcatgtgaatagtagctgcagttattaattcacctacag

SEQ ID NO: 25533 - DNA, 431 bp, Homo sapiens
  chr22.fa.O7frz.35382755
  Located on chromosome 22
  Distance between a terminus base of telomere on chromosomal short arm and 5'-terminus of this base sequence : 35568345
  Distance between 3'-terminus of neighbour sequence of sequence listing upward to telomere on chrosomal short arm and 5'-terminus of this base sequence : 124928
tctgtagatccaaagcatctactgtcacagaatcagtctcctgatgccaagtccctgggcacaaacttgaagatgggatgggggctctggggcaaggagggttagcttgccgggcctgggccgcaccctggggctgctgttcatcctgcaaggagactggactgggaggaggtagggagaggcaagcagaggagctccaggcagggagaggttcggaggccccaggaaagagccctttctctcctctccagccctgtgtgaccctgggcagctcaactctcctctctgggcctttgtttcctcatatgtaaaatgagaactataatacccactttgagcttcggggtgtgtgtgtgtgtgtgtgtgtgtgtgtgtgtgtgtgtgtgtgtgtttgttgttgttgctgtttttagataggatctggctctgtt

SEQ ID NO: 25534 - DNA, 136 bp, Homo sapiens
  D22S272
  Located on chromosome 22
  Distance between a terminus base of telomere on chromosomal short arm and 5'-terminus of this base sequence : 35800422
  Distance between 3'-terminus of neighbour sequence of sequence listing upward to telomere on chrosomal short arm and 5'-terminus of this base sequence : 231646
aatgcacgacccacctaaaggcattctgtgtgtgtgtgtgtgtgtgtgtgtgtgtgtgtgtagtacttgaataaatttttcttaaaatacccaataaatcaactgaaaaaaaatttgtgccaggcaaacaaaactc

SEQ ID NO: 25535 - DNA, 449 bp, Homo sapiens
  AL008583.1_62054
  Located on chromosome 22
  Distance between a terminus base of telomere on chromosomal short arm and 5'-terminus of this base sequence : 35944956
  Distance between 3'-terminus of neighbour sequence of sequence listing upward to telomere on chrosomal short arm and 5'-terminus of this base sequence : 144398
ctgttccttctccaagaacattcttcccgcccccacccctcctctgcccattgcctgctcatcctccagatggcagcttccctgatgcctgaactgagatgctctatagagagagaagagggccctgagagcttctctggcagggctgcagagcactcatccatccatccatccatccatcatccatccatccatccatccatccatccatccatccatgtgtgccgcagcaacatggcgtcgtagttgcagacacgaactgtcacgttagacaggccagcgtcattttcagttccttgcttactagatctgcgaccttgggcaagctgcttaactcctctggccctcagttaccttatctgtaaaatgggtgtaataatagtacctacatttggggatataaataatgataaaatgaaagaacagatatgaagtgtggtcaaccataa

SEQ ID NO: 25536 - DNA, 241 bp, Homo sapiens
  AL022318.2_24435
  Located on chromosome 22
  Distance between a terminus base of telomere on chromosomal short arm and 5'-terminus of this base sequence : 36019104
  Distance between 3'-terminus of neighbour sequence of sequence listing upward to telomere on chrosomal short arm and 5'-terminus of this base sequence : 73699
ccaaagtgctaagattacaggtgtgagccaccatgctcagcccctttagaacatttttaacacacacacacacacacacacacacacacacacacacacacacacacacatataaaacaaaacaaaaaaacccaactctgtacccatgagcagtcattccccattttccctagtccccccagccctcagtaactactaatctactttatgtctctatggatttgcctactctggacattta

SEQ ID NO: 25537 - DNA, 268 bp, Homo sapiens
  AL031846.2_31336
  Located on chromosome 22
  Distance between a terminus base of telomere on chromosomal short arm and 5'-terminus of this base sequence : 36231562
  Distance between 3'-terminus of neighbour sequence of sequence listing upward to telomere on chrosomal short arm and 5'-terminus of this base sequence : 212217
acttggactggctttcttactctttagcttgcagatggactattgtgggaccttgtgattgtgtgagttaatactccttaataaactcccctttagatagatagatagatagatagatagatagatagatcttattagatagatagatagatcgacagatagatagatagatcctattagttctggccctctagagaatcctaatacatcacgtgatgttgtttttataaaacaatgaaaaaacctacatatgctcatgcacaagtac

SEQ ID NO: 25538 - DNA, 347 bp, Homo sapiens
  AL031846.2_103912
  Located on chromosome 22
  Distance between a terminus base of telomere on chromosomal short arm and 5'-terminus of this base sequence : 36303984
  Distance between 3'-terminus of neighbour sequence of sequence listing upward to telomere on chrosomal short arm and 5'-terminus of this base sequence : 72154
ggtggatcatgaggtcaagagattgagaccatcctggccaacatagtgaaaccccgtctctattaaaaatacaaaaattagcttggcatggtggcacacctgtaatcccagctacttgggaggctgaggcaggagaattgcttgaaccctggaggcagaggttgcagtgagccaagatcacaccactgaactccagcctggtaacagagcaagactctgtctcaaaaaaaaaaagaaagaaagaaagagaaagaaagaaagaaagaaagaaagaaagaaagaaagaaagaaagaaagaaaaaagaaataagggctgaaaatctgtctcaaatttggcaaaagacata

SEQ ID NO: 25539 - DNA, 347 bp, Homo sapiens
  AL022312.7_34270
  Located on chromosome 22
  Distance between a terminus base of telomere on chromosomal short arm and 5'-terminus of this base sequence : 36604066
  Distance between 3'-terminus of neighbour sequence of sequence listing upward to telomere on chrosomal short arm and 5'-terminus of this base sequence : 299735
catgccgtttaagatcaagttaacaaccctcaaatcatgtcctatggtgaatcatcatcatcatcatcatcatcatcatcatcatcagtatttacagacattattgattaagtgcctattttgtgccaaactctgagctaaaagacatccctccccattatacccattttccacgtctgtaaaaggaccccacagcacctgtgaagtctgctgctaaaaatgaaccacctggatcgaatcccaaggaaacagtacacaaaccggaactgagagacaatctgcaacagactagcttctctcatatgaatgcatttcttgcaattctgtttatctgaagtgtttgcaga

SEQ ID NO: 25540 - DNA, 147 bp, Homo sapiens
  D22S428
  Located on chromosome 22
  Distance between a terminus base of telomere on chromosomal short arm and 5'-terminus of this base sequence : 36669482
  Distance between 3'-terminus of neighbour sequence of sequence listing upward to telomere on chrosomal short arm and 5'-terminus of this base sequence : 65069
agggtctgtatcctgggtccaggtgtgtgtgtgtgtgtgtgtgtgtgtgtgtgtgagagagacagagagagagaatgagcgagcgctggagtgggcctgcgtgtctggcgtgtgtggtgtgccggggtctgatcaccatgcgaggag

SEQ ID NO: 25541 - DNA, 235 bp, Homo sapiens
  AL008716.1_11700
  Located on chromosome 22
  Distance between a terminus base of telomere on chromosomal short arm and 5'-terminus of this base sequence : 36693848
  Distance between 3'-terminus of neighbour sequence of sequence listing upward to telomere on chrosomal short arm and 5'-terminus of this base sequence : 24219
catacattcatctatccaaccatccatccatccagccaaccatccaaccatctatccatccatccatccatccatccatccatccattcatccacccatttagccatccatccatctatccatccatccacccgcccacccatccatccagccattcatccatttacctatctttccatctcttcatgcattcgtctgcttatccacccatccctccactcaacctttacattca

SEQ ID NO: 25542 - DNA, 289 bp, Homo sapiens
  AL022319.2_37199
  Located on chromosome 22
  Distance between a terminus base of telomere on chromosomal short arm and 5'-terminus of this base sequence : 36767029
  Distance between 3'-terminus of neighbour sequence of sequence listing upward to telomere on chrosomal short arm and 5'-terminus of this base sequence : 72946
ttggtttgttaacttggtttactgggctttggccccagagcacgagcttctcaaaggcagggacggtgccctgactccctcaccactgcccaccctggtagctcgagcccagcacatcatgtcattcaaatttgtggtagccatgcaggaatgaatgaatgaatgaatgaatgaatgaatttggctgcagtccccatgtggtgtaacgggagagcagtttggagtccagcttggttcagtgccctgcctttgccctgccacatccttgctaggtggctctgaacaagtc

SEQ ID NO: 25543 - DNA, 98 bp, Homo sapiens
  D22S284
  Located on chromosome 22
  Distance between a terminus base of telomere on chromosomal short arm and 5'-terminus of this base sequence : 37031453
  Distance between 3'-terminus of neighbour sequence of sequence listing upward to telomere on chrosomal short arm and 5'-terminus of this base sequence : 264135
atgggtatttaacttctctacacagacacacacacacacacacacacacacacacacacacacacacacacaatctgatgtaacgacctcaagagagc

SEQ ID NO: 25544 - DNA, 212 bp, Homo sapiens
  HUMUT2561
  Located on chromosome 22
  Distance between a terminus base of telomere on chromosomal short arm and 5'-terminus of this base sequence : 37089999
  Distance between 3'-terminus of neighbour sequence of sequence listing upward to telomere on chrosomal short arm and 5'-terminus of this base sequence : 58448
acaactcccaccatggcagatttcaggctaccaacatgacatcactgaatccagagttgggaagagatgtacacaattgtttttcatgggcagataggagccagccccagcacaccaccgcatgagtgagtgagtgaatgagtgaatgaatgaatgaatgaatgaatgaatgaaagaaatgtgccagatgctgggaataccagggacgccat

SEQ ID NO: 25545 - DNA, 231 bp, Homo sapiens
  D22S423
  Located on chromosome 22
  Distance between a terminus base of telomere on chromosomal short arm and 5'-terminus of this base sequence : 37096730
  Distance between 3'-terminus of neighbour sequence of sequence listing upward to telomere on chrosomal short arm and 5'-terminus of this base sequence : 6519
tgcaaactcagcctggaattcacgcactcaagagcatctgtgagacaacttgtatttctggctccttgtcattttcccatccctgaaatacacatatatgtacatatttacacactggtacacacatacacatacatgtacttacatacacacatgtacacacacacacacacacacacacacacacacacacacacacacacacaccatgacctaaacgagtcagttggt

SEQ ID NO: 25546 - DNA, 191 bp, Homo sapiens
  Z23853.1_172
  Located on chromosome 22
  Distance between a terminus base of telomere on chromosomal short arm and 5'-terminus of this base sequence : 37096776
  Distance between 3'-terminus of neighbour sequence of sequence listing upward to telomere on chrosomal short arm and 5'-terminus of this base sequence : -185
aacttgtatttctggctccttgtcattttcccatccctgaaatacacatatatgtacatatttacacactggtacacacatacacatacatgtacttacatacacacatgtacacacacacacacacacacacacacacacacacacacacacacacacaccatgacctaaacgagtcagttggtttagtc

SEQ ID NO: 25547 - DNA, 256 bp, Homo sapiens
  Z82206.1_132903
  Located on chromosome 22
  Distance between a terminus base of telomere on chromosomal short arm and 5'-terminus of this base sequence : 37097816
  Distance between 3'-terminus of neighbour sequence of sequence listing upward to telomere on chrosomal short arm and 5'-terminus of this base sequence : 849
gctatgattgtgtcactgcactctagcctgggcaacagagcgaaatcctgtctctaaaaagaaaaaaaggtccactgtgtacaccctaccacacatatgcattctctctctctctgtgtcacacacacacacacacacacacacacacacacatacacagtcacactgggcaacagaatggctgaaaagactcatgttcaattaagttgtctttggcatttgggttcttatttctatgttcctatggtatttacgg

SEQ ID NO: 25548 - DNA, 234 bp, Homo sapiens
  Z83847.1_6127
  Located on chromosome 22
  Distance between a terminus base of telomere on chromosomal short arm and 5'-terminus of this base sequence : 37114669
  Distance between 3'-terminus of neighbour sequence of sequence listing upward to telomere on chrosomal short arm and 5'-terminus of this base sequence : 16597
tgagaattctgccttaagtctaatggggggtgacaaaaagaaactaaatttcagcacagtggtaggggtggggatattgatagctattacttattgggcatataagtgctaggcaaatgccagcccttttagaattttattttattttattttattttattttattttattttattttattttctgagagggagtcttgctctgtcacccaggctggagtgcagtgactcttat

SEQ ID NO: 25549 - DNA, 304 bp, Homo sapiens
  AL033547.7_17848
  Located on chromosome 22
  Distance between a terminus base of telomere on chromosomal short arm and 5'-terminus of this base sequence : 37196153
  Distance between 3'-terminus of neighbour sequence of sequence listing upward to telomere on chrosomal short arm and 5'-terminus of this base sequence : 81250
gaggcttgatctaattcagattgggtttttttggcaagaatattttataggaggtggtgtttacttccatcaagaggcacataataaccagttgtttcatctaatcttattatgatgttaacagctattgaagagcaatactaagatatgttaattagggtttacaaaatggtaatatcctaagtcatttgtctttgtttgttagctagagaaactatttttgttgttgctgttgttgttgttgttgttgttgttgttgttgttgttgttgagacagggtcttgttctattgtccagtctgtag

SEQ ID NO: 25550 - DNA, 261 bp, Homo sapiens
  AL022238.1_162059
  Located on chromosome 22
  Distance between a terminus base of telomere on chromosomal short arm and 5'-terminus of this base sequence : 37570180
  Distance between 3'-terminus of neighbour sequence of sequence listing upward to telomere on chrosomal short arm and 5'-terminus of this base sequence : 373723
tcaatagagcggtatctatttcagtttgtcagactctctctctcatatacacatgcacacactgtactttacaactggctgtcttcattcattccttcattcagtgccaggcactggggacgggactgataaaatatacacacacacacacacacacacacacacacacacacacacatatatacatatatatatatatatatatatatatatatatacacacatgaatgatactttctcaaggagatcatagtctagcag

SEQ ID NO: 25551 - DNA, 493 bp, Homo sapiens
  HUMUT7213B
  Located on chromosome 22
  Distance between a terminus base of telomere on chromosomal short arm and 5'-terminus of this base sequence : 37680159
  Distance between 3'-terminus of neighbour sequence of sequence listing upward to telomere on chrosomal short arm and 5'-terminus of this base sequence : 109718
gaagcacttgaaactgagagatggagtttgccgtaagccgagattgcaccactgcagtccagcctgggtgacagggcaagactccataattaatacatacatacatacatacatacatacatacatacatacatacatacatacatacatacatcaagggggtgatgtctctgtttgtgaatggtaccagcatgtgtacaagtctctctgccctataccctgggcctcagcctgggatgaccatgggcagaaggcacatttcttgggaagatctgaactggctccaccccacctctgtccttctcccaggatggtaaagaagaacctgggtatatggtgatccctaccctgggaccctgaatcatgtcttaataataaaaattcactggaaaagtgagagaggcggggaagaaaactgcagcagcagggagtaaaagaacctcacttagatcattgtgacaggcctgggaggttgttgcccaatatcctctct

SEQ ID NO: 25552 - DNA, 369 bp, Homo sapiens
  Z98048.1_16043
  Located on chromosome 22
  Distance between a terminus base of telomere on chromosomal short arm and 5'-terminus of this base sequence : 37911417
  Distance between 3'-terminus of neighbour sequence of sequence listing upward to telomere on chrosomal short arm and 5'-terminus of this base sequence : 230765
catgaggtcaggagtttgataccaccctgaccaacatggtgaaatcccctctctactaaaaatgcaaaaaaattagctgggcctggtggcacatgcctgtaatcccagctacttgggaagctgaggcaggggaattgcttgaaccagggagatggaggttgcagtgagccgcgatcatgccactgcactccagcctgggcaaaagagactctgtctcaaaaaagaaaaaagaaaaaaatatattacatatatatatatatatatatatatatatatatatatatatgtaaatgataaataactaggagctaggtcaacttaaataagaaaatttggtaggcctattatcaatttaaataggtcagcctc

SEQ ID NO: 25553 - DNA, 348 bp, Homo sapiens
  AL035658.7_29257
  Located on chromosome 22
  Distance between a terminus base of telomere on chromosomal short arm and 5'-terminus of this base sequence : 38304467
  Distance between 3'-terminus of neighbour sequence of sequence listing upward to telomere on chrosomal short arm and 5'-terminus of this base sequence : 392681
gaagttgtaaagcaactagttgacagatcagtaggtcctgataggtcaaggcaaggaattagatgatgatgatgatgatggtgatgatgatgatgatgatgatgatgattatcattattattttgtagatggagtctcgctgtgtctcccaggctggagtgcagtggcgcaatctcagctcactgcaactcaagtgatctcctgacctcaagtgatcctcctgcctctgcctcccaaagtgctaggattacaggcgtgaggcactgcgcctggccttaggtattattttaagcgcaatgaggggctaggggagcactttaagagaagggtggcatgatttgtcttaca

SEQ ID NO: 25554 - DNA, 352 bp, Homo sapiens
  AL008582.11_41010
  Located on chromosome 22
  Distance between a terminus base of telomere on chromosomal short arm and 5'-terminus of this base sequence : 38549736
  Distance between 3'-terminus of neighbour sequence of sequence listing upward to telomere on chrosomal short arm and 5'-terminus of this base sequence : 244921
agaacatgttcctagccagacctctgggcaaggctgtgctgctgagctaagcaaagagacatgactgctccatgaactgtcaagggcatcttctgtcctatgaaagacttggggctggattttgattcaaatcctttctggatccagcttgaagtatccaggtgctaatttcaggcttggggattttgagttttctaaacacctgccccaacacatttccctgtaattctcaggcctgggcccatggctcttaaggggcatttaatttaatttaattttacgtatgtatgtatgtatgtatgtatgtatgtatgtatgtatgtatgtatgtggagactgagtctcgttctat

SEQ ID NO: 25555 - DNA, 252 bp, Homo sapiens
  D22S276
  Located on chromosome 22
  Distance between a terminus base of telomere on chromosomal short arm and 5'-terminus of this base sequence : 38726900
  Distance between 3'-terminus of neighbour sequence of sequence listing upward to telomere on chrosomal short arm and 5'-terminus of this base sequence : 176812
cattctgccaagcaatttatatattctatgtctccaaatctttaagtctgaaaacagttttgaaatgggcttgtaaagaaaaataaacgtgatgcatgtacacgaaacttctgatcagaaaataataaacaaatatgaagtacttcttaccacaattaaaacacacacacacacacacacacacacacacacacacacacacttctgcatgtactgtggcacaaaaagaggtcaagaaacttaaagagcagc

SEQ ID NO: 25556 - DNA, 217 bp, Homo sapiens
  chr22.fa.O7frz.38637272
  Located on chromosome 22
  Distance between a terminus base of telomere on chromosomal short arm and 5'-terminus of this base sequence : 38823095
  Distance between 3'-terminus of neighbour sequence of sequence listing upward to telomere on chrosomal short arm and 5'-terminus of this base sequence : 95943
acaatagacttacctggagaactttagaaatacactagaattttatatttagaaaaatattttaaagtataaaacatttaaatatatttaagtatatttaaatagaaatagatgtgtgtgtgtgtgtgtgtgtgtgtgtgtggagcaatatatatatatattcacattaaacaaaacaatatattgggcttttcccttagacattcaattggtctgg

SEQ ID NO: 25557 - DNA, 293 bp, Homo sapiens
  AL021453.1_37597
  Located on chromosome 22
  Distance between a terminus base of telomere on chromosomal short arm and 5'-terminus of this base sequence : 38928051
  Distance between 3'-terminus of neighbour sequence of sequence listing upward to telomere on chrosomal short arm and 5'-terminus of this base sequence : 104739
aggtcagaaatttgagaccatcctggccaacatggtgaaaccctgtctctactaaaaatacaaaaattagccgggcgaggtgacgcatgcctgtagtcccagctactcgggaggctgaggcaggagaatcgcttgaacccgggaggcagaggttgcagtgaggtgagattgcaccactgcactccagcctgggcaacagagcaagactctgtcttaaataaataaataaataaataaataaataaataaataaaaagagaggggtaggtatctttgatctgccagtttgtaat

SEQ ID NO: 25558 - DNA, 238 bp, Homo sapiens
  AL021453.1_63900
  Located on chromosome 22
  Distance between a terminus base of telomere on chromosomal short arm and 5'-terminus of this base sequence : 38954469
  Distance between 3'-terminus of neighbour sequence of sequence listing upward to telomere on chrosomal short arm and 5'-terminus of this base sequence : 26125
gagcctaagaggctgaagatacagtgagtcaagatcacaccactgcacttcagcctcgtcaacagagcgagaccctgtctcaaaaaaaaaaaaatacatacacacacacacacacacacacacacacacacgtatatgtatatatattttttaaattaagaaaaaatgtctgctctatgctggacacttaaagtgacttcccctgggtcctagggtactttctgagccttaatttcct

SEQ ID NO: 25559 - DNA, 370 bp, Homo sapiens
  Z99716.4_36642
  Located on chromosome 22
  Distance between a terminus base of telomere on chromosomal short arm and 5'-terminus of this base sequence : 39003636
  Distance between 3'-terminus of neighbour sequence of sequence listing upward to telomere on chrosomal short arm and 5'-terminus of this base sequence : 48929
cttgtccttccacagagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccaggtgagaataccttggagccattcagaattggagaaagccatgcaaaccgccggtactacagagtcactgcaccagacacgcggagacacgggttgtctcttaatcttgttgagtccgtttgtttgtttgtttgtttgtttgtttgaaccaaagctcagggaggttgagtaacttgcttaaggtcac

SEQ ID NO: 25560 - DNA, 358 bp, Homo sapiens
  Z99716.4_122134
  Located on chromosome 22
  Distance between a terminus base of telomere on chromosomal short arm and 5'-terminus of this base sequence : 39089222
  Distance between 3'-terminus of neighbour sequence of sequence listing upward to telomere on chrosomal short arm and 5'-terminus of this base sequence : 85216
tacataagtgtccttggaatttcgcctagggcttggctggtgtagacccccatttgacagcatatgaaatggcctagatgggatggaatgaatgaatgagtgaatgtgatgagtaccagaaaatgtgcagtgggcacagaagagggccatccacatcagaaggcaaagcagaggctttcctgggagtagcagtggggctgaatgctggaggaggaggaggaggaggaggaggaggaggaggagggagccaggggttggagggggaacaggatcttccagcaaagcttgtggcacagtgacctgcacacatttactgtacttggggctggtgggtggcttgttagcatgtgactggcat

SEQ ID NO: 25561 - DNA, 203 bp, Homo sapiens
  Z99716.4_164109
  Located on chromosome 22
  Distance between a terminus base of telomere on chromosomal short arm and 5'-terminus of this base sequence : 39131321
  Distance between 3'-terminus of neighbour sequence of sequence listing upward to telomere on chrosomal short arm and 5'-terminus of this base sequence : 41741
gatctaatggatgtaccacagaactctttcaaactgtgactacaaataatttttttatctcatatatgtgtgtgtgtgtgtgtatatatatatatatatatatatatatatatatatatatatttttttttttttttttttttttttttttgagacagtgtcttgctttgtcacccaggctggagtgcaatcatgcaatcttg

SEQ ID NO: 25562 - DNA, 449 bp, Homo sapiens
  22_39167492
  Located on chromosome 22
  Distance between a terminus base of telomere on chromosomal short arm and 5'-terminus of this base sequence : 39353601
  Distance between 3'-terminus of neighbour sequence of sequence listing upward to telomere on chrosomal short arm and 5'-terminus of this base sequence : 222077
tggcccttggaatttattgtttatataaaaatattcacaatgttggctgggcatggtgctcatgcctgtaatcccagcactttgggaggccaaggcgggcggatcacgaggtcaggaaatcgagaccatcttgaccaacatggtaaaaccccgtctctactaaaaataccaaaaaaaagtagccgggcttggtggtgcgtgcctgtagtcccagctagttgggaggctaaggcaggggcatcacttgaacccgggaggaggagactgccatgagctgagatcgcgccactgcactccaacctggcaacagagtgagacttcatctcaaacaacaacaacaacaacaacaacaacaacaacaacaacaaaaccacattatttattgttataaatgtttgggtaaataaaatatgcttgccgacctgttttggaatcaacatgggttgatg

SEQ ID NO: 25563 - DNA, 103 bp, Homo sapiens
  DISO7_10004547
  Located on chromosome 22
  Distance between a terminus base of telomere on chromosomal short arm and 5'-terminus of this base sequence : 39477886
  Distance between 3'-terminus of neighbour sequence of sequence listing upward to telomere on chrosomal short arm and 5'-terminus of this base sequence : 123836
aagagatagaataccgggaggcaggaggacccccccaacttcacacacacacacacacacacacacacacacacacacttctgagaaattggataagaggaat

SEQ ID NO: 25564 - DNA, 101 bp, Homo sapiens
  DISO7_10004549
  Located on chromosome 22
  Distance between a terminus base of telomere on chromosomal short arm and 5'-terminus of this base sequence : 39550054
  Distance between 3'-terminus of neighbour sequence of sequence listing upward to telomere on chrosomal short arm and 5'-terminus of this base sequence : 72065
catggcctggtaactttagcaaagcctccccctcctccccctcctcctcctcctcctcctcctccctcctccctcttctaggtacagaggatgagcagtgg

SEQ ID NO: 25565 - DNA, 268 bp, Homo sapiens
  chr22.fa.O7frz.39455554
  Located on chromosome 22
  Distance between a terminus base of telomere on chromosomal short arm and 5'-terminus of this base sequence : 39641421
  Distance between 3'-terminus of neighbour sequence of sequence listing upward to telomere on chrosomal short arm and 5'-terminus of this base sequence : 91266
cttgatctagatagcaagatgactagataactgtatcattccaggttctccagagaaacagaaccaactgtgtgtgtgtgtgtgtgtgtgtgtgtgtgtgtgtgtgtgtattatatatatatatagaaagagagagacagagattgagatttattttgaggaactggctcacagattgtggggtctggcaagtctgaaatctgtaggcaggctgcaggctggacactcaggcaggatctctatgtcacagtcttgaacagacttgaag

SEQ ID NO: 25566 - DNA, 231 bp, Homo sapiens
  Z93241.11_118962
  Located on chromosome 22
  Distance between a terminus base of telomere on chromosomal short arm and 5'-terminus of this base sequence : 39755922
  Distance between 3'-terminus of neighbour sequence of sequence listing upward to telomere on chrosomal short arm and 5'-terminus of this base sequence : 114233
ggaggtctatagatcctggagtccaggggccttcccaaccatgccacgtgggagatgtagttatgactcaaataaataaaaccacacacacacacacacacacacacacacacacacacacacacacacgaggtatcattaactgagggtcaacagcgtgccagggctagactgggaaaccagagatgaatggtttcctactggcctgtagcatacctttctgcaattaga

SEQ ID NO: 25567 - DNA, 133 bp, Homo sapiens
  D22S1166
  Located on chromosome 22
  Distance between a terminus base of telomere on chromosomal short arm and 5'-terminus of this base sequence : 39755939
  Distance between 3'-terminus of neighbour sequence of sequence listing upward to telomere on chrosomal short arm and 5'-terminus of this base sequence : -214
ggagtccaggggccttcccaaccatgccacgtgggagatgtagttatgactcaaataaataaaaccacacacacacacacacacacacacacacacacacacacacacacacgaggtatcattaactgagggt

SEQ ID NO: 25568 - DNA, 174 bp, Homo sapiens
  HUMUT1091
  Located on chromosome 22
  Distance between a terminus base of telomere on chromosomal short arm and 5'-terminus of this base sequence : 39806891
  Distance between 3'-terminus of neighbour sequence of sequence listing upward to telomere on chrosomal short arm and 5'-terminus of this base sequence : 50819
cctgggaagttaagactgcactgagccatgatggtgccactgcacttcagcctgtatgacacggcaagaccctgttttgagaagaggaaagagagaaggaaggaaggaaggaaggaaggaaggaaggaaggaaggaaggaaaagaaatcaattagggaagaaataagcggtaga

SEQ ID NO: 25569 - DNA, 144 bp, Homo sapiens
  chr22.fa.O7frz.39798920
  Located on chromosome 22
  Distance between a terminus base of telomere on chromosomal short arm and 5'-terminus of this base sequence : 39984790
  Distance between 3'-terminus of neighbour sequence of sequence listing upward to telomere on chrosomal short arm and 5'-terminus of this base sequence : 177725
gatgtagttgatggctgataagaaacatgaaagtacatgtgcaaccagtcagcaatggtatgtatgtaggtaggtaggtaggtaggtaggtaggtaggtaggtatgtatgtacctacctacttacctactttagagatgaggtc

SEQ ID NO: 25570 - DNA, 133 bp, Homo sapiens
  D22S1151
  Located on chromosome 22
  Distance between a terminus base of telomere on chromosomal short arm and 5'-terminus of this base sequence : 40243322
  Distance between 3'-terminus of neighbour sequence of sequence listing upward to telomere on chrosomal short arm and 5'-terminus of this base sequence : 258388
ccagactgcgccattgcactccagcctgggcaacaagaatgaaactccatctccagaaaaaaacaaaaaacaaaaaaaatatatatatatacacacacacacacacacagaggacactttcaggttaagacgc

SEQ ID NO: 25571 - DNA, 369 bp, Homo sapiens
  Z82214.23_51017
  Located on chromosome 22
  Distance between a terminus base of telomere on chromosomal short arm and 5'-terminus of this base sequence : 40294743
  Distance between 3'-terminus of neighbour sequence of sequence listing upward to telomere on chrosomal short arm and 5'-terminus of this base sequence : 51288
ttctgcgaaatgcatgtatatatcttttgtcagtttttattttttatttttcattttttgtagagatgggggagtcttgccatgttgcccaggctggtctcgaactcctggacacatgcaatcctcctgctttggcttcccaaagtgctgggattataggtgtgagccactgcacctgaccctagatttcttttagaacctgaggaaagctgtgggccatattcccagagaaatagaaatgtgtatctgtacatgcatgtgtacacacacacacacacacacacacacacacacacacagcattgcgtgccgaatttcaatgagtcatagattccctgaggctcactgtgaccatgacttccagattaa

SEQ ID NO: 25572 - DNA, 176 bp, Homo sapiens
  D22S1179
  Located on chromosome 22
  Distance between a terminus base of telomere on chromosomal short arm and 5'-terminus of this base sequence : 40294950
  Distance between 3'-terminus of neighbour sequence of sequence listing upward to telomere on chrosomal short arm and 5'-terminus of this base sequence : -162
agctgtgggccatattcccagagaaatagaaatgtgtatctgtacatgcatgtgtacacacacacacacacacacacacacacacacacacagcattgcgtgccgaatttcaatgagtcatagattccctgaggctcactgtgaccatgacttccagattaaagccccagtgtcaa

SEQ ID NO: 25573 - DNA, 312 bp, Homo sapiens
  Z99756.7_17719
  Located on chromosome 22
  Distance between a terminus base of telomere on chromosomal short arm and 5'-terminus of this base sequence : 40390888
  Distance between 3'-terminus of neighbour sequence of sequence listing upward to telomere on chrosomal short arm and 5'-terminus of this base sequence : 95762
cttaaaccttaatgttccatgtctgtattgtcattttaataggcaaatatataaaaccacaaaggcggcgtgagctactggctgcttctagccaatccccggtccctaacacacacacacacacacacacacacacacacacacacactcttcggtgttgagcttttgatacacttctttttaacatagacatcttttactattggaaccaaaaggatgtgaaaaggtaaagagttggtgacctgcactgaactgggagaggacttggctgtggagcgatttgagccaggtcctatttagactcatggacga

SEQ ID NO: 25574 - DNA, 390 bp, Homo sapiens
  AL031301.2_107564
  Located on chromosome 22
  Distance between a terminus base of telomere on chromosomal short arm and 5'-terminus of this base sequence : 40421997
  Distance between 3'-terminus of neighbour sequence of sequence listing upward to telomere on chrosomal short arm and 5'-terminus of this base sequence : 30797
ttccattcatctaagcactgacccatccaaacatccatccatccatccatccatccatccatccatccatccatccagatgagaaatcctctcatctgtatattcattgattcaaatacccacctttctatccaaacacatgtacactcacgctcatgcacacacacgcacattcaaacacctacctacccattcatccatccaaacttctattaactcactgattccttcaaatatccctccaaacagcttacaaaatacatacaacaattttttctaatagaataagatgttagtatgaagaaaaataaatgagggttgaagaataagataaagctggtgaaaatatacaaaaacacatttgataactgtagcacaatgacagaaggt

SEQ ID NO: 25575 - DNA, 310 bp, Homo sapiens
  Z99756.7_65644
  Located on chromosome 22
  Distance between a terminus base of telomere on chromosomal short arm and 5'-terminus of this base sequence : 40438760
  Distance between 3'-terminus of neighbour sequence of sequence listing upward to telomere on chrosomal short arm and 5'-terminus of this base sequence : 16373
caagttcagtctaggctttgagggctcccgacactctctacctcctgcccccaacacatatacactttcagtctggaacagctgttggggcaaattgtgcaaaatagattctgtgtatccattccatctatacaccccaagcctctctccttgtctcttttacacacacacacacacacacacacacacacacacacacacacacacacacagagttcaggcagggaggggacgtgcctcttgtcgggcacagttcagcacagtcagagctgtacctataatccaggttgattcctcaggttatagatga

SEQ ID NO: 25576 - DNA, 223 bp, Homo sapiens
  AL031301.2_15401
  Located on chromosome 22
  Distance between a terminus base of telomere on chromosomal short arm and 5'-terminus of this base sequence : 40511053
  Distance between 3'-terminus of neighbour sequence of sequence listing upward to telomere on chrosomal short arm and 5'-terminus of this base sequence : 71983
gctaggtattgctggaaacttcatccatttccttccatccattcatccctccctcccatccatccatccatccatccatccatccatccactcactcaacacatatttattcctgtctgctatgtgctcggccaggggattcagtggctacctagacaggtcccagccctcaaagggaatgttgatcatggaatgcccaaactaaggagcagttctgtctcct

SEQ ID NO: 25577 - DNA, 223 bp, Homo sapiens; identical to SEQ ID NO: 25576
  AL096761.1_55970
  Located on chromosome 22
  Distance between a terminus base of telomere on chromosomal short arm and 5'-terminus of this base sequence : 40511053
  Distance between 3'-terminus of neighbour sequence of sequence listing upward to telomere on chrosomal short arm and 5'-terminus of this base sequence : -223

SEQ ID NO: 25578 - DNA, 162 bp, Homo sapiens
  D22S282
  Located on chromosome 22
  Distance between a terminus base of telomere on chromosomal short arm and 5'-terminus of this base sequence : 40562543
  Distance between 3'-terminus of neighbour sequence of sequence listing upward to telomere on chrosomal short arm and 5'-terminus of this base sequence : 51267
ggcttgatgacactgcatttgtgtatatgaattgaacatctgaaagctgttggtcagctctgtgtgtgtgtgtgtgtgtgtgtgtgtgtgtgtgtgtgtgtgtgtggtgggcatagggggatgtgatcatggggccctggccatgtctttgggcaagcccta

SEQ ID NO: 25579 - DNA, 218 bp, Homo sapiens
  Z82172.2_3875
  Located on chromosome 22
  Distance between a terminus base of telomere on chromosomal short arm and 5'-terminus of this base sequence : 40562569
  Distance between 3'-terminus of neighbour sequence of sequence listing upward to telomere on chrosomal short arm and 5'-terminus of this base sequence : -136
atgaattgaacatctgaaagctgttggtcagctctgtgtgtgtgtgtgtgtgtgtgtgtgtgtgtgtgtgtgtgtgtgtggtgggcatagggggatgtgatcatggggccctggccatgtctttgggcaagccctatattgatacctatgggtttttcctcctgcacctgtttttctccccagtttttgctttccaagtctggcttccagatttgata

SEQ ID NO: 25580 - DNA, 375 bp, Homo sapiens
  AL096759.1_1998
  Located on chromosome 22
  Distance between a terminus base of telomere on chromosomal short arm and 5'-terminus of this base sequence : 40568202
  Distance between 3'-terminus of neighbour sequence of sequence listing upward to telomere on chrosomal short arm and 5'-terminus of this base sequence : 5415
ataaaccatctatccgtccatccatctatatatgcatctatatattcatacatatataaagcatccattcattcatccacccatccatccatctacccacccaccaacccatctataaaccatccatccatccattaatccatctatatatgcatctatatatccatacatatataaatcatccatccagccacccatccatccatccatccataaatcatccatccatccatccatccatccattcatccatctatatatacatctatatatccatacatatataaagcatccatccataaaccatccatctatccattcatccatccatgtatgcatctatatatccatccgtctacaaagcatccattcatc

SEQ ID NO: 25581 - DNA, 358 bp, Homo sapiens
  chr22.fa.O7frz.40451205
  Located on chromosome 22
  Distance between a terminus base of telomere on chromosomal short arm and 5'-terminus of this base sequence : 40636854
  Distance between 3'-terminus of neighbour sequence of sequence listing upward to telomere on chrosomal short arm and 5'-terminus of this base sequence : 68277
tttatggtaagtatgccatcagtgagttccttcagtttttgtgtgcctagaaaatccaatgtatctctttatttttgaaaggtattttgctggttacaaaatttgagcttgatgattttctttcagcactctgaaaatgttatgccattgtctgctggttagcatggtttctgagaagtatgctataattcttatccttgttcctctgtaggtcatgtacatcttttttctctagctgccttctttttttttgcagcaattcgaatatgatattcctagaggtgcgtgtgtgtgtgtgtgtgtgtgtgtgtgtgtgtgtgtgtgtgtgtgtgtgtatcctgccaggttctatatgctt

SEQ ID NO: 25582 - DNA, 174 bp, Homo sapiens
  chr22.fa.O7frz.40588855
  Located on chromosome 22
  Distance between a terminus base of telomere on chromosomal short arm and 5'-terminus of this base sequence : 40774687
  Distance between 3'-terminus of neighbour sequence of sequence listing upward to telomere on chrosomal short arm and 5'-terminus of this base sequence : 137475
agctgagatagaattgcttgaacccaggaggcagaggttgcagtgagccgagatcgcgccactgcactccagcctgggtgacagagtgagactccatttcaaaataataataataataataataataataataataataataataatttatagagtagacagaatctttctggc

SEQ ID NO: 25583 - DNA, 98 bp, Homo sapiens
  D22S1165
  Located on chromosome 22
  Distance between a terminus base of telomere on chromosomal short arm and 5'-terminus of this base sequence : 40940358
  Distance between 3'-terminus of neighbour sequence of sequence listing upward to telomere on chrosomal short arm and 5'-terminus of this base sequence : 165497
cacagtatgttctcgacgctgcttcaccacacacacacacacacacacacacacgtgaaccaaaaggggtattttggagaaggtcacatccaaggata

SEQ ID NO: 25584 - DNA, 370 bp, Homo sapiens
  Z97055.1_123435
  Located on chromosome 22
  Distance between a terminus base of telomere on chromosomal short arm and 5'-terminus of this base sequence : 40982262
  Distance between 3'-terminus of neighbour sequence of sequence listing upward to telomere on chrosomal short arm and 5'-terminus of this base sequence : 41806
tagattgtctgaggtcaggagtttgagaccagtctgaccaacatggcgaaaccccgtctctactaaaaatacaaaacttagccagatgtagtgtgtgcctgtaatcccatgattatatatatatatatatatatatatatatatatatatatatatatatatatatgatgggaagcagtggtcgggcatgcctcattatatcctacccccttttggaatcacagatagaaaatattctttttttaacgtttctagtagctttattcataacagcaaaaactggaaacaaagtattgatatattcattcactgagcgaatggttaaacaaactatggtacatccatactatggaatactattcagcggtaa

SEQ ID NO: 25585 - DNA, 300 bp, Homo sapiens
  AL035398.19_21504
  Located on chromosome 22
  Distance between a terminus base of telomere on chromosomal short arm and 5'-terminus of this base sequence : 41071989
  Distance between 3'-terminus of neighbour sequence of sequence listing upward to telomere on chrosomal short arm and 5'-terminus of this base sequence : 89357
aaagatgctgttcataactcattcatttcatgtcccatacccgctgccttgcacatggtgctcaatacacacttattgactgactggtagaccgatctgcttaaaggttaaaggctacatccaaatatttattttatttttttatattacacacacacacacacacacacacacacacacacactttttaatagaaacagggtctcactatgttgcccaggctggtctcaaactcctgggctcaagtgatcctcctgccttggcctctcaaagtgccagtgctaggtacagacatgagct

SEQ ID NO: 25586 - DNA, 399 bp, Homo sapiens
  Z82174.2_2118
  Located on chromosome 22
  Distance between a terminus base of telomere on chromosomal short arm and 5'-terminus of this base sequence : 41179239
  Distance between 3'-terminus of neighbour sequence of sequence listing upward to telomere on chrosomal short arm and 5'-terminus of this base sequence : 106950
ttgagatcctgatacgcaccctgtataagaccttcaacagcctgtcgaccactcactgcctccgtttcctcatctgttagatagggatgatcataagggttctttcttgcttgccttatggggccttgatgagaatcaaatgaaatgatgacatcagtcccttaattatttctcctcctcctcctcctcctcctcctcctcctcctcctcctcttcctcctccatctcctcctctcttcttcttccttttttttcttctttcttctttctttttcttcttcttaggcagggtctcactctgttgcccaggctagagtgcagtgggatggtcataggctcaagtgatcctcctgcctcagcctcctgaataactggaactacaggtatgtgccattgtat

SEQ ID NO: 25587 - DNA, 379 bp, Homo sapiens
  AL033543.6_39883
  Located on chromosome 22
  Distance between a terminus base of telomere on chromosomal short arm and 5'-terminus of this base sequence : 41235060
  Distance between 3'-terminus of neighbour sequence of sequence listing upward to telomere on chrosomal short arm and 5'-terminus of this base sequence : 55422
agccatgattgtaccactacattccagcctaggcaacagagtgagaccctgtcgatcaagagagagagagagagagagagagagagagacagagagacagagagagagagagagagagagagacacagagacagagagagagagagagagagagagagagagagagagagagagagagaggtctcactgctttctctcccacgtatacactcccaggtaacaattttcaatggattctgattttatccttcttatgtttctttacaaaaatgtccatatacacacctactcatttcccttttattccttgcataaaaggtgatgtattttgtacattcttttacacaccctgcttgtttcgcttaatatgttctaggaa

SEQ ID NO: 25588 - DNA, 248 bp, Homo sapiens
  chr22.fa.O7frz.41140717
  Located on chromosome 22
  Distance between a terminus base of telomere on chromosomal short arm and 5'-terminus of this base sequence : 41326519
  Distance between 3'-terminus of neighbour sequence of sequence listing upward to telomere on chrosomal short arm and 5'-terminus of this base sequence : 91080
atcaccatcactgttactatcatcaccatcacatcatcatcactatcatcaccatcatcactaccatcatcattgtcaccatcaccatcattgtcaccatcatcaccactgctgtcactatcatcaccatcacatcatcatcatcatcatcattatcatcatcatcactacaggcacaaaaacagtgctggaagtccctcctccataggtcctagtgaggatgcagtgacatgaggtacgtgaggtta

SEQ ID NO: 25589 - DNA, 360 bp, Homo sapiens
  AL022339.1_3475
  Located on chromosome 22
  Distance between a terminus base of telomere on chromosomal short arm and 5'-terminus of this base sequence : 41397435
  Distance between 3'-terminus of neighbour sequence of sequence listing upward to telomere on chrosomal short arm and 5'-terminus of this base sequence : 70668
gaattgcagtagacaagctcagatctgaacataaccctggggcagccaccccacaaggccaacccttgagatgccacctctctgccttcctgccttccttccttccttccttccttccttccttccttccttccttcacagcctgcctgagtcagaactagtacccctcatgccatacaaggcatgtacacataaggaactaagtaacatttgtattttctaacctcatgctgaaaaatctggctggacagactgatttgcttcctttggccagatttacaactcaaaaagccatccggttttcccctttgccttggcagctaggtaacccaaaactccactaaatgtttagtggttacc

SEQ ID NO: 25590 - DNA, 156 bp, Homo sapiens
  DISO7_10008873
  Located on chromosome 22
  Distance between a terminus base of telomere on chromosomal short arm and 5'-terminus of this base sequence : 41539925
  Distance between 3'-terminus of neighbour sequence of sequence listing upward to telomere on chrosomal short arm and 5'-terminus of this base sequence : 142130
taggtcgcctgacatgtgtgtatgtgtgtgtgtgtgtgtgtgtgtgtgtgtgcatgcaaatgtatgaattcaataagcattgttgcacacctactgtgtgccaggtcccatgctgggaagtaatcagaagaagacattatcatgatgtatacagcg

SEQ ID NO: 25591 - DNA, 376 bp, Homo sapiens
  Z75407.2_35363
  Located on chromosome 22
  Distance between a terminus base of telomere on chromosomal short arm and 5'-terminus of this base sequence : 41660004
  Distance between 3'-terminus of neighbour sequence of sequence listing upward to telomere on chrosomal short arm and 5'-terminus of this base sequence : 119923
aaacattgtgccaaattgttacccacatggcggagggcagagagcggttagaggcaaacagccagggttggcttcttggagtggtagactggggtgaaattgcatttgtttttttaagagttattttaatacagctggcccatttcgggggcatgaacacagatcagggtgaattgctgttttccttcaacaactatgaccccaatggaatcactgttctcgccaaacccccgcaatctctcacacacacacacacacacacacacacacacacacacacacacacacacgtcaggggtggaagaacaccctaaattggagttgtagctctgccactggcaaattgcacagatgtggactagtgatcactccttct

SEQ ID NO: 25592 - DNA, 364 bp, Homo sapiens
  Z98743.1_3089
  Located on chromosome 22
  Distance between a terminus base of telomere on chromosomal short arm and 5'-terminus of this base sequence : 41765123
  Distance between 3'-terminus of neighbour sequence of sequence listing upward to telomere on chrosomal short arm and 5'-terminus of this base sequence : 104743
tacctggatgaaagaatggatggatgaatggatggatggatgattgaatggatggatggatggatggatggatggatggatggatgattgaacggatggatggatggatggatggatggatggatggatggtttgatgggggatggataagttgatggatgggggatggatggatgcatggatggatgactgaacagatggacagatggacggatggatgggtgggtgggtgggtgaataatgaagggatatgtggatgtatgggtggatgtgtagatgggttttcaggggcctagattgtccgaccattgcccctgttttggtacaagggaatggccatcactcctttcattcctctatcctc

SEQ ID NO: 25593 - DNA, 443 bp, Homo sapiens
  Z93244.1_64038
  Located on chromosome 22
  Distance between a terminus base of telomere on chromosomal short arm and 5'-terminus of this base sequence : 41918426
  Distance between 3'-terminus of neighbour sequence of sequence listing upward to telomere on chrosomal short arm and 5'-terminus of this base sequence : 152939
cactgttatgtctcatccaaagcaacaaacatctgcaaaaacgtagacaacaaacaactccgtgcccagcagttggtcagaggaaaacatcttgcgttgctttgttttgttttgttttgttttgttttgttttgttttgtttgagacagggtttcgctctgtcgcccaggctggagtgcagtagtacgatcccagctcacagcaacctctgcctcccgggttcaagagattctcctcctcagcctcccaagtagctgggattacaggcgctcacccccacactcagctaatttttgtatttttagtagagacggggtttcgccattttggtcaggctggtcttgaactcctgacctcaagtgatccacctgtctcggtctcccagaatgctgggattataggcgtgagccaccgtgcccggccttgcattgctttaatttagg

SEQ ID NO: 25594 - DNA, 206 bp, Homo sapiens
  D22S274
  Located on chromosome 22
  Distance between a terminus base of telomere on chromosomal short arm and 5'-terminus of this base sequence : 42004476
  Distance between 3'-terminus of neighbour sequence of sequence listing upward to telomere on chrosomal short arm and 5'-terminus of this base sequence : 85607
gtccaggaggttgatgctgcaatgagccgagatcatgatcatgccactgaactccagcctgggtgacagtgagaccctgtcttaaaaacaacacacacacacacacacacacacacacacacacacacacacgccaagaaaagaaaaatcacttgaaatgtgactatctatgaatcctattcttaatattttgagaaatgggcact

SEQ ID NO: 25595 - DNA, 273 bp, Homo sapiens
  Z83838.2_58813
  Located on chromosome 22
  Distance between a terminus base of telomere on chromosomal short arm and 5'-terminus of this base sequence : 42004496
  Distance between 3'-terminus of neighbour sequence of sequence listing upward to telomere on chrosomal short arm and 5'-terminus of this base sequence : -186
aatgagccgagatcatgatcatgccactgaactccagcctgggtgacagtgagaccctgtcttaaaaacaacacacacacacacacacacacacacacacacacacacacacgccaagaaaagaaaaatcacttgaaatgtgactatctatgaatcctattcttaatattttgagaaatgggcactctcgtatactgctggtcacaatgcaaatagtacagtcactttagagagcgatttagcaagctggtgaagttcaagcattgttaagtc

SEQ ID NO: 25596 - DNA, 237 bp, Homo sapiens
  chr22.fa.O7frz.42036252
  Located on chromosome 22
  Distance between a terminus base of telomere on chromosomal short arm and 5'-terminus of this base sequence : 42222033
  Distance between 3'-terminus of neighbour sequence of sequence listing upward to telomere on chrosomal short arm and 5'-terminus of this base sequence : 217264
aaggcaatcagtctactaagttaacaaaagcttaccattcacagtaaaagcaaaagaaatgaaaaaaaaaaatgtaaggagccctccggtaagtgattttcctattgcttctgtctactgagatagtgatttctttggttctcgtgaccaaccacacacacacacacacacacacacacacccctctatagaagaaatgtgtgaaactcatgcttccagtaacaatctatacattga

SEQ ID NO: 25597 - DNA, 271 bp, Homo sapiens
  D22S1141
  Located on chromosome 22
  Distance between a terminus base of telomere on chromosomal short arm and 5'-terminus of this base sequence : 42454224
  Distance between 3'-terminus of neighbour sequence of sequence listing upward to telomere on chrosomal short arm and 5'-terminus of this base sequence : 231954
ctccccacagcgtcagaggggactgtgtgtgtgtgtgtgtgtgtgtgtgtgtgtgtgtacacagcacaaggccggaactcgcagacagttccagactttgtgtttgcaatgtttccgctttgactttcattctcttgctcccttcttttcaagtagaaagtttttaaaaagcctcatccggaaacagccccaggaactgctcctggttatcgggactggcgtcagcgcagcagtggcccccggaatccctgccctttgctcgtggagaagc

SEQ ID NO: 25598 - DNA, 416 bp, Homo sapiens
  AL021391.2_42490
  Located on chromosome 22
  Distance between a terminus base of telomere on chromosomal short arm and 5'-terminus of this base sequence : 42540510
  Distance between 3'-terminus of neighbour sequence of sequence listing upward to telomere on chrosomal short arm and 5'-terminus of this base sequence : 86015
tataatcctagcactttggcaggccaaggtgagcagatcacctgaggtcaagaattcgagactagcctggccaacacggtgaagccccctctctaccaaaaaatataaaaaatagccgagcttggtggcacgcacctgtagtcccagctactcaggaagctgaggcaagagaattgcttgaacctaggaggcggtggttgcagtgagccgagattgcaccactgcactccagcctgggcaacgaggagagactccaactctaaataaataaataaataaataaataaataaataaataaataaataaaaacaagagaagctaactaaatccaggatcgagggctagattaaaattgtttgattggtatgagatggtgctacagaaaatttatatagcaggcttgatactgttatct

SEQ ID NO: 25599 - DNA, 335 bp, Homo sapiens
  Z93784.1_47306
  Located on chromosome 22
  Distance between a terminus base of telomere on chromosomal short arm and 5'-terminus of this base sequence : 42858370
  Distance between 3'-terminus of neighbour sequence of sequence listing upward to telomere on chrosomal short arm and 5'-terminus of this base sequence : 317444
ccgtcttgatttcattgttaacccccaaatcatgcaggagcagcttgtttaatttccgtgtatttatgtagttttgagggttccttttggaattgatttctagttttattctattgtggtctgagaagatacttgatatagttctgtctgtctgtctatctatctatatctatctatctatctatctatctatctatctatctatctatctgagactgagtctcgctctgttgcccaggctggggtgcagtggcacgatcttggcttactgtaacctctgcctcctgggttcaagtgattcttccgcctcagcctcctgagtagctggattacag

SEQ ID NO: 25600 - DNA, 171 bp, Homo sapiens
  HUMUT7136
  Located on chromosome 22
  Distance between a terminus base of telomere on chromosomal short arm and 5'-terminus of this base sequence : 42858485
  Distance between 3'-terminus of neighbour sequence of sequence listing upward to telomere on chrosomal short arm and 5'-terminus of this base sequence : -220
gtggtctgagaagatacttgatatagttctgtctgtctgtctatctatctatatctatctatctatctatctatctatctatctatctatctatctgagactgagtctcgctctgttgcccaggctggggtgcagtggcacgatcttggcttactgtaacctctgcctcct

SEQ ID NO: 25601 - DNA, 176 bp, Homo sapiens
  Z93784.1_60654
  Located on chromosome 22
  Distance between a terminus base of telomere on chromosomal short arm and 5'-terminus of this base sequence : 42871837
  Distance between 3'-terminus of neighbour sequence of sequence listing upward to telomere on chrosomal short arm and 5'-terminus of this base sequence : 13181
gtgcttagaaagtagcttggatagagagatatatattttatatgaatacacacacacacacacacacacacacacacacacacacacatatatatacacacacacacgtgtgtgtgtgtgtgtatatatatatatgtatatgttaatatataggctctttggagcctagacaaatt

SEQ ID NO: 25602 - DNA, 355 bp, Homo sapiens
  Z84478.1_57876
  Located on chromosome 22
  Distance between a terminus base of telomere on chromosomal short arm and 5'-terminus of this base sequence : 42958203
  Distance between 3'-terminus of neighbour sequence of sequence listing upward to telomere on chrosomal short arm and 5'-terminus of this base sequence : 86190
ttatgttaaccgaaaggagtaaacagagctttaaaggagcagcatttttggatgttactgaagtaaaactggcataaattagaattagagtattataactttcgaatgttaaatgtaatccccatggtaaccacacacacacacacacacacacacacacacacacacacacacggctatagaatatacacaaaaggaaatgaaaaaggaacttaaacatttcagtacaaaaaataaaaagaagacaataatgtaagaaataagttataagacatatgggaaacaaatagcaaaatgacataaataagcccttatcggtaattatttaaatgtaaatggatcaagctgtgtaatc

SEQ ID NO: 25603 - DNA, 117 bp, Homo sapiens
  D22S1149
  Located on chromosome 22
  Distance between a terminus base of telomere on chromosomal short arm and 5'-terminus of this base sequence : 43339166
  Distance between 3'-terminus of neighbour sequence of sequence listing upward to telomere on chrosomal short arm and 5'-terminus of this base sequence : 380608
tgaggattaaatgaccccagtaaacaatacatatatatacatacacacacacacacacacacacacacacacacacacacatacattttaaagataactctggaagccagtgcttaa

SEQ ID NO: 25604 - DNA, 152 bp, Homo sapiens
  DISO7_10004556
  Located on chromosome 22
  Distance between a terminus base of telomere on chromosomal short arm and 5'-terminus of this base sequence : 43586640
  Distance between 3'-terminus of neighbour sequence of sequence listing upward to telomere on chrosomal short arm and 5'-terminus of this base sequence : 247357
ctggaaggaaaggtgttaccccacacgatgaccttgaaaacggcccccacccccgttgtgtgcgtgtgtgtgtgtgtgtgtgtgtgtgtgtgtctgtctgtctgtgtgttttgtttgctttttaagagcccctggccttcatccaggacaag

SEQ ID NO: 25605 - DNA, 424 bp, Homo sapiens
  chr22.fa.O7frz.43611309
  Located on chromosome 22
  Distance between a terminus base of telomere on chromosomal short arm and 5'-terminus of this base sequence : 43796938
  Distance between 3'-terminus of neighbour sequence of sequence listing upward to telomere on chrosomal short arm and 5'-terminus of this base sequence : 210146
taatcacgtctaagtcgaagagtgactttttgtgtatgcttttctgtgttttctcgatattattaaatcaacatgacttacttttgtaagcaggaaaaacatttttttaaagtatctgtggcatgcctatgttttgccaggcactttgcagggtgtgctgaggacacgctttataaacacagtactgacctgcccaacgagttcaccaccagcctgggacatcccaagtggggttggtggaaggaaggggaggatcctcccacaaaggtagagcctgggcagtagtcccctcaccccccaacacacacacacacacacacacactcttcccattcccaactctaaaggaataaatgcagggtttgtctaagtgtgttttgcgacagtcaggggaaataacccagatatcaactcagtgtttcca

SEQ ID NO: 25606 - DNA, 478 bp, Homo sapiens
  chr22.fa.O7frz.43796289
  Located on chromosome 22
  Distance between a terminus base of telomere on chromosomal short arm and 5'-terminus of this base sequence : 43982121
  Distance between 3'-terminus of neighbour sequence of sequence listing upward to telomere on chrosomal short arm and 5'-terminus of this base sequence : 184759
acctttatggcaactgtttaacccccttaaaatggatgcacatgctgatgttttcttctaggcttaaagctgagtgttaggtatatatgtgtttgtttgtatgtatgtatgtatgtatgtatgtatgaatgaaggagagagacagagtgttgctctattgcctaggctaagtgcactaacgttatcatagttcatggcagctgcaacctcccaggcttaagtgatgctcctacctcagcctcccaagtagctgggactacaggcatgcaccaccacgcctgactaattttttattttttgtagaggcagagtcttgctatattgccctggttggtctcaaactcctggactcaaggaattcttcttccttggcctctcaaagtgctgggattacaggcacgagccactgtgcctagctcaaagctgggtattctcccattctaataatcatttagtcatgtcctatgacaattatacc

SEQ ID NO: 25607 - DNA, 438 bp, Homo sapiens
  chr22.fa.O7frz.44122712
  Located on chromosome 22
  Distance between a terminus base of telomere on chromosomal short arm and 5'-terminus of this base sequence : 44308462
  Distance between 3'-terminus of neighbour sequence of sequence listing upward to telomere on chrosomal short arm and 5'-terminus of this base sequence : 325863
tggtttctactttacaatgagaagtctgaggcacagagaagagttcagtgtgcaaactgtgcccagaaagggctgtgactaactacaaagacatgcagccaacctggggcagaagctaactgctaactggagacctggagtcactgggtcctggtgccgcctctctcctccaggggtgctgtgtgtgtgtgtgtgtgtatgtgtgtgtgtgtgtgtgtgtgtgtgtgtgtgtggtctgtcccgagccagccataatgtaggaccctgagttctgggaggcagcaccagggaacacgtcagtccgagcacccaggagatggggttgtcttctaagccacatcgacaggaagaatcccagaggcggcactggaaggatgttgtctctgtggccaaactcagccctggttttgttgggactcagtgattcatttaggacag

SEQ ID NO: 25608 - DNA, 251 bp, Homo sapiens
  22_44251533
  Located on chromosome 22
  Distance between a terminus base of telomere on chromosomal short arm and 5'-terminus of this base sequence : 44437840
  Distance between 3'-terminus of neighbour sequence of sequence listing upward to telomere on chrosomal short arm and 5'-terminus of this base sequence : 128940
atcctgaacctgttcctcacagcagaggatcggccagtggaggaagaagctctgaaatcacagtaaacgaagttagccacctgcaaaatggactccccaaacacacatgtgcgcgcgcgcgtgcacacacacacacacacacacacacacacaacgtggagcacctcaacatgtgatagagatgggagggacctcagtagccccaggccgaccccagaaccttctcggcgcctactgtctggtcttggcat

SEQ ID NO: 25609 - DNA, 322 bp, Homo sapiens
  chr22.fa.O7frz.44331062
  Located on chromosome 22
  Distance between a terminus base of telomere on chromosomal short arm and 5'-terminus of this base sequence : 44516873
  Distance between 3'-terminus of neighbour sequence of sequence listing upward to telomere on chrosomal short arm and 5'-terminus of this base sequence : 78782
gaatttatcaccaatagatcacactaaaggaaatactaaagattgttctataggcagaacaaaaatgatctcaggtgaaaggtaagagatgcaaaatatataaggaacaaaaagagtttgtgtgtgtgtgtgtgtgtgtgtgtgtgtgtgtgtgtgaaaataatgcctcattgggcttaaaacagagaattaaaatatacaacagcaatgctatacaagaaggaatgtgataaatggaccttatgtgtttttaagcccttaattgtccagaaagagggtaaaataacaaaaaatactaaactttaataagccaagaatgctt

SEQ ID NO: 25610 - DNA, 386 bp, Homo sapiens
  chr22.fa.O7frz.44458035
  Located on chromosome 22
  Distance between a terminus base of telomere on chromosomal short arm and 5'-terminus of this base sequence : 44643663
  Distance between 3'-terminus of neighbour sequence of sequence listing upward to telomere on chrosomal short arm and 5'-terminus of this base sequence : 126468
atggaatcagttaggtcagatctttttcactgtctcagatattattttgcgatggtggtttcataactttaaatgatgactattgtagttttcataactaatctaggtaaatgattaaaataattaggtacgtgtaatgggataaatacttgtagacagacttgtcataatttagaatctaaagttaaattaaataacagatatttcattatttgggtattttccaataaaaatatattgaaggaaaccattctttctaaaatacatatatattataaataaatatatatatatatatatagtgtgtgtgtgtgtgtgtgtgtgtgtcctttttaaaaaagtgaataatttttgttgaatccaaagcttatctaaaggttacgttt

SEQ ID NO: 25611 - DNA, 302 bp, Homo sapiens
  AL117329.8_33175
  Located on chromosome 22
  Distance between a terminus base of telomere on chromosomal short arm and 5'-terminus of this base sequence : 44717486
  Distance between 3'-terminus of neighbour sequence of sequence listing upward to telomere on chrosomal short arm and 5'-terminus of this base sequence : 73437
ctttcaggcagatctggacttggtgttgcacacctgcaaggggcacaggcacgtggaccagagtgcaggtgtgcaggagagttggcatacacactagagaacctgtacaacacacacacacacacacacacacacacacacacacacacacacagaggagagagagggacagtgacagtactgcttctaatatcctaacacaattattcaaaatacccagggaattgggacaaatctctgatgggtctaaggtgatttctgcttttcaaagaatattttaaattgtcaggaaagtgtattca

SEQ ID NO: 25612 - DNA, 207 bp, Homo sapiens
  22_44605219
  Located on chromosome 22
  Distance between a terminus base of telomere on chromosomal short arm and 5'-terminus of this base sequence : 44791520
  Distance between 3'-terminus of neighbour sequence of sequence listing upward to telomere on chrosomal short arm and 5'-terminus of this base sequence : 73732
gtcagttccctattagcagaagtttttacatttagaattgattggaaattttagaataacaaacatttttaacagcacataagttacacagggaaaatctgaattcaaatgcctcaaagcaggtgcaattttatttatttatttatttatttatttatttatttatttatttatttattttttactgtcatctgctggaaatgtaag

SEQ ID NO: 25613 - DNA, 291 bp, Homo sapiens
  AL121580.8_96330
  Located on chromosome 22
  Distance between a terminus base of telomere on chromosomal short arm and 5'-terminus of this base sequence : 44927038
  Distance between 3'-terminus of neighbour sequence of sequence listing upward to telomere on chrosomal short arm and 5'-terminus of this base sequence : 135311
agacggcacctataggatagatagttagatatatagatgattgataggtaaatagatagatagatagatagatagatagggagagagttattaggggaataggctcacatgattatagtggctgagaaatcccatgaaaggccatctgcaatttggagaagcaaagaagctgggagtgtggctcagtccaagtgcaaaaacttcagaaccagcaaagccagtggtgtaactctcagtccaaggatgaaggtctgaggacccagaggactgctcttgcaaattgtggagtcc

SEQ ID NO: 25614 - DNA, 354 bp, Homo sapiens
  AL110122.1_27903
  Located on chromosome 22
  Distance between a terminus base of telomere on chromosomal short arm and 5'-terminus of this base sequence : 44995648
  Distance between 3'-terminus of neighbour sequence of sequence listing upward to telomere on chrosomal short arm and 5'-terminus of this base sequence : 68319
cctccataatcacataaaccacttcccctaataaatcccctctcatatagcttcatctatctatctatctatctatctatctatctatctatctatctatctatctaactatccatccatccatcctattggttttgtctctctggagaatgctgactaatactccagattataacatggtgtcccagtacttccctccaccccaatggcagaggatgtcggagaaggctgagtaggaaaacccctgtcttcccacttcctagtgtcctagtgtcaagggagaacccacacccacccagtggtaatgagaaccccacccctgaatggggtagtgtcagagaaggattggttcaa

SEQ ID NO: 25615 - DNA, 247 bp, Homo sapiens
  AL110121.1_8441
  Located on chromosome 22
  Distance between a terminus base of telomere on chromosomal short arm and 5'-terminus of this base sequence : 45105668
  Distance between 3'-terminus of neighbour sequence of sequence listing upward to telomere on chrosomal short arm and 5'-terminus of this base sequence : 109666
ttctgtttcagaacaaactccttctaaataaataaataaataaataaatacagtcgtgtgttgcttaaagacaggaatatgctctgagaaatgcacctgtgggtgattttatggctatgtgaacatcacagggtgcactcacacacacctgggcggcacagcctcctacacaccgaggctatgtggtatggccagttgctcctgggccatgcacctgttcagtgtgtgactgtatagatcctgcagg

SEQ ID NO: 25616 - DNA, 172 bp, Homo sapiens
  chr22.fa.O7frz.45023212
  Located on chromosome 22
  Distance between a terminus base of telomere on chromosomal short arm and 5'-terminus of this base sequence : 45209054
  Distance between 3'-terminus of neighbour sequence of sequence listing upward to telomere on chrosomal short arm and 5'-terminus of this base sequence : 103139
gatttaagaatgatcagatctgagagcacagcccacaaagccagtgtctgtgtgctgagcatggcccacgcccccaaccaaccaacgacacacacacacacacacacacacacacacacacacagcatgtggtctgtgtgcagagcacacgcggttaaagccaacctaagcc

SEQ ID NO: 25617 - DNA, 469 bp, Homo sapiens
  chr22.fa.O7frz.45150325
  Located on chromosome 22
  Distance between a terminus base of telomere on chromosomal short arm and 5'-terminus of this base sequence : 45335881
  Distance between 3'-terminus of neighbour sequence of sequence listing upward to telomere on chrosomal short arm and 5'-terminus of this base sequence : 126655
tgacaactagtgaaaaggagtaagcattgaaccaaaaggctggatatggggaaacagagacaaaacaagactaagcggccacatcaagtcatccaaagtcagaaagcctggtcgaaaatgcaggaaggagacaaactgcatcactggaaggcaccttggaggttatccaggccaatcatatctatccatccatccatccatccatgcatccatccttccattcatccacccacccaccaatctatccatatccatccattcaaccacccatctatccattcattcatccttccacctatctatccatccacccatctatccatccacccatcaatccatcaatccatccatccaaccacattcatctatccttcatccatccatccattcatccatccatctgtttattcagaatgcaatttttgaggcccttcagtgtatgcagcagagttagcatgattgaggtttc

SEQ ID NO: 25618 - DNA, 308 bp, Homo sapiens
  Z82249.1_34738
  Located on chromosome 22
  Distance between a terminus base of telomere on chromosomal short arm and 5'-terminus of this base sequence : 45516934
  Distance between 3'-terminus of neighbour sequence of sequence listing upward to telomere on chrosomal short arm and 5'-terminus of this base sequence : 180584
gtggtaagtcgcaggtgaccagacacttgtgttaggaaaatccagagccccccacgccccaggaagcagccaacagagaatcgcctccatggtgtggatttagaaagcagagtttagagatttttcctgagaaattgtgtggaagcatggttatttgagatgttcatgaggtgaagaacattcatggacatgcacacacacacacacacacacacacacacacacacacacacgagagagagagagaaagggaaaccccctcctatccgacgttgcctcatgatgttgatgctacagtcataaaacct

SEQ ID NO: 25619 - DNA, 441 bp, Homo sapiens
  chr22.fa.O7frz.45436710
  Located on chromosome 22
  Distance between a terminus base of telomere on chromosomal short arm and 5'-terminus of this base sequence : 45622561
  Distance between 3'-terminus of neighbour sequence of sequence listing upward to telomere on chrosomal short arm and 5'-terminus of this base sequence : 105319
actaatgtgaggtgctttcatgctgcagaaggcacctgggtcctgacacccacactgggccatgaaaaacgttgtattttattattattattattattattatattattattattaattatttatttatttatttttgagatggagtttcgctcttgttgcccaggcgggagtgcagtggtgctattcggctcactgcatcctctgcctcccgggttcaagcaattctcccgcctcagcttcctgagtagctgggattacaggtgctcaacaccacgcctggataattttttgtgtttttagtagagatggggtttcaccgtgttggccagactggtcttgaactcctgacctcaggtgatccacccacctcggcctcccaaagttctgggattacaggtgtgagccaccacgcctggcctcacagttgtctttaaagtgg

SEQ ID NO: 25620 - DNA, 420 bp, Homo sapiens
  chr22.fa.O7frz.45519731
  Located on chromosome 22
  Distance between a terminus base of telomere on chromosomal short arm and 5'-terminus of this base sequence : 45705547
  Distance between 3'-terminus of neighbour sequence of sequence listing upward to telomere on chrosomal short arm and 5'-terminus of this base sequence : 82545
tggaatgttcttgaaacaatacagcttatcttcagcggggctcaccacccacgtgcaggggctcttctctcttccccacctccctctctctcgagctccctgctttgctctgtgtctgtctgtctgtctgtctgtctgtctgtctgtctgtctgtctctccctctctctctctctctctccatctctccatgctttgctctgtatctctctcttttccctctctctgcatctttcttggtgcaaattcctcctgaacggagccaagaagggaggcttctctagggagggattggtgggggcggctgggggtggcagtgggtcctggtgcttctgttgtcgtgaccatgtgagtgcgtttgtttaaatgacttgtggaaagttacatattaagtcatctttagttaaagtgaagatgagga

SEQ ID NO: 25621 - DNA, 121 bp, Homo sapiens
  D22S922
  Located on chromosome 22
  Distance between a terminus base of telomere on chromosomal short arm and 5'-terminus of this base sequence : 45846679
  Distance between 3'-terminus of neighbour sequence of sequence listing upward to telomere on chrosomal short arm and 5'-terminus of this base sequence : 140712
ttcctcagttttacctgtgctcatttgtgtgtgcgtgtgtgtgtgtgtgtgtgtgcgcgatgagttctatacaattttatcctctttgtaggttcatgtacccaacaccaccatcaagata

SEQ ID NO: 25622 - DNA, 465 bp, Homo sapiens
  chr22.fa.O7frz.45936031
  Located on chromosome 22
  Distance between a terminus base of telomere on chromosomal short arm and 5'-terminus of this base sequence : 46121552
  Distance between 3'-terminus of neighbour sequence of sequence listing upward to telomere on chrosomal short arm and 5'-terminus of this base sequence : 274752
agactgaaataacatggtattgaccttgctcagaaaggctaccaaaatagaatgttcaatactctctattttaactgacagttaaaaattcaatacaccttcctcctgccagacacctgtatgcaatcaagctaaataaatgccctcgggttcttgcaagaggcgtagctgtttgtgtataaagctatcggccctggctggaagggactgattttccacagtctagagaatggcccttttgaaaagtaaacaatgcctccacaatcccaggctattttgacaaaagcaagaagcgaagcagaagtgggagataaaggcacgctccgtctctcctcggacccaacacggactccacagacattgttccgtcacggaaatcaataccaaaaaataaaggtcagatacgtgtgtgtgtgtgtgtgtgtgtgtatgagctatagacacagaacgtgagtatccagagga

SEQ ID NO: 25623 - DNA, 251 bp, Homo sapiens
  chr22.fa.O7frz.46021388
  Located on chromosome 22
  Distance between a terminus base of telomere on chromosomal short arm and 5'-terminus of this base sequence : 46207245
  Distance between 3'-terminus of neighbour sequence of sequence listing upward to telomere on chrosomal short arm and 5'-terminus of this base sequence : 85228
tgttcttatgatagcgagtgagttctcacaaggtctggttgtttgaaagtgtgtagcacttcccccttgtctctctctctctctctctctctgtctctctctcctgtcaccatgtgaagatgtgcttgcttcccctttgccttctgccatgattgtaagtttcctgaggctccccagccatgctccctgtacagcctgtggaactgtgagttcattaaacctcttttctttataaattacctagcctcagg

SEQ ID NO: 25624 - DNA, 335 bp, Homo sapiens
  Z82202.1_86055
  Located on chromosome 22
  Distance between a terminus base of telomere on chromosomal short arm and 5'-terminus of this base sequence : 46339421
  Distance between 3'-terminus of neighbour sequence of sequence listing upward to telomere on chrosomal short arm and 5'-terminus of this base sequence : 131925
ccaatctcagactgagactcacaatgtctgcttttctgggtctccagcttgcagacagcagactacaggacttctcagcctctacaatcacatggaccaattccttagaataaatctctctgtgtatatatggaggatacacacacacacacacacacacacacacacacataaaggacctcctgctactgtgcatccacacagggttctcacagtcacaaagatgagcaaagctccctggacagccacagactgaaggcactaaatgaccattcgaaggacatctgagaacaaacagaagtaacccttcgtgactcaggtcagagttctggtaa

SEQ ID NO: 25625 - DNA, 406 bp, Homo sapiens
  Z82189.1_36548
  Located on chromosome 22
  Distance between a terminus base of telomere on chromosomal short arm and 5'-terminus of this base sequence : 46395161
  Distance between 3'-terminus of neighbour sequence of sequence listing upward to telomere on chrosomal short arm and 5'-terminus of this base sequence : 55405
caacatggtgaaactgtctctactaaagatacaaaaattagctgggcatggtggcgtgtgcctgtaatcccagctactcgggaggctgtcaggagaatcacataaactcgggaggtggttgcagtgagctgagatcacgccattgcacggaaggaaggaaggaaggaaggaaggaaggaaggaaggaaggaaggaaggaaggaaggggaaaaaaaagaaagaaagaaagagaaagaaaggaaaggaaagagagagaagggagggaagggagggaagggaaggaagggaggaaaaatgaaacactggtaaattagaaataaacagaacatagttaatatgcaaaacttactaaacaaaagctataagagagcaagacggtgcataatactagaaggtccgtgtcatg

SEQ ID NO: 25626 - DNA, 263 bp, Homo sapiens
  Z82189.1_85350
  Located on chromosome 22
  Distance between a terminus base of telomere on chromosomal short arm and 5'-terminus of this base sequence : 46443981
  Distance between 3'-terminus of neighbour sequence of sequence listing upward to telomere on chrosomal short arm and 5'-terminus of this base sequence : 48414
tttaaatgtctagtgaggtcgatcatattttaggtttatttgtcatttatacaactttatttaaattgtttgtgtcctttgcccactctttaaatgtgttagtcgcaggttcttctctttgatttgaaggacacacacacacacacacacacacacacacacacagacactcatgtaatataaattttgtttatttgaaggagatatagacataaacacacatctagatagatatagatatatgcttaagcctcaagaattag

SEQ ID NO: 25627 - DNA, 276 bp, Homo sapiens
  HUMUT580B
  Located on chromosome 22
  Distance between a terminus base of telomere on chromosomal short arm and 5'-terminus of this base sequence : 46528303
  Distance between 3'-terminus of neighbour sequence of sequence listing upward to telomere on chrosomal short arm and 5'-terminus of this base sequence : 84059
agagcaagactctgtctcaacaaaaaaagaaagaaaagaaagaaagacggaaagaagaaagaaagaatgaaagacagaaagaaagagaaagaaggaaggaaggaaggaaagaagaaagaagaaagaaagaaagagagaaagaaagaaagaaagaaagaaagaaagaaagaaagaaagaaagaaagaaagaaaggaaggtaggtaggttggtttaatggactcacagtcccacatggctggggagacctcacaatcatggcagaaagtgaaggagaa

SEQ ID NO: 25628 - DNA, 430 bp, Homo sapiens
  Z82189.1_176495
  Located on chromosome 22
  Distance between a terminus base of telomere on chromosomal short arm and 5'-terminus of this base sequence : 46535032
  Distance between 3'-terminus of neighbour sequence of sequence listing upward to telomere on chrosomal short arm and 5'-terminus of this base sequence : 6453
ttaagtccacatctccagtctaatttaattttcccaacagctctgggaagaaggtgctatcatttccatgattttgcatggaatcaaaaacacaaagaatgaaataacttgtgcacaaacccacagcttgtatgtcacagagactgagttcaaacccagatagcacccatgaccctcagagctgaacgttgagattaatgggtggatggatggaagcaaggaaagatggatggatggatggatggatggatggatggatggatggatggatgtgtggatggatgtgtgggtgggtaaatggatggatagatggatgtgtgggtgggtggatggatggatggatgcgcaggtggatggatggtggaaggatggaaggatgggtgagtaaatagatgtgtgggtgggcagatggataggtacatgagtgaat

SEQ ID NO: 25629 - DNA, 239 bp, Homo sapiens
  22_46459042
  Located on chromosome 22
  Distance between a terminus base of telomere on chromosomal short arm and 5'-terminus of this base sequence : 46645438
  Distance between 3'-terminus of neighbour sequence of sequence listing upward to telomere on chrosomal short arm and 5'-terminus of this base sequence : 109976
tccatcactttgattatggtgccactatcaccatcatcatcatcatcatcatcatcatttctatcataatcatcatcatagctcactgccatcaccatcaccaccaccatcaccattatctccaccatcaccgtcatctccactattattccatcatctctatcatcactatgattatcaccacagttgccaccatcatcatcaccatcaccattatctccactatcaccatcatttcc

SEQ ID NO: 25630 - DNA, 347 bp, Homo sapiens
  HUMUT1988
  Located on chromosome 22
  Distance between a terminus base of telomere on chromosomal short arm and 5'-terminus of this base sequence : 46758072
  Distance between 3'-terminus of neighbour sequence of sequence listing upward to telomere on chrosomal short arm and 5'-terminus of this base sequence : 112395
gcactccagccttggctacagactaagaccctgtcaaaaaaaaaaagaaagaaggaaggaaaggaaggaaggaaagaaaggagggagggagggagggagggaaagaaaaagaaagaaagaaagaaagaaagaaagaaagaaagaaagaaagaaagaaagaaagaaagaaagaaaagaaagaaaagaaagagaaagaaaggaggaaaggaaagaaaggaagaaagaaaaagaaagagaaacaggagatgaaaattcttgccagggagtgtggctaaaacctacccagtctaacagtaaatcatgatgcccaaggggagggtgcaccgtggggagcaagctggagaaat

SEQ ID NO: 25631 - DNA, 318 bp, Homo sapiens
  Z98885.1_73823
  Located on chromosome 22
  Distance between a terminus base of telomere on chromosomal short arm and 5'-terminus of this base sequence : 46915364
  Distance between 3'-terminus of neighbour sequence of sequence listing upward to telomere on chrosomal short arm and 5'-terminus of this base sequence : 156945
aatcttaaatatcaaaggacggtaaaatggacaaagtgaggtgtatccacgcaatggaatagcacacagcaacagaaatgaatgaattccaccaccaacacggccaaatctcaaacacataattttaaatggaagaaagaaatctcaaaagattacagaatatgattccatttacactcagcagacagagctaggaaataagtatgtacaaacacacacacacacacacacacacacacacacacacacacacacacacccatatcttttctgatacctcttagcaaaccttgagttcatactgatacctgtacctcc

SEQ ID NO: 25632 - DNA, 405 bp, Homo sapiens
  chr22.fa.O7frz.46952128
  Located on chromosome 22
  Distance between a terminus base of telomere on chromosomal short arm and 5'-terminus of this base sequence : 47137707
  Distance between 3'-terminus of neighbour sequence of sequence listing upward to telomere on chrosomal short arm and 5'-terminus of this base sequence : 222025
tttctgtttataacaatggcatgtgttaagtcaaaattccaaccaggctgggtgcagtggctcacgcctgtaatcccaacactttgggaggccaaggcaggcagatcacctgaggccaggagttcaagaccagcctgaccaacatggtgaaactcgtctctactaaaaatacaaaaattagccgggcgtggtggcgggcgcctgtaatcccaactactccggaggctgaggcaggagaatcacttgaacccaggaggcagaggttgcagtgagccgagattgcaccattgtaccccagcctgggcaacagagtgagactccatctgaaaacacccccccaaaaaagtgtgtgtgtgtgtgtgtgtgtgtgtgtgtaaataatagcatactaatcactaaccactg

SEQ ID NO: 25633 - DNA, 318 bp, Homo sapiens
  AL096767.14_25055
  Located on chromosome 22
  Distance between a terminus base of telomere on chromosomal short arm and 5'-terminus of this base sequence : 47491967
  Distance between 3'-terminus of neighbour sequence of sequence listing upward to telomere on chrosomal short arm and 5'-terminus of this base sequence : 353855
ggcaggagaatcacttaaactcagggggcggaagttgcagtgagccgagatcacaccactgccctccagcctgggcggcaaagtgagattctgtctcaaaacacacaaacacacacacacacacacacacacacacacaccccaaaatgggacagaaaaactgctgaaaaacaaagagaaaagtcccaaaacctgccagaagaaaaaaagacatgctctctttgaaagagcaacaataaaactgacggctgacttcaaaagagaaacacgaggccaactgtcaacttccagccatgacagataattagtctgaacagc

SEQ ID NO: 25634 - DNA, 119 bp, Homo sapiens
  DISO7_10008890
  Located on chromosome 22
  Distance between a terminus base of telomere on chromosomal short arm and 5'-terminus of this base sequence : 47823818
  Distance between 3'-terminus of neighbour sequence of sequence listing upward to telomere on chrosomal short arm and 5'-terminus of this base sequence : 331533
gagctgcagtatgtgattgtgtggtggggaagagagagagagagagagagagacagagaattcaaattcatggagatggcctaaaaaccagcaaagcccccagagaattattcacagct

SEQ ID NO: 25635 - DNA, 191 bp, Homo sapiens
  Z66869
  Located on chromosome X
  Distance between a terminus base of telomere on chromosomal short arm and 5'-terminus of this base sequence : 5122
  Distance between 3'-terminus of neighbour sequence of sequence listing upward to telomere on chrosomal short arm and 5'-terminus of this base sequence : 0
ccaaccctccatgatactgaaaagcaagtatatcagaaaagactgtgttctacaaattatgtttttaattgcactgtgtgtgtgtgtgtgtgtgtgtgtgttttaaaataacaaaactgctaaactccatgggaattactcaaaatgaatatcagggaaaggtttccttcgttacttaaacagatgccttt

SEQ ID NO: 25636 - DNA, 295 bp, Homo sapiens
  UT708
  Located on chromosome X
  Distance between a terminus base of telomere on chromosomal short arm and 5'-terminus of this base sequence : 60617
  Distance between 3'-terminus of neighbour sequence of sequence listing upward to telomere on chrosomal short arm and 5'-terminus of this base sequence : 55304
tgctagctgcttctttctccctgaaactctcggatggaaggaagtaagaaattcagcttgggctgtgaccagttctcaccaccaacgccctcttctctctcccttctccttccttccttccttccttcctttctttctttttctttctttctctctttctttcttttctttctttctgtttctttcctttttatctttctctctttttctttctcttttccttttttgtttctttctttctttttctttctttctttttctttcttctttctttcttcgatgaagtctcactctg

SEQ ID NO: 25637 - DNA, 255 bp, Homo sapiens
  HUMUT6069
  Located on chromosome X
  Distance between a terminus base of telomere on chromosomal short arm and 5'-terminus of this base sequence : 159416
  Distance between 3'-terminus of neighbour sequence of sequence listing upward to telomere on chrosomal short arm and 5'-terminus of this base sequence : 98504
atcgcagctactcaggaggctgaggcaggagaatcgctggaacgcgggaggtggaggttgcggtgagccgagattgtgccattgcactccagcctgggcaacaagagcgaaactccgtctcaaaataaatacataatagacagatagatgatagatacatagatagatagatagatagatagatagatagatagatagatagatagatacattccaggtcccctcagttggcacgcctgacttcttaggttggat

SEQ ID NO: 25638 - DNA, 245 bp, Homo sapiens
  G08101
  Located on chromosome X
  Distance between a terminus base of telomere on chromosomal short arm and 5'-terminus of this base sequence : 159523
  Distance between 3'-terminus of neighbour sequence of sequence listing upward to telomere on chrosomal short arm and 5'-terminus of this base sequence : -148
cgaaactccgtctcaaaataaatacataatagacagatagatgatagatacatagatagatagatagatagatagatagatagatagatagatagatagatacattccaggtcccctcagttggcacgcctgacttcttaggttggataatttcttaggataagaaatccgagcctaatttcttaggataagaaatctgtcttaggataagaaatatgaggacagacagaggaaacccaaacaca

SEQ ID NO: 25639 - DNA, 139 bp, Homo sapiens
  DISD22_0006773
  Located on chromosome X
  Distance between a terminus base of telomere on chromosomal short arm and 5'-terminus of this base sequence : 532420
  Distance between 3'-terminus of neighbour sequence of sequence listing upward to telomere on chrosomal short arm and 5'-terminus of this base sequence : 372652
gctggtcatcttcactttactctcccaaatttgaggactgtgacacacacacacacacacacacacacacacacacactctctctctctctctctctctctctctgtctctcttaggaaacaatggtatatcaacaatg

SEQ ID NO: 25640 - DNA, 202 bp, Homo sapiens
  "DXYS228X,DXYS228Y"
  Located on chromosome X
  Distance between a terminus base of telomere on chromosomal short arm and 5'-terminus of this base sequence : 756959
  Distance between 3'-terminus of neighbour sequence of sequence listing upward to telomere on chrosomal short arm and 5'-terminus of this base sequence : 224400
acgtgggagcaatagttcactattcgctaattcagtgttcgctgagactttataaaacgtaactgctttgaataacaaagctgtaattaacaaaccgagctgttaagtgtgtgtgtgtgtgtgtgtgtgtgtgtgtgtgtgtgtgtgtgtgttggcctcacatcattttacagagacacacagggctctgtgaactgctaat

SEQ ID NO: 25641 - DNA, 102 bp, Homo sapiens
  DISD22_0006786
  Located on chromosome X
  Distance between a terminus base of telomere on chromosomal short arm and 5'-terminus of this base sequence : 985067
  Distance between 3'-terminus of neighbour sequence of sequence listing upward to telomere on chrosomal short arm and 5'-terminus of this base sequence : 227906
gactcatctgaatgccaaacaaaatgtgtgtgtgtgtgtgtgtgtgtgtgttgttacacacttgcattttcatctgttttttcacatgacccttaagaaggc

SEQ ID NO: 25642 - DNA, 192 bp, Homo sapiens
  AC005295.1_122246
  Located on chromosome X
  Distance between a terminus base of telomere on chromosomal short arm and 5'-terminus of this base sequence : 1103768
  Distance between 3'-terminus of neighbour sequence of sequence listing upward to telomere on chrosomal short arm and 5'-terminus of this base sequence : 118599
accactaaacggttagaacgtgggcttcaccaaatgccccaaggtagttagtctttaaggatattacatttgagagccatattggagggttgaagttgagaagatggcctggggaattggctaatttacacacacacacacacacacacacacacacacacacacacagactcctgagaatcagtccttatt

SEQ ID NO: 25643 - DNA, 126 bp, Homo sapiens
  DISO7_10004561
  Located on chromosome X
  Distance between a terminus base of telomere on chromosomal short arm and 5'-terminus of this base sequence : 1281501
  Distance between 3'-terminus of neighbour sequence of sequence listing upward to telomere on chrosomal short arm and 5'-terminus of this base sequence : 177541
tgttggaggcagaaacacaatattttattattttttaattatggatacataaatataaacctctttcttctctctctctctctctctctctctctcgtctctctctgtttcatagccgcaattaca

SEQ ID NO: 25644 - DNA, 196 bp, Homo sapiens
  "DXYS229X,DXYS229Y"
  Located on chromosome X
  Distance between a terminus base of telomere on chromosomal short arm and 5'-terminus of this base sequence : 1363387
  Distance between 3'-terminus of neighbour sequence of sequence listing upward to telomere on chrosomal short arm and 5'-terminus of this base sequence : 81760
tgtggctgttgtaacaaattactataatctgggtggattgtggaataatcccaaatgccatcaatcaacaggttggtaaaggaactatgatatatatgtacacacacacacacacacacacacacacacacacacaccatggaatactactcagccataaaaatgaataaattaatggcatttgcagcaacctagg

SEQ ID NO: 25645 - DNA, 489 bp, Homo sapiens
  HUMUT5198B
  Located on chromosome X
  Distance between a terminus base of telomere on chromosomal short arm and 5'-terminus of this base sequence : 1384879
  Distance between 3'-terminus of neighbour sequence of sequence listing upward to telomere on chrosomal short arm and 5'-terminus of this base sequence : 21296
tgaaaccgtctctaagacagaaagaaagaaaaaaagaaagaaagaagaaaggagggagaaagaaagaagaaaggagggagaaagaaagaaagaggaaggaaggaaagaaagaaagagagagaaagaaagaaagaaagaaagaaagaaagaaagaaagaaagaaagaaaagaaagaaagaaagaaagaaagaaagagaaagaaggaaagaaaaggaaggaaggaggaaggagagtgagagggagggaaggaagggaagggaaggaaggaaggaaggaaggaaggaaggaaggaaggaaggaaagaaggaaagaaggaagggaggaaaggaaggaaaggaacgaaggaaggaaagaaggaaggagaaagggagggaggaaaggaaagaaaggaaggaaaggaaggaaggaaggaagcaaagagggggaagggagaagcccatcatggtttgtttacaagcgctttgcttttctacctgccctgtctgtctt

SEQ ID NO: 25646 - DNA, 271 bp, Homo sapiens
  chrX.fa.O7frz.1043506
  Located on chromosome X
  Distance between a terminus base of telomere on chromosomal short arm and 5'-terminus of this base sequence : 1486712
  Distance between 3'-terminus of neighbour sequence of sequence listing upward to telomere on chrosomal short arm and 5'-terminus of this base sequence : 101344
ttcaacaagtttatctgaccatatgtggaatttgcatctcctctgcacctctattattttgctttattctttctttctttctttctttcttcttttctttttttttttttttttttttgagtcagaatctcactctgtcatccaggctagattgaggtgatgtgatctcagctcactgcaaacttgaacttctgggttcaagccatccttccacctcagctaaaaataattctcacaccaaagtggcatatttggagatgacatagtctga

SEQ ID NO: 25647 - DNA, 191 bp, Homo sapiens
  "DXYS232X,DXYS232Y"
  Located on chromosome X
  Distance between a terminus base of telomere on chromosomal short arm and 5'-terminus of this base sequence : 1532235
  Distance between 3'-terminus of neighbour sequence of sequence listing upward to telomere on chrosomal short arm and 5'-terminus of this base sequence : 45252
cctttttatggctgagtagtattccatggtgtgtgtgtgtgtgtgtgtgtgtgtgtgtgtatgaatatgaaaatttgatatggatagatacctgcagatctatacagataaagaagatgtgttatatataggtatctacagatctatagatatcaagagtgtctcgctccaagcaccaagcactgctgctg

SEQ ID NO: 25648 - DNA, 368 bp, Homo sapiens
  chrX.fa.O7frz.3603221
  Located on chromosome X
  Distance between a terminus base of telomere on chromosomal short arm and 5'-terminus of this base sequence : 1701553
  Distance between 3'-terminus of neighbour sequence of sequence listing upward to telomere on chrosomal short arm and 5'-terminus of this base sequence : 169127
cagtagcacgtgcctataatcccagctactctggaggatgagacaagagaattgcttgaatcagggaggcagaggctgcagtaagccgagactgcaccactgcactccagcctgggtgatagagtgagactccacctcaaaaaaaagaaagaaggaaggaaagaaagaagaaaagaaagaaagaaagaaagaaaaagaaagaaagaaagaaagaggaagaaaaagaacaatggtttctgagtgacgtccactccactaaacctcctttttaacaaatcctgtcaacagagaaaaactattgctcatccaaagagggataaggactcctggaggagagataattgctatttctgaaacagacttaatgc

SEQ ID NO: 25649 - DNA, 477 bp, Homo sapiens
  chrX.fa.O7frz.3491094
  Located on chromosome X
  Distance between a terminus base of telomere on chromosomal short arm and 5'-terminus of this base sequence : 1813570
  Distance between 3'-terminus of neighbour sequence of sequence listing upward to telomere on chrosomal short arm and 5'-terminus of this base sequence : 111649
ctcaaactgagtccattaacatttggagctggatgattctctgtggtggggccatcctgtgcactgtaaggtggcaagcagtgaccctggactccacccacctgttatcagtagcacctccctgagctgtgacaacaaaaatgtctccagacttgtccagggaagaagtatctccctgatggagctgaattgccattggcagagaatctctgccacagacagatagaaagataggtagatgggtatgatagacagatagatggatagatagaaagatgattgattgattgaatgactgactggatggatggatggatggatggacaatgggtatgatacatacatggaaagagaaagatgatacactgattaattgattggatggatggatggatgggtaggtgggtaggtagataggtaacagataggatagataggtgatacatagataattaggatggttagataattgatagg

SEQ ID NO: 25650 - DNA, 348 bp, Homo sapiens
  chrX.fa.O7frz.3260902
  Located on chromosome X
  Distance between a terminus base of telomere on chromosomal short arm and 5'-terminus of this base sequence : 2086187
  Distance between 3'-terminus of neighbour sequence of sequence listing upward to telomere on chrosomal short arm and 5'-terminus of this base sequence : 272140
catctgaagtcatactggtgagtgttatcttcaccctagtcattcttgcttcttcacccatcttcgtatgtcaaacacacacacacacacacacacacacacacacacacacactctcacacaccctatagacattaaattaaatgccccaactctctaccccttaagcattctgttaccatctattcaccaacattttgttccctcacaggatgactctaatatgaagggatgatggagaatcttgacagaccatggtggaggtgaccagaggtagccacagatgcagaggtagtgtgagagtagggcaataataagactgtggggtattagcaatgctgtagtcca

SEQ ID NO: 25651 - DNA, 418 bp, Homo sapiens
  chrX.fa.O7frz.3011853
  Located on chromosome X
  Distance between a terminus base of telomere on chromosomal short arm and 5'-terminus of this base sequence : 2207130
  Distance between 3'-terminus of neighbour sequence of sequence listing upward to telomere on chrosomal short arm and 5'-terminus of this base sequence : 120595
gttcattacttaatgctttctgagtattctagtaaaacatcttccttcctttctttctttctctttgttttctttttctttctttctttcttttttctttctttctttctttttctttctttctttttctttctttctctatttctttctttctctctttctttctttcttctttctttctttctttctttctttctttctttctttctttctttcttcctctctctctctctcccttccttccttccttccttccttccttccttccttccttccttcctttctttctttctttctttctttctttctttctttctttctttctttctttctttctttctttctttctttctttctttctttctttctttcctttctctgttgcccaggctggagtgtagtggtgcaatcatagctc

SEQ ID NO: 25652 - DNA, 278 bp, Homo sapiens
  DXS8095
  Located on chromosome X
  Distance between a terminus base of telomere on chromosomal short arm and 5'-terminus of this base sequence : 2234481
  Distance between 3'-terminus of neighbour sequence of sequence listing upward to telomere on chrosomal short arm and 5'-terminus of this base sequence : 26933
gattgggagatgcagactccagtgtaaaacaaaatgagccccggaggacaaagagggggcctggcttaaatcgggaaggttcctgtcccagtcctcaattagacctgtatgtcattacacacacacacacacacacacacacacacacacacacacacacacacacacacacagagagatggatagatagatagatagaatatatatatatatatatatgcacacacacacacatgtatatatatgcttttattttaagtttttaagttcggggtaca

SEQ ID NO: 25653 - DNA, 275 bp, Homo sapiens
  chrX.fa.O7frz.2342355
  Located on chromosome X
  Distance between a terminus base of telomere on chromosomal short arm and 5'-terminus of this base sequence : 2569107
  Distance between 3'-terminus of neighbour sequence of sequence listing upward to telomere on chrosomal short arm and 5'-terminus of this base sequence : 334348
ccattaattgaatttagaagtcagacaaaaataataaatataccatcctttgatttttaccagtgtataaatataatgtcaatgcaataaaataatatgcatcagcagaaataaaatgggcacatgagagaaacttgcacacacacacacacacacacacacacacacaagctaagtggttaaaacattttgatccaaacccactccttctttagacaatttttcttttgctatgacatttccaatccgtggactgtaatgaatttctggacaga

SEQ ID NO: 25654 - DNA, 371 bp, Homo sapiens
  chrX.fa.O7frz.2416449
  Located on chromosome X
  Distance between a terminus base of telomere on chromosomal short arm and 5'-terminus of this base sequence : 2639067
  Distance between 3'-terminus of neighbour sequence of sequence listing upward to telomere on chrosomal short arm and 5'-terminus of this base sequence : 69685
gattcacttccacttaatgaatagtagatatattatcctccttatgattttcttaataactttcttttctctagcttactttattctaagaacacagtatatgatacgtataacataaaaaatatgtgttgattgaatgtttatgttatcagtaaggagttcattcaatagtaggctattagtacttaagttttcaaagagtaaaacgtatatatgcattttcaactacagaactacagaggaaggtggcactcctaaccctggagttgttcagggattaactctgtgcgtgtgtgtgtgtgtgtgtgtgtgtgtgtgtctatcttccttcaaactcttaaatagtagtttccttgaaacttagtatttga

SEQ ID NO: 25655 - DNA, 471 bp, Homo sapiens
  chrX.fa.O7frz.2762744
  Located on chromosome X
  Distance between a terminus base of telomere on chromosomal short arm and 5'-terminus of this base sequence : 2758525
  Distance between 3'-terminus of neighbour sequence of sequence listing upward to telomere on chrosomal short arm and 5'-terminus of this base sequence : 119087
tctgtaatagtaaacgattggaagtaatccaagtgcagggtggcacaacaaaattataccagttatatttactttaaaacctgctaaatagtgctattgattactaccagatacatgcataagtaacagtatttaaaaaaaattctgtgttcaagatgaacaacaaaattacagtaagctgtacttttaaaaataaaaacaaagcagaattggatcagatgattgtttacagagaactttacctttttacacacacacacacacacacacacacacacacacaatcaacaaggggaaaataaaaaggattgagaaggaaagaaaagcaagacagtctgactaagaaatgaataaatataatcttgggtgatggtcatacaccttggcaggtttcctatgtctggtttgaaagcaaagccaattcagagtgcatgactttactatgatatagtccaatgtagaacagaggta

SEQ ID NO: 25656 - DNA, 404 bp, Homo sapiens
  chrX.fa.O7frz.2149171
  Located on chromosome X
  Distance between a terminus base of telomere on chromosomal short arm and 5'-terminus of this base sequence : 2878099
  Distance between 3'-terminus of neighbour sequence of sequence listing upward to telomere on chrosomal short arm and 5'-terminus of this base sequence : 119103
gtggttgcatgatttagtttatcaagtgcttagcttattatgaatattattccaggtattgttggaaaaatgaaaaccataagctactttcctttcttataaatatttgctatatatttaggaataaggtagcaatttttttctttaaagagccagagagtaaatagtttagaaatttcaatagatgtaatgccctcaacttggcaagctattgttctctctgaaggactagctggtagttttgtttgttttgtttgttttacattttacatgttaaaatgtccaaaccactcttagctcacagccaaatttgtctctccggctgttaataactgctatacaaagaggaagaatgcatacacacaagaaaattagaataaagctgaaagtgcttaccagaaata

SEQ ID NO: 25657 - DNA, 430 bp, Homo sapiens
  chrX.fa.O7frz.2074553
  Located on chromosome X
  Distance between a terminus base of telomere on chromosomal short arm and 5'-terminus of this base sequence : 2960293
  Distance between 3'-terminus of neighbour sequence of sequence listing upward to telomere on chrosomal short arm and 5'-terminus of this base sequence : 81790
acatcagaatttattcagtgctactgttaattatactacagacttttttcagacttcaccagtttttatatgcactgtgtgtgtgtgtgtgtgtgtgtgtgtgtgtgtgtgtgcatgtaaggaaaaatcaacatttgattttaattttctttaatgattcaatattctgtttcaatgatttactatttgtttttttcaattcctccttatattccattaaatttctcgtttgttagctttttaaacgtgaaaacttagttgaatttatgtttgtttattcatataaggatctaaagaattagatattttctttaatttctgctttgcttgcatatgacaaattgtgatatattttgttttcattttcttccaactcaaaatatttttccaactttcccgaagatagcttctgtgatcaatggtaattaag

SEQ ID NO: 25658 - DNA, 153 bp, Homo sapiens
  DISD22_0006814
  Located on chromosome X
  Distance between a terminus base of telomere on chromosomal short arm and 5'-terminus of this base sequence : 3033230
  Distance between 3'-terminus of neighbour sequence of sequence listing upward to telomere on chrosomal short arm and 5'-terminus of this base sequence : 72507
gatataataagcaaattgcaatgggaaggggagaagggaaaatacatatgtgtgtgtatatatatgtatgtatatatgtgtatacacacacacacacacacacacacacacacacacacacatatatatttacacttaccagaccatggagga

SEQ ID NO: 25659 - DNA, 103 bp, Homo sapiens
  DISD22_0006817
  Located on chromosome X
  Distance between a terminus base of telomere on chromosomal short arm and 5'-terminus of this base sequence : 3103903
  Distance between 3'-terminus of neighbour sequence of sequence listing upward to telomere on chrosomal short arm and 5'-terminus of this base sequence : 70520
taccagctgaagtatctcatagccatatatatatatatatatatatatatatatatatatatatatatatatatatatcagcacagcagtggtgactgcagaa

SEQ ID NO: 25660 - DNA, 300 bp, Homo sapiens
  chrX.fa.O7frz.5325566
  Located on chromosome X
  Distance between a terminus base of telomere on chromosomal short arm and 5'-terminus of this base sequence : 3361852
  Distance between 3'-terminus of neighbour sequence of sequence listing upward to telomere on chrosomal short arm and 5'-terminus of this base sequence : 257846
ctttatggctgaatactattcaactgtatagatataccacatttgtttatccattaatctgttgatatacattttgtttgtttccaagtgtgattattgttaagagccctgctattaacattcatttacatgtctttggatacctgtttttaatcttttggggcatggatggatagatagatatagatagatagatagatacacacatatacacacacatacacacacacacacacacacacatatatgtatataaaatatgcctaggagtgtaattgctggttcatatggtaccataga

SEQ ID NO: 25661 - DNA, 169 bp, Homo sapiens
  DISO7_10004577
  Located on chromosome X
  Distance between a terminus base of telomere on chromosomal short arm and 5'-terminus of this base sequence : 3485310
  Distance between 3'-terminus of neighbour sequence of sequence listing upward to telomere on chrosomal short arm and 5'-terminus of this base sequence : 123158
cccatattccttgttcattatatgttgagtaactttggattttgtcctgaatattggaaattttattttgtgttcctgggggccctattcatttatgtgacttgtgtgtgtgtgtgtgtgtgtgtgtgtgtgtgtgtgtgtgtgtatgtgctttgccagacaattgctt

SEQ ID NO: 25662 - DNA, 313 bp, Homo sapiens
  chrX.fa.O7frz.5069494
  Located on chromosome X
  Distance between a terminus base of telomere on chromosomal short arm and 5'-terminus of this base sequence : 3545219
  Distance between 3'-terminus of neighbour sequence of sequence listing upward to telomere on chrosomal short arm and 5'-terminus of this base sequence : 59740
tctaactcctatgccatcaagaagaaggaagagctgcagcatgtggccaagcccaaccactgattttcccggctgctgaccaataaacctgtctgcccttcagggcagccaaaaaaaaaataataaaagaaagaaagagagaaaggaagaaagaaagaaagaaagaaagaaagaaagaaagaaagaaagaaagaaagaaagaaagaaagaaggaaagaaaaacgaactacaaaaataaaataaaatcaagtctttaactgcaatatggatgaagctgggagccattgtcctaagtccattaactcagaaacag

SEQ ID NO: 25663 - DNA, 382 bp, Homo sapiens
  chrX.fa.O7frz.4865967
  Located on chromosome X
  Distance between a terminus base of telomere on chromosomal short arm and 5'-terminus of this base sequence : 3735971
  Distance between 3'-terminus of neighbour sequence of sequence listing upward to telomere on chrosomal short arm and 5'-terminus of this base sequence : 190439
tcaggagttcaacaccaacctggccaagatggcgaaacccagtctctactaagaatacaaaaaattagctgggcgtggtggtgggcgcctgtaatctcagctacttggaaggctgaggcagagaattgcttgaacctgggaggcgaaggttgcagtgagccgagatggcgccaatgcactccagcctgggcgacagagtgagactctgtctcaaaaaatagataaataaataaataaataaataaataaataaataaataaataaaataagcagccattgatccattcatgaggttggaggcctcaggaccctcaggcatctctccctaagccccacctctgagcactattgcattggagaataggtttccaatacatggac

SEQ ID NO: 25664 - DNA, 236 bp, Homo sapiens
  "DXYS231X,DXYS231Y"
  Located on chromosome X
  Distance between a terminus base of telomere on chromosomal short arm and 5'-terminus of this base sequence : 3753209
  Distance between 3'-terminus of neighbour sequence of sequence listing upward to telomere on chrosomal short arm and 5'-terminus of this base sequence : 16856
gcacatcggatatacaagactacaaaggaatctttgtttcaagttggccaattcaaagaaaataaaaatcatttacagattatatttttattcaaattggaattgtgtttcataacactaagaaaaagtaatttctgtctcccttcctccctctttctctctctctctctctctctctctcgtgcacacacacacacacacacacacacacacacacacacacccatcccacaacc

SEQ ID NO: 25665 - DNA, 445 bp, Homo sapiens
  chrX.fa.O7frz.4553832
  Located on chromosome X
  Distance between a terminus base of telomere on chromosomal short arm and 5'-terminus of this base sequence : 3869072
  Distance between 3'-terminus of neighbour sequence of sequence listing upward to telomere on chrosomal short arm and 5'-terminus of this base sequence : 115627
gtcactcaagtatttggaagatagagtaattattactgcccacgaaggcttttgctactcttttgaacttagccaattcaccataatgaagaggttctttattctgttcagttaaacactaaaggaggctgggcgcagtggctcatgcctgtaattccagcactctgagaggccaaggcaagaggactgcttgaacgctgaagtttgagaccagtctaggaacataatgagaacctgtttctattaaaaataaataaataaataaataaataaataacaaaatcacacaggtgtgtgcctgtagtcccagctgctcaggaggctgaggtgggaggactgcttgagtccagggattgcaggctgcagtgagctataattgtggcactgcactccagtttaggtgagtgagaccttgtcaacataagcataacttaagcatatgtca

SEQ ID NO: 25666 - DNA, 371 bp, Homo sapiens
  chrX.fa.O7frz.4668355
  Located on chromosome X
  Distance between a terminus base of telomere on chromosomal short arm and 5'-terminus of this base sequence : 3884815
  Distance between 3'-terminus of neighbour sequence of sequence listing upward to telomere on chrosomal short arm and 5'-terminus of this base sequence : 15298
tgcctgtttgaaagtaaactcatccacccatccatccaaaggttgcattttctcaattcccaattctaaatatgtctgtgtgtgtgtgtgtgtatgtgtgtgtgagagagagagagagagaatctagtgcaattttattgttctactttgttccaggcttgacattttagtgattgaaactaaaataccttgattcttaccctctaattttacaaataaaatctggtttactgttatggattgaactgtgttacagattgaattgtgttccccaaaaagatatattgaaatcctaatgcccagcacctcagaatgtgatcttattttgaaataaggtctttgcagatgtaattacaatgaggtgattaagg

SEQ ID NO: 25667 - DNA, 163 bp, Homo sapiens
  DXS996
  Located on chromosome X
  Distance between a terminus base of telomere on chromosomal short arm and 5'-terminus of this base sequence : 4089358
  Distance between 3'-terminus of neighbour sequence of sequence listing upward to telomere on chrosomal short arm and 5'-terminus of this base sequence : 204172
aaattcttgcttaggccactctaggacttttaattgctatttcttaggaaatattccttagaacatgaagcagtctgtctttcaacacacacacacacacacacacacacacacacacacacacacacacacacaccccctagcatacgatccagaacaacgt

SEQ ID NO: 25668 - DNA, 158 bp, Homo sapiens
  DXS8105
  Located on chromosome X
  Distance between a terminus base of telomere on chromosomal short arm and 5'-terminus of this base sequence : 4198661
  Distance between 3'-terminus of neighbour sequence of sequence listing upward to telomere on chrosomal short arm and 5'-terminus of this base sequence : 109140
tttagtttcctgccacggaataaatcagagtgaattttctctctctctctgtctcactctctctctctctcacacacacacacacacacacacacacacacacacacactttactattttagatctgttaaaaacctcaatatgaaaaacatggaata

SEQ ID NO: 25669 - DNA, 461 bp, Homo sapiens
  chrX.fa.O7frz.4336203
  Located on chromosome X
  Distance between a terminus base of telomere on chromosomal short arm and 5'-terminus of this base sequence : 4296489
  Distance between 3'-terminus of neighbour sequence of sequence listing upward to telomere on chrosomal short arm and 5'-terminus of this base sequence : 97670
  misc_feature (1)...(461): n = A,T,G or C
agttattggagcaagaaactaatcaacattattataaattcagataatcgttggtgggggggtgtctgtgaatacactttacagtaagaaagctccttattggaatgttgggacacacttttgttcatacatgtgtaggtgaaggtaataatgagtagcttcttgtagaaccaaatgaggaaaagtgaatttcatatattttgtctcagtctntctctntctctctctctctctctctctctctgcgtgtgtgtgtgtgtgtgtgtgtgtgtgtgtgagagagagagagagagacagagaaggacagagacaaagagacagagagagagacagaaacagtctgtttttgtctctactgaatgcatagaaaatgtatacaaattgtcatttgagctttaaattccatgaaacatgtatttaattaaaaaatgagaatggtgtgagtcatctaatgtttccag

SEQ ID NO: 25670 - DNA, 146 bp, Homo sapiens
  DXS1060
  Located on chromosome X
  Distance between a terminus base of telomere on chromosomal short arm and 5'-terminus of this base sequence : 4538830
  Distance between 3'-terminus of neighbour sequence of sequence listing upward to telomere on chrosomal short arm and 5'-terminus of this base sequence : 241880
aaaattaaaacatctactaggcagactacactccctcttaatgttgcctgtacatcatacacacacacacacacacacacacacacacacacacacacacacacacacattttatctcccaccaaagactctcaccgttcgcagta

SEQ ID NO: 25671 - DNA, 477 bp, Homo sapiens
  chrX.fa.O7frz.4015419
  Located on chromosome X
  Distance between a terminus base of telomere on chromosomal short arm and 5'-terminus of this base sequence : 4772309
  Distance between 3'-terminus of neighbour sequence of sequence listing upward to telomere on chrosomal short arm and 5'-terminus of this base sequence : 233333
gtatcagccactaattgtcaacttaaattatagtttcttatctttaaaaacactgcgtatcaaaatcgtttttgcattaaaacaacttttaaaaataaaaatgtcatattgaacaagagctatttgcaaattaattgaactcactaacaattgttattccatggagaaggagaactatttattagctaaggcaggccaccctgcttttcccagaactgatggtcattctttgaaatcattaatttggggttaataattatgtcccaaaaatgtatcatgcaattttaagagtataattcaaattaaaagaaaagaaactacacacacacacacacacacacacacacacacacacacacacacacatttctgcttggcaatggatggaataacattatgccaatgatgaattgacttacaggtattgccaatttttcaaatagatcacacatttaaccatttgctaagttatagtcc

SEQ ID NO: 25672 - DNA, 124 bp, Homo sapiens
  DISO7_10004569
  Located on chromosome X
  Distance between a terminus base of telomere on chromosomal short arm and 5'-terminus of this base sequence : 4815940
  Distance between 3'-terminus of neighbour sequence of sequence listing upward to telomere on chrosomal short arm and 5'-terminus of this base sequence : 43154
ggtttaattagatgagtggaaccattataagacacacacacacacacacacacacacacacacacacgtgtctatatatatatatacctgtatctatatctatcttcatttatctctgcatctg

SEQ ID NO: 25673 - DNA, 288 bp, Homo sapiens
  chr4.fa.O7frz.40293423
  Located on chromosome X
  Distance between a terminus base of telomere on chromosomal short arm and 5'-terminus of this base sequence : 4888958
  Distance between 3'-terminus of neighbour sequence of sequence listing upward to telomere on chrosomal short arm and 5'-terminus of this base sequence : 72894
  misc_feature (1)...(288): n = A,T,G or C
aattactggattcaactggatcatattgtgctatatatctcttcaaatacttttgatggctacagctctgtataatatgtattatattatattgtattgtatcgtgccatnatattatattatattatattatatatacttattatattatattatattatacaattaaatcagcaatcccattacagggtatatatccaaaggaatataatttgttctatcataaagacacatgcacacatatgttaatcacagcactatttgcagtaacaaagacatggaatcaac

SEQ ID NO: 25674 - DNA, 280 bp, Homo sapiens
  chrX.fa.O7frz.5664826
  Located on chromosome X
  Distance between a terminus base of telomere on chromosomal short arm and 5'-terminus of this base sequence : 5241513
  Distance between 3'-terminus of neighbour sequence of sequence listing upward to telomere on chrosomal short arm and 5'-terminus of this base sequence : 352267
aggacttcaaagttgtgagttcggcacccttacgtgtcaacaaagattaagcctgaagtggcaggctttcacacagggttggggggattcaggttttgatgcagggttagggggaattcggaggctgattggagaatgactagggatccagagctgctccctttgtatcagagatgcacatactacacacacacacacacacacacaaaaggaggaggaggacaaaacatggtgggcatatggctaaatttccagacccttcctaggctaattatccaac

SEQ ID NO: 25675 - DNA, 383 bp, Homo sapiens
  AC005704.1_24186
  Located on chromosome X
  Distance between a terminus base of telomere on chromosomal short arm and 5'-terminus of this base sequence : 5351612
  Distance between 3'-terminus of neighbour sequence of sequence listing upward to telomere on chrosomal short arm and 5'-terminus of this base sequence : 109819
atgatatgctgagctaaccaaaatcattttgtgattcagagattaatataggcatgaaaaattattaatgggcttttatcctattgtgttcaatttcaataaaatggtctgcacctgaactaacccttttaccacaaagcatagaaaatggaaatgaatcttctccaaggagcgcgcgcgcacacacacacacacacacagatatgtatgtgtgtgtgtgtgtgtgtgtgtgtgtgtgtgtgtgtgtgtatatatatatatatatataaaatggatcccttctatgatggcatcttggtgtggaacaaattcataatcttaatcctccagtatttttaattgttccctacccagctaatgggaccagtatctttccaaggaac

SEQ ID NO: 25676 - DNA, 451 bp, Homo sapiens
  chrX.fa.O7frz.6081777
  Located on chromosome X
  Distance between a terminus base of telomere on chromosomal short arm and 5'-terminus of this base sequence : 5738753
  Distance between 3'-terminus of neighbour sequence of sequence listing upward to telomere on chrosomal short arm and 5'-terminus of this base sequence : 386758
gatcatttgtcagtggtttagagggttagtaatgtacttaaattaataaaatatgtaatatccccgaaaggaatccatttctgaaaattcagtacttggttttgatcctttaagttccctcaatattttttgtgcatgcaaattttatttacacagtaaaatactgccctcagatacatatcgggatatatatatatatatatatatatatagagagagagagagagagagagagagagagagagagacagagagagagagacagagagagagaatttttgctatccaaatattatgtcttggttttgttgtctttataatattaaaatttaacattagcatttgagttacatggaaatcaattgtattttaatagtctaagttaccccttatttctacctatttgaaagactcaaatctctttttactttaagatcttcaccttaaggac

SEQ ID NO: 25677 - DNA, 164 bp, Homo sapiens
  DXS1223
  Located on chromosome X
  Distance between a terminus base of telomere on chromosomal short arm and 5'-terminus of this base sequence : 5817397
  Distance between 3'-terminus of neighbour sequence of sequence listing upward to telomere on chrosomal short arm and 5'-terminus of this base sequence : 78193
tgccaatttttgcttttgttgtgattgcttttggtgtcttcaatctgacatttttagacacacacacacacacacacacacacacacacacacacacgtggatttttccaagcactgttacatgaccatcttcacagtaaccatgaagtgagtggcaaaatcct

SEQ ID NO: 25678 - DNA, 376 bp, Homo sapiens
  chrX.fa.O7frz.6391248
  Located on chromosome X
  Distance between a terminus base of telomere on chromosomal short arm and 5'-terminus of this base sequence : 6013901
  Distance between 3'-terminus of neighbour sequence of sequence listing upward to telomere on chrosomal short arm and 5'-terminus of this base sequence : 196340
atcactcttaggactttgcatcctcatagcttagttcccacttacaagtgagaacatacaatgtttggttttccattcctgagttacttcacttacaataatggtctccaatcccatccaggttgctgcgaataccatcagttcattcctttttatgtctgagtggtactccattatgtgtgtacacacacacacacacacacacacacacacatacacaccacagtttctttatccactcattgattgatgggaatttgggctggttccacatttttgcaattgcgtgtgcaagtatcttttttcatataatgacttatttttctctgggtagatatccagtagtgggattgctggatcaaatggtagttctact

SEQ ID NO: 25679 - DNA, 171 bp, Homo sapiens
  AC003685.1_84986
  Located on chromosome X
  Distance between a terminus base of telomere on chromosomal short arm and 5'-terminus of this base sequence : 6101407
  Distance between 3'-terminus of neighbour sequence of sequence listing upward to telomere on chrosomal short arm and 5'-terminus of this base sequence : 87130
taactgacctcaaagcaactttacccataatagctaagaataccagccaatacttgctgctgagtatttcttgtgggccaggctacacacacacacacacacacacacacacacacacacacacacacacacgcagatgcagatgcaggtactcagtttgcacagtggtac

SEQ ID NO: 25680 - DNA, 477 bp, Homo sapiens
  chrX.fa.O7frz.6600599
  Located on chromosome X
  Distance between a terminus base of telomere on chromosomal short arm and 5'-terminus of this base sequence : 6268079
  Distance between 3'-terminus of neighbour sequence of sequence listing upward to telomere on chrosomal short arm and 5'-terminus of this base sequence : 166501
tagcttgatttaatcattccacatggtgtacatatatcagagcatcacattatgccttataagtttatacaattatgacttctgaataaaaaataaaattcataatgaaaagtaaataaataaaatatagaaatgagatagcttaaactaagtagaataaagacaatctagagaaagagggactattcaaatgtgtacttactactcagatatgttgagtatgatgaagtattgacttaggaaaacaatgatatcacaccattctcttctgccaagagtccctgaaacataaagaaacaaactttgttttaaaaattaagcttttatttatttatttatttatttatttatcaccttgtattttagtttgtggatgtacatgtgcaggtttgttacatgggtaaattttgtatcattgaatttcagtgtatgaataatcttgtcactcaggtagtgagcatagtatccaataggtag

SEQ ID NO: 25681 - DNA, 102 bp, Homo sapiens
  DISD22_0006852
  Located on chromosome X
  Distance between a terminus base of telomere on chromosomal short arm and 5'-terminus of this base sequence : 6396291
  Distance between 3'-terminus of neighbour sequence of sequence listing upward to telomere on chrosomal short arm and 5'-terminus of this base sequence : 127735
gtcttgctgctaggattgccatggcctgcctctctctctctctctctctctctctctctctctctctctctctctctctccagttcctcagggagattcatt

SEQ ID NO: 25682 - DNA, 221 bp, Homo sapiens
  D12S1026
  Located on chromosome X
  Distance between a terminus base of telomere on chromosomal short arm and 5'-terminus of this base sequence : 6608155
  Distance between 3'-terminus of neighbour sequence of sequence listing upward to telomere on chrosomal short arm and 5'-terminus of this base sequence : 211762
tattgaatgctctgctcaaggaattacaaataaaaaatgaaaatttacctgtgtctatatattcattctatctatctatcttatctatctatctatctatctatctatctatctatctatctatctgatatggtttggctctgtgtccccacccaaatctcatcttgaattggactcccataattcccacgtgttgtgagagggacctggtgggagataat

SEQ ID NO: 25683 - DNA, 443 bp, Homo sapiens
  chrX.fa.O7frz.6925880
  Located on chromosome X
  Distance between a terminus base of telomere on chromosomal short arm and 5'-terminus of this base sequence : 6736137
  Distance between 3'-terminus of neighbour sequence of sequence listing upward to telomere on chrosomal short arm and 5'-terminus of this base sequence : 127761
caggctgctagaaattactttaggtcctctcatgtgggcattgagaatggcaagaagacagactggggaaataattcagtcgactgaatagaaaaacaaacaaaaactttctctcagtggaaaaaaatcaagactttatttatttatttatttatttatttatttatttatttatttttgagacagggtctcactgttgtcacccaggctagaatccagtggtgtgatcatggctcactgcagcctcaacctcctgggctcaagcaatcctcccatctcagcctcccaagtagctaagaccacaggcacgtaccatcacacccagataatttttttgtatttttagtagaaatgaggtctcaccatgttgcccaggctggtggagggccctttaaaacacagatggctgggccctatccctaagcttctgagtcaatagatgt

SEQ ID NO: 25684 - DNA, 392 bp, Homo sapiens
  chrX.fa.O7frz.7027948
  Located on chromosome X
  Distance between a terminus base of telomere on chromosomal short arm and 5'-terminus of this base sequence : 6838134
  Distance between 3'-terminus of neighbour sequence of sequence listing upward to telomere on chrosomal short arm and 5'-terminus of this base sequence : 101554
ctgttgactcaatgaggtaaaccacaatgttttatgaaaatacaatttccctttggcctggggcaggcaaggtcacctagcatagcaatgctgttcaatgccaacattgcctgagatgttaatctttggcaaattaaatggcatacattctggctgagacaagagattaggtaaaacagagtgatatcaaaaatatcaaagccacgtgtgtgtgtgtgtgtgtgtgtgtgcgcgtgtgtgtgttctgccatgtcatgtgtagaaggttgaaaagaaactctgccttttaagagtgataaatagccacagggactctcatgggtgaatgtggggataatttcagcattaaaaaagtaataaaacaataacgatggtaattcttatgccacata

SEQ ID NO: 25685 - DNA, 257 bp, Homo sapiens
  AC002549.1_101705
  Located on chromosome X
  Distance between a terminus base of telomere on chromosomal short arm and 5'-terminus of this base sequence : 7126446
  Distance between 3'-terminus of neighbour sequence of sequence listing upward to telomere on chrosomal short arm and 5'-terminus of this base sequence : 287920
cattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaatacca

SEQ ID NO: 25686 - DNA, 159 bp, Homo sapiens
  DXS8051
  Located on chromosome X
  Distance between a terminus base of telomere on chromosomal short arm and 5'-terminus of this base sequence : 7126512
  Distance between 3'-terminus of neighbour sequence of sequence listing upward to telomere on chrosomal short arm and 5'-terminus of this base sequence : -191
tttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggt

SEQ ID NO: 25687 - DNA, 412 bp, Homo sapiens
  AC003036.1_119612
  Located on chromosome X
  Distance between a terminus base of telomere on chromosomal short arm and 5'-terminus of this base sequence : 7231411
  Distance between 3'-terminus of neighbour sequence of sequence listing upward to telomere on chrosomal short arm and 5'-terminus of this base sequence : 104740
gttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaatt

SEQ ID NO: 25688 - DNA, 385 bp, Homo sapiens
  chr1.fa.O7frz.235237485
  Located on chromosome X
  Distance between a terminus base of telomere on chromosomal short arm and 5'-terminus of this base sequence : 7389987
  Distance between 3'-terminus of neighbour sequence of sequence listing upward to telomere on chrosomal short arm and 5'-terminus of this base sequence : 158164
cagtgcacttatccttgattcatccctcaaaccctccccagtgatgaaatatctcttaatatattcagacacaccgggggtcatcttttgagatcttctctgtctgaaaacagcatgatttttatcttgacagtaaattgtttgggcgtagtcctgaatggagacagttctcccacagcactctgaaggtggtgtccactctgctgttgtgcagtattgctggagggagatcagacgtttttgtttcttgatcttttgtactaggtctactttttccctctcatttttctttttctttctttctttctttcttttttttttgaagagacagggtcttgctgtgttgctctggctggagagccgtggctattcacaggcacggtta

SEQ ID NO: 25689 - DNA, 214 bp, Homo sapiens
  chrX.fa.O7frz.7492974
  Located on chromosome X
  Distance between a terminus base of telomere on chromosomal short arm and 5'-terminus of this base sequence : 7571601
  Distance between 3'-terminus of neighbour sequence of sequence listing upward to telomere on chrosomal short arm and 5'-terminus of this base sequence : 181229
gcacttagttactaggacattgagcgctgaaggactccactgacaatgaagagacacacaagtagactctgtgtgtgtgtgtgtgtgtgtgtgtgtgtgtgtgtgtgtgtgtgtgcatgcacgtgcacacatgataacagaattccagacaactccagacagccagaactactttggttgcaagtgacagaaatacagcctagaccattagctt

SEQ ID NO: 25690 - DNA, 218 bp, Homo sapiens
  AC002359.1_4313
  Located on chromosome X
  Distance between a terminus base of telomere on chromosomal short arm and 5'-terminus of this base sequence : 7803366
  Distance between 3'-terminus of neighbour sequence of sequence listing upward to telomere on chrosomal short arm and 5'-terminus of this base sequence : 231551
tacctggaaacattctagcaagcacaccgtgtgtgtgtgtgtgtgtgtgtgtgtgtgtgtgtgtgtcaaaacagacataatgtaaaatttaccattttaaccattttgaggtgtacttcacggaacgtaaaacgaaccatttttaaagtgaatagtttggtagcatttggtgcatttgcagtcttgcacagccatcacctctatcttgttccagaaca

SEQ ID NO: 25691 - DNA, 248 bp, Homo sapiens
  DXS7108
  Located on chromosome X
  Distance between a terminus base of telomere on chromosomal short arm and 5'-terminus of this base sequence : 7971320
  Distance between 3'-terminus of neighbour sequence of sequence listing upward to telomere on chrosomal short arm and 5'-terminus of this base sequence : 167736
gaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacattggtttaatcaacattatattgagcatctattttagc

SEQ ID NO: 25692 - DNA, 257 bp, Homo sapiens
  Z67125
  Located on chromosome X
  Distance between a terminus base of telomere on chromosomal short arm and 5'-terminus of this base sequence : 8026185
  Distance between 3'-terminus of neighbour sequence of sequence listing upward to telomere on chrosomal short arm and 5'-terminus of this base sequence : 54617
aaggataatttccacatctcaagatccttaagtaagtcacatctgtaatcccatttgccatctgtattagtcaggggtttctagggaaacagaattagtagagagagagagagagagagagagagagagagagtgtgtgtgtgtgtatgtgtgtgtgtgtgtgtgtgtgtgtatgaagatttatatattacatatgtatatgtattatattggctcatgaaattatggagattgagaagtcccatgatgtgctatct

SEQ ID NO: 25693 - DNA, 204 bp, Homo sapiens
  AC003666.1_58273
  Located on chromosome X
  Distance between a terminus base of telomere on chromosomal short arm and 5'-terminus of this base sequence : 8031534
  Distance between 3'-terminus of neighbour sequence of sequence listing upward to telomere on chrosomal short arm and 5'-terminus of this base sequence : 5092
ttgacaagaccaggaaattaacactggtactaataatgcattcgtgtgtgtgtgtgtgtgtgtgtgtgtgtgtgtgtgtgtgtgtgtgtgtatttctatgaaatttcatcccgtgtagattcgagtgaccatcacaatcagaatacacaacagaattgttggaacagaattgttccatcaccacaaggaaactccttcatgtta

SEQ ID NO: 25694 - DNA, 439 bp, Homo sapiens
  chrX.fa.O7frz.8130647
  Located on chromosome X
  Distance between a terminus base of telomere on chromosomal short arm and 5'-terminus of this base sequence : 8129593
  Distance between 3'-terminus of neighbour sequence of sequence listing upward to telomere on chrosomal short arm and 5'-terminus of this base sequence : 97855
ctcctaccttgaagatagcaactttgtattctagcgctcactgctgtgtctggcacagaacaaaaagatgctcaacaaatctcaatggatttcctcccttcctgaaaagaatgcatcacacatgggagaatttcaggccctgtagcccttggggatggagggggtttgggtgataattgaaggtgtgtgtgtatgtggtggggtggtcagccgtgtgtgtgtgtgtgtgtgtgtgtgtgtgtgtgtgtgtgtgatggggtggtcagccatgtgtccctcaacataatcaccttctctgtttattacacaaggaatactttgtcatcattcactttctagggagtatgaaggcaagtttatataatagaatgactgtgcttacataataattcattcaacaagtatttatctttgctcagacactgttcttgatactaag

SEQ ID NO: 25695 - DNA, 230 bp, Homo sapiens
  AC002349.1_144289
  Located on chromosome X
  Distance between a terminus base of telomere on chromosomal short arm and 5'-terminus of this base sequence : 8322296
  Distance between 3'-terminus of neighbour sequence of sequence listing upward to telomere on chrosomal short arm and 5'-terminus of this base sequence : 192264
caggtataggtgatcatatgaaactattattattattattattattattattattattaaagactaggtctcgctgtgttgcccaggctggagtgcagtggctagtcacaggcacactcatattgcactacagcctcaaactcctgggcacgagccatcctcctgcctcagcctcccaagtagctgggactacaagctcacaccaccatgtctggtaggcctatgaaatt

SEQ ID NO: 25696 - DNA, 458 bp, Homo sapiens
  AC004469.1_106722
  Located on chromosome X
  Distance between a terminus base of telomere on chromosomal short arm and 5'-terminus of this base sequence : 8376782
  Distance between 3'-terminus of neighbour sequence of sequence listing upward to telomere on chrosomal short arm and 5'-terminus of this base sequence : 54256
cctacaatcctagcactttgagaggctaaggtgagccgattgagctcaggagttcaagatcagcctaggcaacatggtgaaaccccgtcactaccaaaaataaaaataaaaaaatgcactgggtgtggtggcgcggcctgtattcagcaggctgaggtgggaggatggcttgagtccaggaggtggaggttgcagtgagctgagattgtgccactgcacttcagcctaggtgacagagccagaccctgtctcaataataataataataataataataataataataataataataataataatgctacacacactattgtgttcacagacgtatatatatgtgatgtttgtattaaaggcaacaacaacagcaacatcaaaacactttgtgacaataaaaatgtctaaaattaaggaattggttacaaaaattgtggtatggtcattcaaaggcctat

SEQ ID NO: 25697 - DNA, 298 bp, Homo sapiens
  AC002349.1_89559
  Located on chromosome X
  Distance between a terminus base of telomere on chromosomal short arm and 5'-terminus of this base sequence : 8376846
  Distance between 3'-terminus of neighbour sequence of sequence listing upward to telomere on chrosomal short arm and 5'-terminus of this base sequence : -394
ctaggcaacatggtgaaaccccgtcactaccaaaaataaaaataaaaaaatgcactgggtgtggtggcgcggcctgtattcagcaggctgaggtgggaggatggcttgagtccaggaggtggaggttgcagtgagctgagattgtgccactgcacttcagcctaggtgacagagccagaccctgtctcaataataataataataataataataataataataataataataataataatgctacacacactattgtgttcacagacgtatatatatgtgatgtttgtattaaaggcaa

SEQ ID NO: 25698 - DNA, 477 bp, Homo sapiens
  chrX.fa.O7frz.8538060
  Located on chromosome X
  Distance between a terminus base of telomere on chromosomal short arm and 5'-terminus of this base sequence : 8461849
  Distance between 3'-terminus of neighbour sequence of sequence listing upward to telomere on chrosomal short arm and 5'-terminus of this base sequence : 84705
agtatgctgtctaatatcatggatgctaaaagacaaaaagaaagaaagaaagaaaagaaagaaagaaaaagaaagaaagaaagaaaggaaaggaaaggaaaggaaagaaagaaagaaagaaagaaagaaagaaagaaagaaagaaagaaagaaagaaagaaagaaagaaccaaaaccaaaatgaagctcaaatctcagaaacagaacctcttgccttagggtctgagcagggagaatacactcaaacacccaaggggagacaggcagggtgcagccctgagggtactgatgggacataagaaaaagaccaacaatcgtgccacaaaggccccatcggctctgcctctgtcttgggcagacagttggtcatctcaagctcaccaggagcaaaatttttgtcacaactggagagggtgtgctaccatcatttagtgggtagaggatatgtaggggactactacagatcctgcaacctac

SEQ ID NO: 25699 - DNA, 327 bp, Homo sapiens
  U96409.1_69506
  Located on chromosome X
  Distance between a terminus base of telomere on chromosomal short arm and 5'-terminus of this base sequence : 8535879
  Distance between 3'-terminus of neighbour sequence of sequence listing upward to telomere on chrosomal short arm and 5'-terminus of this base sequence : 73553
agacaaccaaaagttatcttcagacattgcccagtgtcccctagtggtcaaaattgactctgagtgagaacttctgaactagattgttacaatagctttttaattgtcttccctacttctgcttttgcccctctacaatctattcttcacggagctgccaaagtcacctttaaaaactatttatcatgtgacacacacacacacacacacacacacacacacaccatggaatactactcagccataaaaaggaaagaaataatggcattcacagcaacctggatggagttggagactattattctaagtgaagtaactcaggaatgg

SEQ ID NO: 25700 - DNA, 185 bp, Homo sapiens
  U69729.1_9028
  Located on chromosome X
  Distance between a terminus base of telomere on chromosomal short arm and 5'-terminus of this base sequence : 8679282
  Distance between 3'-terminus of neighbour sequence of sequence listing upward to telomere on chrosomal short arm and 5'-terminus of this base sequence : 143076
tttacagatagagtgccaagttaaaaagtatcagaactgtgtgtgtgtgtgtgtgtgtgtgtgtataaccatttgtgtgaacaatgtgtaatgtgtttcaaaatggcccctcaaagtggaatgtgaaatagaaaaaaatatatctgatgctgaagtcagggttttttaccatgaccttaaggcat

SEQ ID NO: 25701 - DNA, 258 bp, Homo sapiens
  U69729.1_4570
  Located on chromosome X
  Distance between a terminus base of telomere on chromosomal short arm and 5'-terminus of this base sequence : 8683721
  Distance between 3'-terminus of neighbour sequence of sequence listing upward to telomere on chrosomal short arm and 5'-terminus of this base sequence : 4254
gattcatcactaagttgtcaggagtggtatgtggtgtgtgtgtgtgtgtgtgtgtgtgtgtgtgtgtgtgtgtgtgtgtgtgtattagcctcttttaagaggttatttagaagaggaagacataattattcacttcatttatgagttgctctattacaatttggttgttcctttcgcaaagcattcgtgacattgttagaacttgtcattaagtcctttggcggagggctctacctctaatctttgcacagcactagc

SEQ ID NO: 25702 - DNA, 195 bp, Homo sapiens
  U69729.1_2087
  Located on chromosome X
  Distance between a terminus base of telomere on chromosomal short arm and 5'-terminus of this base sequence : 8686195
  Distance between 3'-terminus of neighbour sequence of sequence listing upward to telomere on chrosomal short arm and 5'-terminus of this base sequence : 2216
gaccagtgaaatgcttctattaacagcagagttcttcattcagtgtgtgtgtgggggtgtgtgtgtgtgtgtgtgtgtgtgtgtgtgtgtgtagaaagagtactttaagccaactaaaaggcgagattgtcaacagagcctaggagtctgagaagtttgagataagcgatggtgatacaaacatcattagcactg

SEQ ID NO: 25703 - DNA, 404 bp, Homo sapiens
  chrX.fa.O7frz.8889425
  Located on chromosome X
  Distance between a terminus base of telomere on chromosomal short arm and 5'-terminus of this base sequence : 8773593
  Distance between 3'-terminus of neighbour sequence of sequence listing upward to telomere on chrosomal short arm and 5'-terminus of this base sequence : 87203
ctaggaagttgcactgatgtattgtgacctcagggtggtatagagtacagacatgcaagttggtctcagccatcatctgaaaacattctccacacctatccccagccatcacaggctgctgtccagtgtccagttgcttgctgcttgggaagggcaagcagtgggtctcgggtctctctctctctgtctctctctctctctctctctctctctctctctctctctctctctctctctctctctcgatccagtgggggaagagaagatttgcacactcctctcttgtaggtctggctctgtgcccctgggggctgacctaaatggactttgtgaatgagccttccaatggggagtctcaggatagtatcagagaaagtgaagagattcagtttgaagtaggaatt

SEQ ID NO: 25704 - DNA, 316 bp, Homo sapiens
  AC004467.1_23018
  Located on chromosome X
  Distance between a terminus base of telomere on chromosomal short arm and 5'-terminus of this base sequence : 8897787
  Distance between 3'-terminus of neighbour sequence of sequence listing upward to telomere on chrosomal short arm and 5'-terminus of this base sequence : 123790
agaataccagcttggaggtaactgcccccataattcaattaattcccactgggtccctcccaccacacatggggattatgggaactacaatacaagatgagagtgggtggggaatataacccaaccatatcaggtggtttcaacttgcatgcttatttttatgaccctccactactgtaccactgtgtgcaaactgagcatctggatctgtgtgtgtgtgtgtgtgtgtgtgtgtgtgtgtgtgtgtgtgtgtgtgtgtgtgtgtagcctggtccacaggaaatactcagcaagtattggctggtattcttagcta

SEQ ID NO: 25705 - DNA, 300 bp, Homo sapiens
  AC002366.1_126132
  Located on chromosome X
  Distance between a terminus base of telomere on chromosomal short arm and 5'-terminus of this base sequence : 9046927
  Distance between 3'-terminus of neighbour sequence of sequence listing upward to telomere on chrosomal short arm and 5'-terminus of this base sequence : 148824
aaatggtctgcaatacttctaagttattagtgaaaaagacttccctttagtacaacacaatttttaattccttgaagtatgtcttggggtaacaaacacccccatcctttaggtcatattcaaattacacacacacacacacacacacacacacacacacacacacgcatgcatacacagtgcaccacccacttctctcatttcctcctgtaaccacaaaacggaatgttttactacaatcatgcacacccattttatttacataaaaatgatgcctttaaactggtaaagaagcaggag

SEQ ID NO: 25706 - DNA, 155 bp, Homo sapiens
  Z67166
  Located on chromosome X
  Distance between a terminus base of telomere on chromosomal short arm and 5'-terminus of this base sequence : 9046997
  Distance between 3'-terminus of neighbour sequence of sequence listing upward to telomere on chrosomal short arm and 5'-terminus of this base sequence : -230
cttgaagtatgtcttggggtaacaaacacccccatcctttaggtcatattcaaattacacacacacacacacacacacacacacacacacacacacgcatgcatacacagtgcaccacccacttctctcatttcctcctgtaaccacaaaacgga

SEQ ID NO: 25707 - DNA, 154 bp, Homo sapiens
  DXS1043
  Located on chromosome X
  Distance between a terminus base of telomere on chromosomal short arm and 5'-terminus of this base sequence : 9146144
  Distance between 3'-terminus of neighbour sequence of sequence listing upward to telomere on chrosomal short arm and 5'-terminus of this base sequence : 98992
tgatatttgcatagagcgtgataagtgatttatgcttgaaatcccctttgtagaacaaataataagtgtgtgtgtgtgtgtgtgtgtgtgtgtgtgtgtgtgtgttcttttgctatctattgtatgtttgatcccaggttgatgaaagggtgat

SEQ ID NO: 25708 - DNA, 102 bp, Homo sapiens
  DISD22_0006855
  Located on chromosome X
  Distance between a terminus base of telomere on chromosomal short arm and 5'-terminus of this base sequence : 9271353
  Distance between 3'-terminus of neighbour sequence of sequence listing upward to telomere on chrosomal short arm and 5'-terminus of this base sequence : 125055
tcagacatctccaagttatagtcctaagtgtgcatggtgtgtgtgtgtgtgagagagagagagagagagagagagagagaccaaccagtctaccttgggtaa

SEQ ID NO: 25709 - DNA, 320 bp, Homo sapiens
  chrX.fa.O7frz.9865857
  Located on chromosome X
  Distance between a terminus base of telomere on chromosomal short arm and 5'-terminus of this base sequence : 9408815
  Distance between 3'-terminus of neighbour sequence of sequence listing upward to telomere on chrosomal short arm and 5'-terminus of this base sequence : 137360
aaatagttatggctttggaaatctctttcctcagcttctatacagaacaactcatcagcccttttcttgaatgagtggcacatggcaaaccctccaagaggtgctgaggctggtcttcatcagtagcaaggccagctgttacggatgatctctctctctctctctctctctctctctctctctctctctctctgtatccaagcagtaactccagaaaagttcagttcacaaatggaaatgtatgaagcacctctgatgtaccaagaggtggtacacataatcatgggaggccacagatacttctcgaccattaaatgtaa

SEQ ID NO: 25710 - DNA, 139 bp, Homo sapiens
  DXS7109
  Located on chromosome X
  Distance between a terminus base of telomere on chromosomal short arm and 5'-terminus of this base sequence : 9601406
  Distance between 3'-terminus of neighbour sequence of sequence listing upward to telomere on chrosomal short arm and 5'-terminus of this base sequence : 192271
ggcttggtacatatacacccattaacttaattcagtttggcaagtgtgtgtgtgtgtgtgtgtgtgtgtgtgtttgtgtgtattttttaagacaaagtcttgttctgtcactcatgctggagtgtggtggcacaatctt

SEQ ID NO: 25711 - DNA, 313 bp, Homo sapiens
  AC002981.1_10896
  Located on chromosome X
  Distance between a terminus base of telomere on chromosomal short arm and 5'-terminus of this base sequence : 9728100
  Distance between 3'-terminus of neighbour sequence of sequence listing upward to telomere on chrosomal short arm and 5'-terminus of this base sequence : 126555
attcagctgcaagtaacaaaatacttggttatctttggcttaaatggaaaaagggagccagcggaagagagagagagagagagagagagagagagagaaggtggaggcgtaagggggtggggacagagatttaattgtctcataaaatgaaaatttgaaggccaaaattctaagttggttctatgacttgacaatatcttccagggccaagcctctctggcctctaccccactgttctcaacatcttgacttttgattttcatgcctattacctcatggttgcaagatgatagatgtagcttaaggcttgatg

SEQ ID NO: 25712 - DNA, 177 bp, Homo sapiens
  DXS7104
  Located on chromosome X
  Distance between a terminus base of telomere on chromosomal short arm and 5'-terminus of this base sequence : 9734920
  Distance between 3'-terminus of neighbour sequence of sequence listing upward to telomere on chrosomal short arm and 5'-terminus of this base sequence : 6507
tcagacaagtagccttatgtgatctacgttaaaacacacacacacacacacacacacacacacacacatacacacacacaaaacatctttttgtctggtatgttgagaatagattatggcataaaaataaaagatttctaaatatattgccttatatgaaaaggttgcgatgagact

SEQ ID NO: 25713 - DNA, 402 bp, Homo sapiens
  chrX.fa.O7frz.10306291
  Located on chromosome X
  Distance between a terminus base of telomere on chromosomal short arm and 5'-terminus of this base sequence : 9847857
  Distance between 3'-terminus of neighbour sequence of sequence listing upward to telomere on chrosomal short arm and 5'-terminus of this base sequence : 112760
gttaatgagctattgaatattggttataactgatatattatttctaggaccaaaaaaatcccaacctagtctggttgtattttgcagtcatgtgtgtagtggttggcaatattcaaagctcctctgtgtactcactttgtaggacttactttagaatataatttttattggacagactatacatatttaagcttattttgtattgggtttaattattaattatggtattctctctctctctctctctctctctctgtgtgtgtgtgtgtttgtgtgtttgtgtgtgtgtgtgtgtgtgtgtgtgtgtgtgtcctgcttaaaaccttgaattatgctaggcacaaaaggcatgaagggaattttttggtgtgctgaaggttctttgtggtattagtctgcaag

SEQ ID NO: 25714 - DNA, 222 bp, Homo sapiens
  DISO7_10004591
  Located on chromosome X
  Distance between a terminus base of telomere on chromosomal short arm and 5'-terminus of this base sequence : 9957838
  Distance between 3'-terminus of neighbour sequence of sequence listing upward to telomere on chrosomal short arm and 5'-terminus of this base sequence : 109579
acctacacttggtgactctcctagcatagcatagcatagcatagcatagcatagcatagcatagcatagcatagcatagcatagcatagcatagcatagcatagagcatagcatagcatagcatagcatagcatagcatagcatagcatagcatagcatagcaagcaataattgtttgctgaaaaaaagcaaacttctgtgctgggtgttgcttacatatga

SEQ ID NO: 25715 - DNA, 112 bp, Homo sapiens
  DISO7_10004589
  Located on chromosome X
  Distance between a terminus base of telomere on chromosomal short arm and 5'-terminus of this base sequence : 10027976
  Distance between 3'-terminus of neighbour sequence of sequence listing upward to telomere on chrosomal short arm and 5'-terminus of this base sequence : 69916
attgataccctcagtgatatgtgtgtatgcccgtgtgtgtgtgtgtgtgtgtgtgtgtgtgtgaattctacttactttcctcttttccattcctgtctgtgtcccaagtgtt

SEQ ID NO: 25716 - DNA, 101 bp, Homo sapiens
  DISO7_10004590
  Located on chromosome X
  Distance between a terminus base of telomere on chromosomal short arm and 5'-terminus of this base sequence : 10146703
  Distance between 3'-terminus of neighbour sequence of sequence listing upward to telomere on chrosomal short arm and 5'-terminus of this base sequence : 118615
agctaacaaattgacctgtcacaattttatgcatgtaagtgtgtacacacacacacacacacacacacacacacacacataccagacctctgaatcagaga

SEQ ID NO: 25717 - DNA, 338 bp, Homo sapiens
  chrX.fa.O7frz.10772337
  Located on chromosome X
  Distance between a terminus base of telomere on chromosomal short arm and 5'-terminus of this base sequence : 10285255
  Distance between 3'-terminus of neighbour sequence of sequence listing upward to telomere on chrosomal short arm and 5'-terminus of this base sequence : 138451
acaaatcacctatgttcaggtaattccttatcttttccaaacatttagaaaccttcatggggatcaaaatacattaatattgccaggcacagtggcatgtgcctgtaatcccagctacttgggaggcaacacagaaagacttcatttcaaaaaaaagaaaaaaaaaagactaaaaacagaaggaaaaagttgcatcaatattacattgtctgtaacctgattttgtctttgctttgaaagtggtcaattttgatttgtgtagatagtgatgtgtgtgtgtgtgtgtgtgtgtgtgcgcgcgcgtgccaatgggtctgtaagactagctatcagtttgg

SEQ ID NO: 25718 - DNA, 445 bp, Homo sapiens
  chrX.fa.O7frz.10854710
  Located on chromosome X
  Distance between a terminus base of telomere on chromosomal short arm and 5'-terminus of this base sequence : 10367669
  Distance between 3'-terminus of neighbour sequence of sequence listing upward to telomere on chrosomal short arm and 5'-terminus of this base sequence : 82076
gtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatg

SEQ ID NO: 25719 - DNA, 304 bp, Homo sapiens
  chrX.fa.O7frz.11135418
  Located on chromosome X
  Distance between a terminus base of telomere on chromosomal short arm and 5'-terminus of this base sequence : 10639369
  Distance between 3'-terminus of neighbour sequence of sequence listing upward to telomere on chrosomal short arm and 5'-terminus of this base sequence : 271255
ttgtctagccacaattaggagagagtatggattgtcaggaaatggagcttgttccaccctctcactgtggcttaagaattttcttctcaacaatgaaaagatgcacagatcatagtacaggagataataagagtcactcttgctatcttcagcagatcatagttgtacaccattctataaaaatatgagagagagagagagagagagagagagagagagagagagaaagatctttgtaggaataaacatagaaagccattttatctacaaagccaattcaacctggactgcagtacttacaatc

SEQ ID NO: 25720 - DNA, 159 bp, Homo sapiens
  DXS1224
  Located on chromosome X
  Distance between a terminus base of telomere on chromosomal short arm and 5'-terminus of this base sequence : 10830846
  Distance between 3'-terminus of neighbour sequence of sequence listing upward to telomere on chrosomal short arm and 5'-terminus of this base sequence : 191173
tgggtggcaacactcactaccaaaaacgtgggggagtagtagtggtgatataagtgtgtgtgtgtgtgtgtgtgtgtgtgtgcacgcgcgcgcatgcctgtgcctacatcaagggggagagggaaggaaggaaagattccagattttgtaggcttgaag

SEQ ID NO: 25721 - DNA, 126 bp, Homo sapiens
  Z67587
  Located on chromosome X
  Distance between a terminus base of telomere on chromosomal short arm and 5'-terminus of this base sequence : 10882235
  Distance between 3'-terminus of neighbour sequence of sequence listing upward to telomere on chrosomal short arm and 5'-terminus of this base sequence : 51230
taggccctgctcagactggttgaatgagaatataagaggataaggcccaggtattgatattaaaacaaaacaacaacaaccacacacacacacacacacacacacacgccaggcaattcaaacata

SEQ ID NO: 25722 - DNA, 317 bp, Homo sapiens
  chrX.fa.O7frz.11857654
  Located on chromosome X
  Distance between a terminus base of telomere on chromosomal short arm and 5'-terminus of this base sequence : 11082218
  Distance between 3'-terminus of neighbour sequence of sequence listing upward to telomere on chrosomal short arm and 5'-terminus of this base sequence : 199857
ggtcatcgtgaaatagaaactactatgcatccagtccctctatttttcatatcgatgaaggaaagtcacacaatgtgcatggaatgcagaatttttctttattgagctgttcagttggacctcaactctgtgtgtgtgtgtgtgtgtgtgtgtgtgtgtgtgtgtgtgttggtggaaatattagtttggtgcaaaagtaattgcagtttttgccactgaaaataatggtaaaaactgctattacttttgcatcaacctaataaatagtgacagacaataaatgtctattatgtgctatgtaaaagtagccacgtgca

SEQ ID NO: 25723 - DNA, 251 bp, Homo sapiens
  AC003037.1_134352
  Located on chromosome X
  Distance between a terminus base of telomere on chromosomal short arm and 5'-terminus of this base sequence : 11470763
  Distance between 3'-terminus of neighbour sequence of sequence listing upward to telomere on chrosomal short arm and 5'-terminus of this base sequence : 388228
acaggcttacggtccaatatatggtgagtaaagggatgtagaagagctcagtacacacacacacacacacacacacacacacacacacacacacacacacaaatggcttgggggacccacatggaaactggtttatttacaatcaggccctgtctaaacatttagggtctcaaaaatctattgagatggttggctctgatggttgggatgggaattgggaggtctcggttctaaggttctaatcttggctc

SEQ ID NO: 25724 - DNA, 168 bp, Homo sapiens
  DXS8022
  Located on chromosome X
  Distance between a terminus base of telomere on chromosomal short arm and 5'-terminus of this base sequence : 11556235
  Distance between 3'-terminus of neighbour sequence of sequence listing upward to telomere on chrosomal short arm and 5'-terminus of this base sequence : 85221
ggaaactaatgcagcatgtctgcactgtttaagtttgtttgaaaagaacatgtattagtttattaatgtgtgtgtgtgtgtgtgtgtgtgtgtgtgtgtgtgtgtgtaaggaggctccatcttaaaaaataaggcagcaggttggctaaaatgggacttctgtgacag

SEQ ID NO: 25725 - DNA, 241 bp, Homo sapiens
  AC003035.1_170339
  Located on chromosome X
  Distance between a terminus base of telomere on chromosomal short arm and 5'-terminus of this base sequence : 11556248
  Distance between 3'-terminus of neighbour sequence of sequence listing upward to telomere on chrosomal short arm and 5'-terminus of this base sequence : -155
gcatgtctgcactgtttaagtttgtttgaaaagaacatgtattagtttattaatgtgtgtgtgtgtgtgtgtgtgtgtgtgtgtgtgtgtgtgtaaggaggctccatcttaaaaaataaggcagcaggttggctaaaatgggacttctgtgacagcagaggagagatacaaatagatcgaaactttcaagtccactgttataaattcaagtgaaaagccagtaggcacatctgccttataa

SEQ ID NO: 25726 - DNA, 151 bp, Homo sapiens
  DXS8108
  Located on chromosome X
  Distance between a terminus base of telomere on chromosomal short arm and 5'-terminus of this base sequence : 11582504
  Distance between 3'-terminus of neighbour sequence of sequence listing upward to telomere on chrosomal short arm and 5'-terminus of this base sequence : 26015
tgtataacgagatgttttgatatgtgtatacattgtaaaatgataatcacaatcaagttaacatctatcgccatatctagttatttctgtgtgtgtgtgtgtgtgtgtgtgtgtgtgtatgtgtgtcgtgaaaacatttaagacctactct

SEQ ID NO: 25727 - DNA, 471 bp, Homo sapiens
  chrX.fa.O7frz.12461233
  Located on chromosome X
  Distance between a terminus base of telomere on chromosomal short arm and 5'-terminus of this base sequence : 11691645
  Distance between 3'-terminus of neighbour sequence of sequence listing upward to telomere on chrosomal short arm and 5'-terminus of this base sequence : 108990
gaattcctgttagagatggaactgtccttgtttgaaaaaatatctcaataggtaatttggccatcaaaaccaagccttcagagaagggtctggagaagaaatgcagaactcaagaaggaccaagtcattttctataagaaattatatgggagaaattattcatttgttgttggctctgagtgaggaggagtaagggaataaagggaaagaagagccagtaagaaagtttgggggctacatggaatgttgggggtggcaaaaggactcttaggaatagggagagctaatattagttttcagttacttgtattactgttgtgaacccatgctgtttttccaaaccttgggtcaagtttgctgtaaacataaatgtcttggttgggtgtgtgtgtgtgtgtgtgtgtgtgtgtgtgtgtgtgtgtgtgtattaagtaaagggaataagcctaatgtttagactacaatggaatg

SEQ ID NO: 25728 - DNA, 278 bp, Homo sapiens
  DISD22_0006862
  Located on chromosome X
  Distance between a terminus base of telomere on chromosomal short arm and 5'-terminus of this base sequence : 11784005
  Distance between 3'-terminus of neighbour sequence of sequence listing upward to telomere on chrosomal short arm and 5'-terminus of this base sequence : 91889
ttcccatctcagcattctcttcattttatatttactcggtatatctttcccagcctttgatttttgacagttttcactttttttttgttttaggtatatataccttttatagaaatcatcctgttgacacagtatatgcgtgcgtgtgtgtgtgtgtgtgtgtgtgtgtgtgtgtgttaaatgtgagagcccttgtcttttcgtttatgttcttatctacacacatataaactgggttggtattctttagaattttaactgttggttgtggacaaatt

SEQ ID NO: 25729 - DNA, 282 bp, Homo sapiens
  chrX.fa.O7frz.12764809
  Located on chromosome X
  Distance between a terminus base of telomere on chromosomal short arm and 5'-terminus of this base sequence : 11950987
  Distance between 3'-terminus of neighbour sequence of sequence listing upward to telomere on chrosomal short arm and 5'-terminus of this base sequence : 166704
cactgctataacagaatacctgagagtggataatttataatcaatagcaatttgtttggctcatggttgtagaggttgggaaggccaacatactgaggaaatgcatctgatgagggccttcttgctgatccataacatggtggaaggtatcatataacacatgcacgagagagagagagagagagagagaagaagagaagagaagagaaaggaagggaacggggggcgaactcatccttttatcaggaacacactcctgtgataatggtactagttccttca

SEQ ID NO: 25730 - DNA, 324 bp, Homo sapiens
  chrX.fa.O7frz.12949232
  Located on chromosome X
  Distance between a terminus base of telomere on chromosomal short arm and 5'-terminus of this base sequence : 12189850
  Distance between 3'-terminus of neighbour sequence of sequence listing upward to telomere on chrosomal short arm and 5'-terminus of this base sequence : 238581
ccataacaagaatgtatttggtaggatggtacatggttaatggtattgtgtaatcacctgcacaaatgtgttcctgattgcttcagtaaaggaagtacaggctattccgttcaattgccattaagcataatatacaaaatctcatttcaataattctgccattctgtaacattcaagcatgcacacacacacacacacacacacacacacacacacacacaaattcaatagctcagcatagtcattaacaacatacttatagctggatacatggaaacctggttccaatgtcagctttgcttctaagtaaacacgtgaccttga

SEQ ID NO: 25731 - DNA, 453 bp, Homo sapiens
  chrX.fa.O7frz.13028827
  Located on chromosome X
  Distance between a terminus base of telomere on chromosomal short arm and 5'-terminus of this base sequence : 12269091
  Distance between 3'-terminus of neighbour sequence of sequence listing upward to telomere on chrosomal short arm and 5'-terminus of this base sequence : 78917
cgattagaacaggttaatgtagacagctatgagacatcaaagtagagtcagtgaataggcatttgatataggagtgtggagttaatagaaggttttggctaaagatacaaatttcactgattgaaatacagctcctggcatttctttgtttcgtttactagactgtaaattatttcatggcaagagcctgtctcattcatttatctccagcccttaacatggtgccagaaacataataacactgtgttttgctgatgttcaaagatgctacatgaatgaatgaatgaatgaatgaatgaatgaacagacacatacttttatgacgctaacttacttatgcactttgagacaagaacattttcctcctgtggaaggaaaaagacttcaagttgtttcatttacctctaatggtatttagaaagcttgcatgttcaagcaggtatcatagtaaag

SEQ ID NO: 25732 - DNA, 439 bp, Homo sapiens
  AC003658.1_105854
  Located on chromosome X
  Distance between a terminus base of telomere on chromosomal short arm and 5'-terminus of this base sequence : 12361034
  Distance between 3'-terminus of neighbour sequence of sequence listing upward to telomere on chrosomal short arm and 5'-terminus of this base sequence : 91490
gtctttatttcctcaattgtcaaggtttttctttttactttttttgaaacattttttaaagttaaaaaatacaagaatagtacaaataactcccataaaactttacccagactgctcaatttttacattttgccacagctgctttataattctctcctcctccctccttccttcttctctgtctctggctctctctctctctctctctctgacacacacacacacacacacacacacacacacacacacacacacacacattagtttttctctattgagagattacataaatcatgccactttacctcataatactttagtgtacatttcctaagaatatgatattttcatatataaccacaattataaaatttgagaaaattaatatcgccaccatatttttatcttttctacagttcacattccaattctgttaatc

SEQ ID NO: 25733 - DNA, 242 bp, Homo sapiens
  DISO7_10004596
  Located on chromosome X
  Distance between a terminus base of telomere on chromosomal short arm and 5'-terminus of this base sequence : 12396112
  Distance between 3'-terminus of neighbour sequence of sequence listing upward to telomere on chrosomal short arm and 5'-terminus of this base sequence : 34639
gacttagacaagggaactaaggagaaaaccagaagacaagacaaaaatagtaataataataaataactctaatttttaaaaatagaatatatatatatatatatatatatatatgaatgattataaaactgagatccagtgagaaaagtatggtatgactaaataaaacttcaacctttttaggtaaaagctgcagttaaaaattagcaaaaagaaaaggagaaatctggctagactgtgtc

SEQ ID NO: 25734 - DNA, 378 bp, Homo sapiens
  chrX.fa.O7frz.13298427
  Located on chromosome X
  Distance between a terminus base of telomere on chromosomal short arm and 5'-terminus of this base sequence : 12496255
  Distance between 3'-terminus of neighbour sequence of sequence listing upward to telomere on chrosomal short arm and 5'-terminus of this base sequence : 99901
gattggctgaaattagctattttaaagaaatacagagatgaggcttaaaaatccaccacttggaattactgttgtttttgatgtggttttcactggtattatgagacaagctatcatttgtgtatgaggacaagtattgggagaatatatacacacacgcgcacacacacacacacacacacacacacacacacacacacacacacctttttataaaactgaacccttctgatatggtttggctctctccccacccaaatctcatcttgaattataactcccacaattcccatgtgttgtgggagaaacctggtgggaggtgattgaattatgggggcaggtctttcctgcgctgttctcatgatagtgaatgagtct

SEQ ID NO: 25735 - DNA, 371 bp, Homo sapiens
  chrX.fa.O7frz.14653394
  Located on chromosome X
  Distance between a terminus base of telomere on chromosomal short arm and 5'-terminus of this base sequence : 12767346
  Distance between 3'-terminus of neighbour sequence of sequence listing upward to telomere on chrosomal short arm and 5'-terminus of this base sequence : 270713
acttactcatgtgaccagacaccacctgttcccccataacctatggaaattaaaaaattaaacacacacacacacacacacacacacacacacacacacacagtgagataccaccttatcccagtcagaatggccattgttaaaaagtcacaaaatgatagatgttggtgtggatgtggtgaaaagaaacgcttatacactgttggtgggaatgtcatttagtacaatctccatggaaaacagtatgaagatttttcaaggaactaaaagtagatttacaatttgatccagcaatcccactactgggtatccaaccagtggaaaataagtcattatgtaaaaaagatacctgcactcatatgtttattgct

SEQ ID NO: 25736 - DNA, 301 bp, Homo sapiens
  DISO7_00006137
  Located on chromosome X
  Distance between a terminus base of telomere on chromosomal short arm and 5'-terminus of this base sequence : 12834020
  Distance between 3'-terminus of neighbour sequence of sequence listing upward to telomere on chrosomal short arm and 5'-terminus of this base sequence : 66303
tagaccaaggatcgcctagctagctgctgtttttgttttttgttttttccccccactcaaagcctctgggttgggctttggggtgataagtgtgggggcctaacttgataattgaagctatctgggctggagacaatgagaaggaatgtgtggaggctactactggctatcctaccctccccacacaggtctgtggagtgtgtgtgtgtgtgtgtgtgtgtgtgtgtgtgtgcatgcgcatattgtgcatgtttatgtgttggtgagaatggggtggggggacaatgataaaggtctacca

SEQ ID NO: 25737 - DNA, 331 bp, Homo sapiens
  chrX.fa.O7frz.14519782
  Located on chromosome X
  Distance between a terminus base of telomere on chromosomal short arm and 5'-terminus of this base sequence : 12999829
  Distance between 3'-terminus of neighbour sequence of sequence listing upward to telomere on chrosomal short arm and 5'-terminus of this base sequence : 165508
taatctgagtgctacctgtgatcagagagaggcatgcgctcgtgtacacacacacacacacacacacacacacacgttttacctaactggctggaggcccgccagaggccacaagaaccctccagccctaagtctgcgaagttgctgatgtcacgtcctttcccaaactgagaccaatcagtgaggaagccttggagtttatcaggaaggaaactcagtttgtaacttttgagagtgaagggagcagggtgggggtgaaggaaacagctcactttctgcaactgttgttcaccctgctgagatccgtttgttacatggtagcttgttatgg

SEQ ID NO: 25738 - DNA, 410 bp, Homo sapiens
  U75931.1_14164
  Located on chromosome X
  Distance between a terminus base of telomere on chromosomal short arm and 5'-terminus of this base sequence : 13158346
  Distance between 3'-terminus of neighbour sequence of sequence listing upward to telomere on chrosomal short arm and 5'-terminus of this base sequence : 158186
gaacatttctgcctttgttactactgaattctcagggccaacccactatgtctgtcaaatgctaggtgttcaataaatatttattgaatgatgtttcataatggaaaactccatgtatagtaatacagttattgacagtagatatatgtatatatgaagatatatatgaatatatgtactgacagtacatacacacacacacacacacacacacacatatatataccgtcaataactgtattactattccatatactgtcaataaccgtattactatacatgggattttatatacatatatacatacatatatacacacacaagtgtgtgtgtgtgcatatgtgtgtgtatgtatacatatatatatatatggggtattcatcaacatcttcacctacatgtagcaaaat

SEQ ID NO: 25739 - DNA, 355 bp, Homo sapiens
  AC003669.1_48624
  Located on chromosome X
  Distance between a terminus base of telomere on chromosomal short arm and 5'-terminus of this base sequence : 13357949
  Distance between 3'-terminus of neighbour sequence of sequence listing upward to telomere on chrosomal short arm and 5'-terminus of this base sequence : 199193
aagcatccactaagttcatagaactaatggaggttgttaaggaagtatgaggctccatttgtgccctcactgaactcaaagtctttacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggaga

SEQ ID NO: 25740 - DNA, 192 bp, Homo sapiens
  DXS1053
  Located on chromosome X
  Distance between a terminus base of telomere on chromosomal short arm and 5'-terminus of this base sequence : 13357985
  Distance between 3'-terminus of neighbour sequence of sequence listing upward to telomere on chrosomal short arm and 5'-terminus of this base sequence : -319
ttaaggaagtatgaggctccatttgtgccctcactgaactcaaagtctttacacacacacacacacacacacacacacacacacaaataggactgaaaacaccaagcagtttataattatgtgcccaaattagaaagacaaggtttttgccataactttcaatggcaaaaaacgtgattacttttgcaccaa

SEQ ID NO: 25741 - DNA, 405 bp, Homo sapiens
  AC003669.1_158746
  Located on chromosome X
  Distance between a terminus base of telomere on chromosomal short arm and 5'-terminus of this base sequence : 13467844
  Distance between 3'-terminus of neighbour sequence of sequence listing upward to telomere on chrosomal short arm and 5'-terminus of this base sequence : 109667
gctgtaagatgttaccataaagaacagaaaagggggacaggagtggtggctcaagcctgtaacactttgggaggccaagatgggtggatcacttgagcccaggagctcaagactagcctgggcaacatagtgaaaccccatctctaccaaaaaaaaaaaaaaaatcagccaggcgtggtggcatgcacctgtagtcccagctacccaggaggctaaggcaggaagattgcttgaacctgggaagtggaggttgccgtgagccaagatcatgccactgcactccagcctggatgacagagtgagaccctgtctccaacaacaacaacaacaacaacaacaacaacaacaacaaaagaatggaaatggaaaaatcacttttctcatatgcaaatgttaaatactgca

SEQ ID NO: 25742 - DNA, 101 bp, Homo sapiens
  DISO7_10004602
  Located on chromosome X
  Distance between a terminus base of telomere on chromosomal short arm and 5'-terminus of this base sequence : 13603111
  Distance between 3'-terminus of neighbour sequence of sequence listing upward to telomere on chrosomal short arm and 5'-terminus of this base sequence : 134862
attcggacctgctattgctttggtgtgtgtgtgtgtgtgtgtgtgtgtgtgtgtgtgtgcgcgcacatgtgtgtgcttccactcttaacagaaatgaagtg

SEQ ID NO: 25743 - DNA, 178 bp, Homo sapiens
  DISO7_10004599
  Located on chromosome X
  Distance between a terminus base of telomere on chromosomal short arm and 5'-terminus of this base sequence : 13720346
  Distance between 3'-terminus of neighbour sequence of sequence listing upward to telomere on chrosomal short arm and 5'-terminus of this base sequence : 117134
gatgtggtaaggcccttgggacaaatataggaaaaacatctctctctctctctctctctctctctcctctgtgttgcattgggggcggtggtgattggggcacagaactctctatatagtgaactttttaactgagtgagagagaagctgatttcagggctcttactgtagatagtga

SEQ ID NO: 25744 - DNA, 268 bp, Homo sapiens
  chrX.fa.O7frz.13674924
  Located on chromosome X
  Distance between a terminus base of telomere on chromosomal short arm and 5'-terminus of this base sequence : 13791535
  Distance between 3'-terminus of neighbour sequence of sequence listing upward to telomere on chrosomal short arm and 5'-terminus of this base sequence : 71011
atcagatggtgaactatggagaatgaatggcaagcaccacagtgtggttccatatggaggcaaagaggttgatcgtttttttatatccgtgtcagtcaacagacaattgtcagctgtgagctgcctcctttgctcatgtctgtgtgtgtgtgtgtgtgtgtgtgtgtgtgtgtatgtttgagtgtaaaaacctccttggtaagtcagttctctcctgaccaaaaatgatcctggaaggtggcagctgtgacctattagcaactcagaa

SEQ ID NO: 25745 - DNA, 434 bp, Homo sapiens
  chrX.fa.O7frz.18302665
  Located on chromosome X
  Distance between a terminus base of telomere on chromosomal short arm and 5'-terminus of this base sequence : 14047579
  Distance between 3'-terminus of neighbour sequence of sequence listing upward to telomere on chrosomal short arm and 5'-terminus of this base sequence : 255776
ggaagtttatcagctactggaggtgaagaggacatgatctctctcttctccctctttccctctctctctctctgtttctctaacaagcacacacacacacacacacacacacacacacccctggaaaacatgagcttccttgcctaaatctccatggaatgactcctaccttgaagcagcaccaacctgacaataatgcaatcagtgatgttatttgagggggtctgagaaagacttcctctcccccattcaaaaacaactccttccctagacacaaaatctccataaacttcttaagcataaatgcagcaatcgtaaggaaatgtctttaaaatgaacacaaaatgctcttgtaagtgacagggtattatgttttaactatgcagtttcccctaagtgcctggtacaacaaagtaaagtgttatgagtcacgc

SEQ ID NO: 25746 - DNA, 471 bp, Homo sapiens
  chrX.fa.O7frz.18409095
  Located on chromosome X
  Distance between a terminus base of telomere on chromosomal short arm and 5'-terminus of this base sequence : 14069644
  Distance between 3'-terminus of neighbour sequence of sequence listing upward to telomere on chrosomal short arm and 5'-terminus of this base sequence : 21631
tgtcatcttaacagtcctgaagctgggagggaccagagcttaaaactagcaccaggtgttagaaggagcaggaaagcacagccaccagaaggtccaccattccccagatgtcccctacagtctgcctttgcatacagagtaaatcttaactctctttgcaagctcccttcacatgctgcctccttcatggaactggtttcctcctctgtgcctctatgataatttttaggacattttgccttacttatattataaacaggcatacacacacacacacacacacacagaatgaagactgtcttgctcattttttcatgtcccctatctccagtgcaatgacggctcatggtagttcatcaccatattctctgaactacaaaagcactttctctatacctccctaggggtatgtccacaataagaaaccaatacaaataagaataatagtagctattacttattgagcacttg

SEQ ID NO: 25747 - DNA, 406 bp, Homo sapiens
  AC025033.10_28194
  Located on chromosome X
  Distance between a terminus base of telomere on chromosomal short arm and 5'-terminus of this base sequence : 14316871
  Distance between 3'-terminus of neighbour sequence of sequence listing upward to telomere on chrosomal short arm and 5'-terminus of this base sequence : 246756
cctaggcagttgtcagctaaatagctttaaatttgcatatgaaaggaaacaactcaggtgaaaatcaaaaagcaaaatttacatcctaaggtacggagagaaaaagtctggtgtgctagagggaaattaaaatggatttaattgccaattaaacataaaattatagaaattataaaggcctttcaaatatacacaaacacacacacacacaaagatcctctagcttttacttcagaactttaaccatgagaactttagccatgagataaatacaaattcacaggcttgcaaaaaaaacctgtttgatccaaacagtggttttcacttaatagaaaaataacagcagatttaaagtaggcagaaaagaaaaatagagaaaaagagaacttaggaactctatagtttg

SEQ ID NO: 25748 - DNA, 437 bp, Homo sapiens
  chrX.fa.O7frz.18165079
  Located on chromosome X
  Distance between a terminus base of telomere on chromosomal short arm and 5'-terminus of this base sequence : 14357604
  Distance between 3'-terminus of neighbour sequence of sequence listing upward to telomere on chrosomal short arm and 5'-terminus of this base sequence : 40327
ttaaatgaggtagcaagtctttagcatttacctatcacataacatttgcccgacaaatggtagcaattcaaaagtactattgatatttctagagaaggaaaaagaatatcaagtgtttgaaaatcatttgcatttatcactgttatctgagtgtagagcttggaaaccataaaatatcaaaccttatgcgagggtatcaaaatgatccccaaatatatatatatatgtgtatgtatatatatatatatatatatatatatgctatatatacatatatatataaatacaaaatatgtacatatatagcatatatacacatatgtgtatatatatatatatttggatgggaataaggacattgcagccaaatggtttgtagctcaatgtataagagggtttttgtttgtttgttttggtcatgaatgtttctgcttatg

SEQ ID NO: 25749 - DNA, 110 bp, Homo sapiens
  DISD22_0006890
  Located on chromosome X
  Distance between a terminus base of telomere on chromosomal short arm and 5'-terminus of this base sequence : 14477615
  Distance between 3'-terminus of neighbour sequence of sequence listing upward to telomere on chrosomal short arm and 5'-terminus of this base sequence : 119574
tgtgagacaaacagacagaatgatagagagagagagagagagagtgattctgtttttccttttcttctttttctattttttttttttttttggccaggaactcagagctc

SEQ ID NO: 25750 - DNA, 139 bp, Homo sapiens
  DISD22_0006893
  Located on chromosome X
  Distance between a terminus base of telomere on chromosomal short arm and 5'-terminus of this base sequence : 14548207
  Distance between 3'-terminus of neighbour sequence of sequence listing upward to telomere on chrosomal short arm and 5'-terminus of this base sequence : 70482
gcaatttgcaatacagatggggaagagatagacatcaaagggtgagtattatgagctacacacacacacacacacacacacacacacacacaaaaagtttactaaaatagatcaatgtctcctattgagatgggagcaa

SEQ ID NO: 25751 - DNA, 140 bp, Homo sapiens
  DISD22_0006897
  Located on chromosome X
  Distance between a terminus base of telomere on chromosomal short arm and 5'-terminus of this base sequence : 14625118
  Distance between 3'-terminus of neighbour sequence of sequence listing upward to telomere on chrosomal short arm and 5'-terminus of this base sequence : 76772
agttcccataatagatgtatccagtatatagaacaatagctaaatactcagagaggtatggcgagagagagagagagagagagagagagagagagagagagagagagagagagagaatgaatgacaaccagcttgataat

SEQ ID NO: 25752 - DNA, 213 bp, Homo sapiens
  AC005296.1_26919
  Located on chromosome X
  Distance between a terminus base of telomere on chromosomal short arm and 5'-terminus of this base sequence : 14705363
  Distance between 3'-terminus of neighbour sequence of sequence listing upward to telomere on chrosomal short arm and 5'-terminus of this base sequence : 80105
tatggcctcgtgataatgtaagttaatgcttaataagctcccctttgtgtgtgtgtgtgtgtgtgtgtgtgtgtgtgtatacacacacacatatatacgtacatatatatatatgtgtgtgtgtatatatatatatattagttctgtcactctaagagaaccctgactaatacaacaactgagcaggatatattaatatcagtgctgagccac

SEQ ID NO: 25753 - DNA, 269 bp, Homo sapiens
  AC005296.1_14597
  Located on chromosome X
  Distance between a terminus base of telomere on chromosomal short arm and 5'-terminus of this base sequence : 14717573
  Distance between 3'-terminus of neighbour sequence of sequence listing upward to telomere on chrosomal short arm and 5'-terminus of this base sequence : 11997
tgctttctaaactcatccaaagactctatcattaatcctttttccatcagtccaatggagtaggcatgcaaaggcatcttattacagtagagattggaggaagaaggtccagaaaggattcagagttatattgtagtcaatatattgtgatatatgcattctctctctctctctctctctctctctctctgtgtgtgtgtgtgtgtgtgtgcgtgtgtgtagtagtagtagaagtagtagtaaattagtgatagaatgattgaaggcac

SEQ ID NO: 25754 - DNA, 286 bp, Homo sapiens
  chrX.fa.O7frz.22602925
  Located on chromosome X
  Distance between a terminus base of telomere on chromosomal short arm and 5'-terminus of this base sequence : 14965280
  Distance between 3'-terminus of neighbour sequence of sequence listing upward to telomere on chrosomal short arm and 5'-terminus of this base sequence : 247438
ccacctttatgttcatgtgtacccaatgtttagctcccacttataagtgagaacatgtggtatttggttttctgttcctgcattaatctgcttagcatgatggcctccagctgcatccgtgttgctgcaaagaacatgatctcattcttttttatggctgcatactatatattccatggtgtgtgtgtgtgtgtgtgtgtgtgtgtgtgtgtgtgtgtgtgtatcacattttctttatccagtccattgttgatgggcacctaggttgattccatgtctatcatga

SEQ ID NO: 25755 - DNA, 391 bp, Homo sapiens
  chrX.fa.O7frz.22741499
  Located on chromosome X
  Distance between a terminus base of telomere on chromosomal short arm and 5'-terminus of this base sequence : 14999780
  Distance between 3'-terminus of neighbour sequence of sequence listing upward to telomere on chrosomal short arm and 5'-terminus of this base sequence : 34214
agaacctctgaaagttcttgagcagcttaacaattgcaagttcttcttaggttaaatgttttatatatatatatatatatatatatatatacatatacataaataaatgagtgggggctgtatatacacgtaaaatgagtgcacatattcatatacacttgcaggatatgacactaatttctcatatctaatcttattaaactgaacttgcatattctcaattttacttctgtgtatttttggggcaacttcaaaaatttcattcagtttcagtatatgtaaattgcacaaaactatgattcaatcctgttggggataattagagaaagatgaagctgcagttgagaataggaaaggaaggtaaaagctaatgttggaacagaaataaaga

SEQ ID NO: 25756 - DNA, 231 bp, Homo sapiens
  AC004655.1_2244
  Located on chromosome X
  Distance between a terminus base of telomere on chromosomal short arm and 5'-terminus of this base sequence : 15392780
  Distance between 3'-terminus of neighbour sequence of sequence listing upward to telomere on chrosomal short arm and 5'-terminus of this base sequence : 392609
ggcatgttattccttctctaaatattggcacacgtgtgtgtgtgagtgtgtgtgtgtgtgtgtgtgtgtgtatatatatatcaaattctagtgtttgccttttgggaataatcaaataaatatgaaaaacagaaatagttatctttagtagataccatgactaaacttttcctatgtatttaaagatagaaagggggcatatattattaaaaagtaattggtctggaggca

SEQ ID NO: 25757 - DNA, 242 bp, Homo sapiens
  DXS8027
  Located on chromosome X
  Distance between a terminus base of telomere on chromosomal short arm and 5'-terminus of this base sequence : 15473764
  Distance between 3'-terminus of neighbour sequence of sequence listing upward to telomere on chrosomal short arm and 5'-terminus of this base sequence : 80753
agctgctgtactaataacataggcacaagcgtgtgtgtgtgtgtgtgtgtgtgtgtgtgtgtgtgtgtgtgtgcacatgtgcatgtatatatctataggtacataagataaactgtctaaacggatggatgtagaattaatcaactacaaccttttacaaaatacccttttgtggctttaatagaattaccatgactaatgcaaaatttctcttttctattttttccaagacagcgtctcac

SEQ ID NO: 25758 - DNA, 210 bp, Homo sapiens
  AC004552.1_56252
  Located on chromosome X
  Distance between a terminus base of telomere on chromosomal short arm and 5'-terminus of this base sequence : 15591420
  Distance between 3'-terminus of neighbour sequence of sequence listing upward to telomere on chrosomal short arm and 5'-terminus of this base sequence : 117414
gtcaatgaggattcacgttaagttttaaggccatcacacccataattccttgcctgggccttgagatgtagccatctgcagaagaggggtgtgtatatgtgtgtgtgtgtgtgtgtgtgtgtgtgtgtgtgtgtgtgtgttttgggcagaatcacaaaaccagctatgggcaggagaaatgatgcaaagtctgagaaccaggttaggaat

SEQ ID NO: 25759 - DNA, 109 bp, Homo sapiens
  DXS8099
  Located on chromosome X
  Distance between a terminus base of telomere on chromosomal short arm and 5'-terminus of this base sequence : 15591476
  Distance between 3'-terminus of neighbour sequence of sequence listing upward to telomere on chrosomal short arm and 5'-terminus of this base sequence : -154
ggccttgagatgtagccatctgcagaagaggggtgtgtatatgtgtgtgtgtgtgtgtgtgtgtgtgtgtgtgtgtgtgtgtgttttgggcagaatcacaaaaccagct

SEQ ID NO: 25760 - DNA, 278 bp, Homo sapiens
  AC004552.1_54420
  Located on chromosome X
  Distance between a terminus base of telomere on chromosomal short arm and 5'-terminus of this base sequence : 15593287
  Distance between 3'-terminus of neighbour sequence of sequence listing upward to telomere on chrosomal short arm and 5'-terminus of this base sequence : 1702
ataattgtggcagtagctgactgatacataaggaatacaggcataagcagcaactgacaataagtatctaatggtgtgtgtgtgtgtgtgtgtgtgtgtgtgtgtaggcaccttgaagggggtttcagcacacatctttcaccatgatgagatgcaacacttcttccacagcatcatcctcacacagccaaaaggaccatgcatctacatgcataccaataccaagggaatttctttcgcttttttttttttaactaaacagtaggacagctgtttct

SEQ ID NO: 25761 - DNA, 472 bp, Homo sapiens
  chrX.fa.O7frz.21588753
  Located on chromosome X
  Distance between a terminus base of telomere on chromosomal short arm and 5'-terminus of this base sequence : 15652592
  Distance between 3'-terminus of neighbour sequence of sequence listing upward to telomere on chrosomal short arm and 5'-terminus of this base sequence : 59027
ctacttccaataaatgtttctgacaatgaagcatattattattctgcctattgacaatggattttattattattattattattattatttttgtagagacggagtctcgctctctcccccaggctggagtgcagtggcgcgatctcggctcactgcaacctctgcctcccgggttcaagcaattctcctgccttatcctcccgagtagctgggactacaggcgcacaccgccacgcccggctgatttcttttgtattttagtagagatggggtttcaccgtgttgcccaggctcgtctcgaactcctgagctcaggcaatccgcctgcctcagcctcccaaagtgctaggattacaggcgtgagccaccgcacccggctggattttatgatttattattcatttttatttttgagacagggtctcctctgttgcccaggctggagtgcagtggcttgattatggctcactgc

SEQ ID NO: 25762 - DNA, 470 bp, Homo sapiens
  AC002404.1_35877
  Located on chromosome X
  Distance between a terminus base of telomere on chromosomal short arm and 5'-terminus of this base sequence : 15831573
  Distance between 3'-terminus of neighbour sequence of sequence listing upward to telomere on chrosomal short arm and 5'-terminus of this base sequence : 178509
atagtgaccacgaagtactgcttataaaatatttatatgaagactatttcttgattttacttctaggacattcttctaagtttttttgttgttgttttgagacagggtctcactctgtaacccaggctgtaaccttcacctcccaggctcatgtgatcctcccacctcagcctcctgagtagctgggactacaggcgcatgccaccatgcctggcgtgtgtgtgtgtgtgtgtgtgtgtgtgtgtgtgtgtgtgtgtgtgtgtgtattttttttttttttggtagagatgggggtcttgccatggtgcccagcctggtctcaaactcctggtctcaagtgatccacccaccttggcctcccaaagtgctgggattacaggcatgatccactgcacctggctggttcttttaaggttttagtattagaagatctttaatataagagtgcttttaccttatggcttagcaaa

SEQ ID NO: 25763 - DNA, 237 bp, Homo sapiens
  DXS1195
  Located on chromosome X
  Distance between a terminus base of telomere on chromosomal short arm and 5'-terminus of this base sequence : 16033860
  Distance between 3'-terminus of neighbour sequence of sequence listing upward to telomere on chrosomal short arm and 5'-terminus of this base sequence : 201817
tgcaaatggacccaagcatttataccctcatgtgcacacatgcccctcctctgccaataaatattcttgaaaggggatttaacttacaacacacacacacgcgcacacacacacacacacacacacacacacacacacgaagaaaacactgaccatctttgttaccaatgtgttattttcattagattgaggagtgtacaggaggggagagatgtttcatttgtgcctgtgtgatat

SEQ ID NO: 25764 - DNA, 190 bp, Homo sapiens
  Z93022.1_32478
  Located on chromosome X
  Distance between a terminus base of telomere on chromosomal short arm and 5'-terminus of this base sequence : 16059092
  Distance between 3'-terminus of neighbour sequence of sequence listing upward to telomere on chrosomal short arm and 5'-terminus of this base sequence : 24995
catctttggactattggacctgcattgatcccaggatgaaagagcccaaggtatctgagtttgcgaacacacacacacacacacacacacacacacacacacacacacacacactttagccaaagactgatgggtacaagagcccagctgccttacctcaaattgagacaactttgaggtgtaaactcac

SEQ ID NO: 25765 - DNA, 206 bp, Homo sapiens
  DXS6747
  Located on chromosome X
  Distance between a terminus base of telomere on chromosomal short arm and 5'-terminus of this base sequence : 16195594
  Distance between 3'-terminus of neighbour sequence of sequence listing upward to telomere on chrosomal short arm and 5'-terminus of this base sequence : 136312
ggcctttggtgacaggattaagagtggctttttgttgttcttttagacttttttgaatgactgtgggtgtgtgtgtgtgtgtgtgtgtgagagagagagagagagagagagacagagaattagtctgttctcacactgctataaagaaatacctgagactgggtaatttataaagagaagaggtttaattggctcatggttctgca

SEQ ID NO: 25766 - DNA, 444 bp, Homo sapiens
  Z93929.1_107017
  Located on chromosome X
  Distance between a terminus base of telomere on chromosomal short arm and 5'-terminus of this base sequence : 16476259
  Distance between 3'-terminus of neighbour sequence of sequence listing upward to telomere on chrosomal short arm and 5'-terminus of this base sequence : 280459
cacctattccttgcagtttaaagcttcctcctctggtacgggcttggattggtttttattttgtggattgcagttgtggaagcctttgaaaatctctccaaccacttgcaagtccagaaatgccttgaagagtgtcttgtatccaggatatagctatatatctgctatgcagtggaagagtccctcagagcactcccccgacccccaacacacacacacacacacacacacacacacacacacacacacacacacacaccccactatattgctagaaggagaaggcttattgttaaattttgaaacacactgttttagaggaaatcgggttttttaaaatgccattattcattgttgcactgaatatgccaaatatacaagttgctttcttctttagtcactatttatcattcttattgttgagaatggctatggacctcaaga

SEQ ID NO: 25767 - DNA, 245 bp, Homo sapiens
  AL096763.14_33801
  Located on chromosome X
  Distance between a terminus base of telomere on chromosomal short arm and 5'-terminus of this base sequence : 16712333
  Distance between 3'-terminus of neighbour sequence of sequence listing upward to telomere on chrosomal short arm and 5'-terminus of this base sequence : 235630
cttgtggaataaagctgcatagtactaaacacacacacacacacacacacacacacacacacaaataaatacaagtaaaatgggacatctctataagatctgtggcttgtataaatgtgaatatgctggttgtaatatttgttgttttttgctaaatataattattgggggaaattaggtaaagggtagtcaggatttttctgtcttctttcttatacctgtgtatgatttctgaactacctcaa

SEQ ID NO: 25768 - DNA, 293 bp, Homo sapiens
  chrX.fa.O7frz.16282557
  Located on chromosome X
  Distance between a terminus base of telomere on chromosomal short arm and 5'-terminus of this base sequence : 16830268
  Distance between 3'-terminus of neighbour sequence of sequence listing upward to telomere on chrosomal short arm and 5'-terminus of this base sequence : 117690
tttaaagccagataattagatgagctcaccaggggattaatacaggttagggtttctcagccttggcactactgacgtttggagccagaatgggtgtgcgtgtgtgtgtgtgtgtgtgtgtgtgtgtgcgcgtgtgtgtgtgtatgtgtattctgtgcattgtaggatgtgaagcagcactcatatctaggttacaaagcatcatttcactactctcttctcagcatccaaaaccaacttattcccttgtctttgccctgttattccaaaccttagttcaatatcaccatcca

SEQ ID NO: 25769 - DNA, 338 bp, Homo sapiens
  DISO7_00050819
  Located on chromosome X
  Distance between a terminus base of telomere on chromosomal short arm and 5'-terminus of this base sequence : 17070816
  Distance between 3'-terminus of neighbour sequence of sequence listing upward to telomere on chrosomal short arm and 5'-terminus of this base sequence : 240255
atcactgacttggcttgaaggcagttgtgtgtgtgtgcgtgtgtgtgtgtgtgtgtgtgtgtgtgtgtgtgtgtgttttggagacagagtctcactctgtctgcccggtggctggagtgcagtggcgtgatcttggctcactgcaacctccgcctcctggattcaagcgattctcacgtctcagcctcccgagtagctgggactacaggcgtgtgctaccacgctgggctaatttttttgtatttttagtagagatggggttttaccatgttggccaggctgttctcgaactcctaacctcaagtgatccgcctggaaggcagtcattatctgtacaa

SEQ ID NO: 25770 - DNA, 396 bp, Homo sapiens
  DISO7_00050824
  Located on chromosome X
  Distance between a terminus base of telomere on chromosomal short arm and 5'-terminus of this base sequence : 17217418
  Distance between 3'-terminus of neighbour sequence of sequence listing upward to telomere on chrosomal short arm and 5'-terminus of this base sequence : 146264
gcccattacttgagtgcatctccaggccaggaacagagcagggctggggcagagagctgtgctcacggccagtgcattgtctcccagattcgtggctctgggcttgccttcccggctgaaaggcaaagcagcctggccctgttctagttatttctttgtgtatatatgtttgtttatttatttaagcaagagctctctctgcagagtggggtgtgtgtgtgtgtgtgtgtgtgtgtgtgtgtgtgtgtgtgtttgtgtggggtgcttcagagagggctgaaattgtacctcttttctttcagccctctgcatttccccagagagaaggtttttttctcgtcttcatttcctttgaaacacctggggtgaggaaaaacctctacattggccaagcag

SEQ ID NO: 25771 - DNA, 268 bp, Homo sapiens
  DXS999
  Located on chromosome X
  Distance between a terminus base of telomere on chromosomal short arm and 5'-terminus of this base sequence : 17334364
  Distance between 3'-terminus of neighbour sequence of sequence listing upward to telomere on chrosomal short arm and 5'-terminus of this base sequence : 116550
cagtttcacaatctctgccttttgattatttaatccattctcatatgatgttattattgatatgcctggatttacatctatcattttgccatgtgtgtgtgtgtgtgtgtgtgtgtgtgtgtgtgtgtacatgcacaaaaaatacaaagaggaacaaaacagtaattatatgtatgtgtgtgactgttttgttcctctgttcctcctttatttgaaaatttatttttgtaaatggtctgaggtagaggttgaagtctaggttgttagc

SEQ ID NO: 25772 - DNA, 241 bp, Homo sapiens
  DXS7163
  Located on chromosome X
  Distance between a terminus base of telomere on chromosomal short arm and 5'-terminus of this base sequence : 17650621
  Distance between 3'-terminus of neighbour sequence of sequence listing upward to telomere on chrosomal short arm and 5'-terminus of this base sequence : 315989
agctttggtgcagtttttggatcccattttgtgtgtgtgtgtgtgtgtgtgtgtgtgtgtgtgtgttttaagtatgatgtaataaatgccttttggttttttcctaaaatttcatccagaatcataaattctagaatgatttggatttaaagaaatgccaatagaatcgattttaaattggattttaaatcaaacaggatccaaatgagattttcttaaaagttagtcgaatataatggtc

SEQ ID NO: 25773 - DNA, 115 bp, Homo sapiens
  DISD22_0006906
  Located on chromosome X
  Distance between a terminus base of telomere on chromosomal short arm and 5'-terminus of this base sequence : 17829381
  Distance between 3'-terminus of neighbour sequence of sequence listing upward to telomere on chrosomal short arm and 5'-terminus of this base sequence : 178519
tttcattcaattctaactgcttcctctctctctctctctctctctctctctctctctctctctctctctctctctctctctctcttcctttcatacacacaggaggctctgtcct

SEQ ID NO: 25774 - DNA, 355 bp, Homo sapiens
  AC025563.2_42440
  Located on chromosome X
  Distance between a terminus base of telomere on chromosomal short arm and 5'-terminus of this base sequence : 18015632
  Distance between 3'-terminus of neighbour sequence of sequence listing upward to telomere on chrosomal short arm and 5'-terminus of this base sequence : 186136
ctgaggtcaggagtttgaaaccagcctggccaacatggtgaaaccctgtctctactaaaaatacaaaacttagctgggcgtggtggtgcatgcctgtagtcccagctactcaggaggctgaggcagaattgcttgaacctgaaaggcggaggttgcagtgagccaagatcgcaccactgcattccagcctgggtgacagagcaagactccatttcaaaacaacaacaacaacaacaacaacaacaacaacaacaacaaataccccacaaaaaaccacaatgtgatactacttcatatcccactaggatagctctaattacaatgtcagactataacaagtgttggtgaagatgta

SEQ ID NO: 25775 - DNA, 228 bp, Homo sapiens
  DISD22_0006915
  Located on chromosome X
  Distance between a terminus base of telomere on chromosomal short arm and 5'-terminus of this base sequence : 18130345
  Distance between 3'-terminus of neighbour sequence of sequence listing upward to telomere on chrosomal short arm and 5'-terminus of this base sequence : 114358
ggtgggagaggctgttagattttgttccctggtgtgtgtgtgtgtgtgtgtgtgtgtgtgtgtgtgtgtgtgtgtgtgtgtgtgtgtgtgtgtgtgacagagggaaagaaagagagagagacggagagaccgagagacacagagagacacagagagagagagacatggagagacagagagagagagacagacagacacagagagacagacaggcagacttgaggaaga

SEQ ID NO: 25776 - DNA, 288 bp, Homo sapiens
  chrX.fa.O7frz.17756002
  Located on chromosome X
  Distance between a terminus base of telomere on chromosomal short arm and 5'-terminus of this base sequence : 18390609
  Distance between 3'-terminus of neighbour sequence of sequence listing upward to telomere on chrosomal short arm and 5'-terminus of this base sequence : 260036
ggttactgttctacattcaaagaccctgacatggacctctttaatcatatttcacttttctttaaactttaaactcaagggccattaattttgtgaattatatggatgattgttttcaagatgtttgtctctcttcacaaggtagcagtaatttttctgggtgtgttatgttatgttatgttatgttatgttatgttatgttatgttatgttatgttatgttatgttatttagagacagtgtctccttccatagcctaggctggagtgtagtggtatgatcatggctc

SEQ ID NO: 25777 - DNA, 188 bp, Homo sapiens
  Z67664
  Located on chromosome X
  Distance between a terminus base of telomere on chromosomal short arm and 5'-terminus of this base sequence : 18496906
  Distance between 3'-terminus of neighbour sequence of sequence listing upward to telomere on chrosomal short arm and 5'-terminus of this base sequence : 106009
gtgtccatttgttgcctaccatcaaagaaatctgatatttgcataaacctacctccttctctctctaagtcctgaatttaaccacagattatcctgaataaggaacatgacatttgtagctggagaggacacacacacacacacacacacacacacaaggagaagtaaaacttggggaatctaaatca

SEQ ID NO: 25778 - DNA, 122 bp, Homo sapiens
  chrX.fa.O7frz.15048037
  Located on chromosome X
  Distance between a terminus base of telomere on chromosomal short arm and 5'-terminus of this base sequence : 18536581
  Distance between 3'-terminus of neighbour sequence of sequence listing upward to telomere on chrosomal short arm and 5'-terminus of this base sequence : 39487
tagtatccagtgttcagctgagaaatggttatcatttccaaagttggaatataaattttatacacacacacacacacacactcatattcattacatgtgtgtactttctggttgcttcagta

SEQ ID NO: 25779 - DNA, 289 bp, Homo sapiens
  chrX.fa.O7frz.15214711
  Located on chromosome X
  Distance between a terminus base of telomere on chromosomal short arm and 5'-terminus of this base sequence : 18684554
  Distance between 3'-terminus of neighbour sequence of sequence listing upward to telomere on chrosomal short arm and 5'-terminus of this base sequence : 147851
aacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacac

SEQ ID NO: 25780 - DNA, 129 bp, Homo sapiens
  DXS8036
  Located on chromosome X
  Distance between a terminus base of telomere on chromosomal short arm and 5'-terminus of this base sequence : 18684740
  Distance between 3'-terminus of neighbour sequence of sequence listing upward to telomere on chrosomal short arm and 5'-terminus of this base sequence : -103
ctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtat

SEQ ID NO: 25781 - DNA, 175 bp, Homo sapiens
  DISO7_10019166
  Located on chromosome X
  Distance between a terminus base of telomere on chromosomal short arm and 5'-terminus of this base sequence : 18934031
  Distance between 3'-terminus of neighbour sequence of sequence listing upward to telomere on chrosomal short arm and 5'-terminus of this base sequence : 249162
ggaggatggtattcaagtcttcttttaattctcttaatacagaaatctgtatctatactacacacacacacacacacacacacacacacacacacacatttatgtatgtatcccaaacatttcttattataagctatttctaggctatttttagggtgtgctattgtatcttcat

SEQ ID NO: 25782 - DNA, 228 bp, Homo sapiens
  DXS1229
  Located on chromosome X
  Distance between a terminus base of telomere on chromosomal short arm and 5'-terminus of this base sequence : 19001378
  Distance between 3'-terminus of neighbour sequence of sequence listing upward to telomere on chrosomal short arm and 5'-terminus of this base sequence : 67172
tagaatcaacataaggcccacagtttacaattagttgatatgtcttttaagattttgcaatcatctctagcctctaattccttctctctctctctctctctctcacacacacacacacacacacacacacacacacatacagagacacacttttcaaagcaattttgttgaggaaagcatattgtttgtccttagagttttgatagtctgattctgctaattgtatcc

SEQ ID NO: 25783 - DNA, 308 bp, Homo sapiens
  chrX.fa.O7frz.20515609
  Located on chromosome X
  Distance between a terminus base of telomere on chromosomal short arm and 5'-terminus of this base sequence : 19171752
  Distance between 3'-terminus of neighbour sequence of sequence listing upward to telomere on chrosomal short arm and 5'-terminus of this base sequence : 170146
actgccataatcggagtttttctgtctcctctcctctcctttcccctcctctcccttcccctcctttctctctctctctctctctctctctctctctctctctctctcatactttctctgatgtttatgggcattaactcttcctttttgtcaaaatccttaaaaagagcaaattatttgtgcttccatgcaatgttttgcccattaaaccgtgaaccagggtagatgctctggcatatttgaatccctaatgcctgatatactcagcacctggtgcatcttttgtgtttagtaaatgctgactagct

SEQ ID NO: 25784 - DNA, 110 bp, Homo sapiens
  DISD22_0006918
  Located on chromosome X
  Distance between a terminus base of telomere on chromosomal short arm and 5'-terminus of this base sequence : 19334706
  Distance between 3'-terminus of neighbour sequence of sequence listing upward to telomere on chrosomal short arm and 5'-terminus of this base sequence : 162646
gcatttggttcttcttgaccttttgccctagtgcttcctcccatactctctctctctctttctctctctggtagtaagggccagataaaataggctaggaatgtagccca

SEQ ID NO: 25785 - DNA, 143 bp, Homo sapiens
  DISD22_0006919
  Located on chromosome X
  Distance between a terminus base of telomere on chromosomal short arm and 5'-terminus of this base sequence : 19417172
  Distance between 3'-terminus of neighbour sequence of sequence listing upward to telomere on chrosomal short arm and 5'-terminus of this base sequence : 82356
ttcagtgtattcttcactccaagtatacaaaaccaaggattgtgtgtgtgtgtgtgtgtgtgtgtgtgtatgtgtgtgcgtgtgtgtgtgttacgaggtgaggtgggagagaaaagttgtaggggtactgtgctttgcacatc

SEQ ID NO: 25786 - DNA, 448 bp, Homo sapiens
  chrX.fa.O7frz.19672984
  Located on chromosome X
  Distance between a terminus base of telomere on chromosomal short arm and 5'-terminus of this base sequence : 19552611
  Distance between 3'-terminus of neighbour sequence of sequence listing upward to telomere on chrosomal short arm and 5'-terminus of this base sequence : 135296
ggagttgctagatcatacagttactctgtttcacctttcaataaaccgccaaactattgtccacagcagctgcaccgttttacattcccgccagcaatgtacgagggatccaatttctccgcatccttaccaacacttattttctggcttttaaaatgtgtttctttatttactcacatatagccatccttgtggacgtggagtgagatctattgtgatacaaaccgctttttgatttgacagtggttctcttggctttacactggaatctcctgggtatttatttatttatttatttatttatttatttacaatcccaatgcccaggctgtacctggggccaatttcattagacactagggctagccccaggcagtggcagtatgtttaaagctcccaaggtgattccagtgtgcagctgaaattgagaatcgctgtaaagatccta

SEQ ID NO: 25787 - DNA, 460 bp, Homo sapiens
  chrX.fa.O7frz.19793631
  Located on chromosome X
  Distance between a terminus base of telomere on chromosomal short arm and 5'-terminus of this base sequence : 19673163
  Distance between 3'-terminus of neighbour sequence of sequence listing upward to telomere on chrosomal short arm and 5'-terminus of this base sequence : 120104
tctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactgggaggttgcagtgagccgaaatcgctccactgcactccagcctgcgtgacagagcgagactctgtctcaaaataataataataataataataataataataataataataatgtcccctagactatcctcatggaaattacaatctgcatcttatgag

SEQ ID NO: 25788 - DNA, 372 bp, Homo sapiens
  chrX.fa.O7frz.19919459
  Located on chromosome X
  Distance between a terminus base of telomere on chromosomal short arm and 5'-terminus of this base sequence : 19799081
  Distance between 3'-terminus of neighbour sequence of sequence listing upward to telomere on chrosomal short arm and 5'-terminus of this base sequence : 125458
tagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagcct

SEQ ID NO: 25789 - DNA, 103 bp, Homo sapiens
  DISO7_10000375
  Located on chromosome X
  Distance between a terminus base of telomere on chromosomal short arm and 5'-terminus of this base sequence : 19865942
  Distance between 3'-terminus of neighbour sequence of sequence listing upward to telomere on chrosomal short arm and 5'-terminus of this base sequence : 66489
ttatccttctaagtgaactcctttcttattactgagcgtgtgtgtgtgtgtgtgtgtgtgtgtgtgtgtaggataaaattgtaatggccttaaagttgttacc

SEQ ID NO: 25790 - DNA, 175 bp, Homo sapiens
  chrX.fa.O7frz.19229680
  Located on chromosome X
  Distance between a terminus base of telomere on chromosomal short arm and 5'-terminus of this base sequence : 19989014
  Distance between 3'-terminus of neighbour sequence of sequence listing upward to telomere on chrosomal short arm and 5'-terminus of this base sequence : 122969
catctaacctgagagtacatgaagacaaggcagacagaagtttttgtgtggtgtgtgtgtgtgtgtgtgtgtgtgtgtgtgtgtgtgtgtgtgtgtaaaattcagatgtggtaagaaaagtctttaaagaataactgaattattctgaatctcatctttaaatcttgtaggactt

SEQ ID NO: 25791 - DNA, 244 bp, Homo sapiens
  chrX.fa.O7frz.19105789
  Located on chromosome X
  Distance between a terminus base of telomere on chromosomal short arm and 5'-terminus of this base sequence : 20060248
  Distance between 3'-terminus of neighbour sequence of sequence listing upward to telomere on chrosomal short arm and 5'-terminus of this base sequence : 71059
atctccatcctgttcttaaataactaaatgattaatataactggtctttttctttctttctatttattttatttatttatttatttatttatttatttatttatttatttattttttgccaatttggagacttcttttgctttcatctgggattgatttttctattttctagtgcaacccctctggcagccttttttaggtgagccttttgagggcatctgtaataactcgtatttctgacagc

SEQ ID NO: 25792 - DNA, 432 bp, Homo sapiens
  chrX.fa.O7frz.21359229
  Located on chromosome X
  Distance between a terminus base of telomere on chromosomal short arm and 5'-terminus of this base sequence : 20272781
  Distance between 3'-terminus of neighbour sequence of sequence listing upward to telomere on chrosomal short arm and 5'-terminus of this base sequence : 212289
cttctgcagtatctatgtagtcctctactggattttctccttaggtgaagataagattgtcttaactttttttttttttttagtatacttttttcttttttaatatttaacttttttttgtagagatagggtctcactgttgtccaggctggtcttgagctggcctgaagtgatcctcgtgcctcggcctcccagagtgctgggattatagatgtgagccaccgtgcctggccagattgtcttaatttttgtactaagtattctgtgggaccatcatcgaagaggccaaggcttccaaatttcctgagttccttagaggcagcaatactgtttatctgaacactgcatgtgcacacgagcacacacacacacacacacacacacacacacatatatttatgctaggtcatgtactaagtgctcttaccgtac

SEQ ID NO: 25793 - DNA, 101 bp, Homo sapiens
  DISD22_0007035
  Located on chromosome X
  Distance between a terminus base of telomere on chromosomal short arm and 5'-terminus of this base sequence : 20501773
  Distance between 3'-terminus of neighbour sequence of sequence listing upward to telomere on chrosomal short arm and 5'-terminus of this base sequence : 228560
caattagagaaaggaagcggaagctagagagagaaagagagagagagagagagagagagagagagagagagagagtccaaattgtagaatacttctgagag

SEQ ID NO: 25794 - DNA, 143 bp, Homo sapiens
  DXS1052
  Located on chromosome X
  Distance between a terminus base of telomere on chromosomal short arm and 5'-terminus of this base sequence : 20720472
  Distance between 3'-terminus of neighbour sequence of sequence listing upward to telomere on chrosomal short arm and 5'-terminus of this base sequence : 218598
gccatgtgtcaaggctgattacataaacatctattaatcaaaactcgatgatagtgacaaagtgctagacaaacgttaatggaatagaataaaaggcctacacacacacacacacacacacacagagcgagcgagagaggtta

SEQ ID NO: 25795 - DNA, 191 bp, Homo sapiens
  DXS989
  Located on chromosome X
  Distance between a terminus base of telomere on chromosomal short arm and 5'-terminus of this base sequence : 21076027
  Distance between 3'-terminus of neighbour sequence of sequence listing upward to telomere on chrosomal short arm and 5'-terminus of this base sequence : 355412
acataagaaataaaatggctgccattatttgcttgagactggcctcttttcctctatttgcaaaaccgcactttctctctctctctctctctctctctctctctctctctctctctctctctgtgtgtgtgtgtgtgtgtgtgtgtgtgtctgtgtgtagtgggtggggtgagtgggtatatctatcttct

SEQ ID NO: 25796 - DNA, 358 bp, Homo sapiens
  AC004673.1_110766
  Located on chromosome X
  Distance between a terminus base of telomere on chromosomal short arm and 5'-terminus of this base sequence : 21101925
  Distance between 3'-terminus of neighbour sequence of sequence listing upward to telomere on chrosomal short arm and 5'-terminus of this base sequence : 25707
tatgtcctaccatgattccttaatccataaataactaaaagaacttaggaggtttatttattttcccactttagttcaaattaagagctctgccaataatcttgttgtagccctgctgaattgaaagcaacaggcattgtgtgtacacacacacacacacacacacacacacacagaggaatattcagccattaaaaggtataaagcaataggcaaatcctgattgtctctggttcagaaatagtcattcaggacctaccaaatttcatgagggaccagattatttgcctagaaattagactgactgagggaaaattcagcatctagtgtttcaaccttgtacaaccagtgctaaacc

SEQ ID NO: 25797 - DNA, 328 bp, Homo sapiens
  AC004673.1_113039
  Located on chromosome X
  Distance between a terminus base of telomere on chromosomal short arm and 5'-terminus of this base sequence : 21104270
  Distance between 3'-terminus of neighbour sequence of sequence listing upward to telomere on chrosomal short arm and 5'-terminus of this base sequence : 1987
gtataacttggaggcatgttctacactgcctttctctccttctctctctttctctctgtcacacacacacaaacacacacacacacacacacacacacacagaaacatgattgccacaataaagtccacatttcccagccttccttgtagatgaatgtggctatgtgataagtgttcaacaatgaaatgtgaacataagggatatgtatgaattccttctcacttgcttcaaagaaatcatttgccattgatttattttctttcttccttcctgcaagcaaaaatatgggtgttccaaagatgtagcttcaactatgcagatgaggat

SEQ ID NO: 25798 - DNA, 322 bp, Homo sapiens
  chrX.fa.O7frz.23908585
  Located on chromosome X
  Distance between a terminus base of telomere on chromosomal short arm and 5'-terminus of this base sequence : 21184437
  Distance between 3'-terminus of neighbour sequence of sequence listing upward to telomere on chrosomal short arm and 5'-terminus of this base sequence : 79839
ctgaacttcacctgttacctatctcgttgggacaagaagtctaattcctaggcttaggattcaactccaaatgtgcagagaaaaggaaaaaaaaaaaccacacacacacacacacacacacacacacacacacacacacacacaagtgaagaaatcaatcaaggtcacaaagccattccaagctgttctgtgtctacgacccatattttttgattttccactcctcagaagatcaagaggtaatgaggaatttctcataataaattattacgagtctctagggtgggtgctctgagggctcatggcttagacttatagacag

SEQ ID NO: 25799 - DNA, 417 bp, Homo sapiens
  chrX.fa.O7frz.23828690
  Located on chromosome X
  Distance between a terminus base of telomere on chromosomal short arm and 5'-terminus of this base sequence : 21273851
  Distance between 3'-terminus of neighbour sequence of sequence listing upward to telomere on chrosomal short arm and 5'-terminus of this base sequence : 89092
caagactagctgaagttgatagagtcagaatagctttcctctggggatagtggggttattgactgggaaaggacatgagagggccctctgggtactgtaaatatgctatgtcttgatctgagcaatgtttatgtgtatctatatataaaaattcattaaatatgcacttaacatttacacattgtactgtatataaatcataccttaattatgaagagtgtagacacacacacacacacacacacacacacacacacacacacacaccgtattcagtgaccctgtcagtaaggtggaagagttagactaccatcccagcagtacagaacatccaacaatggtgagtaccaagaagaagaaaggcagcctgaatcttggcagacaaatcagcccagttttagtgacatccaactcact

SEQ ID NO: 25800 - DNA, 250 bp, Homo sapiens
  AC005867.1_142401
  Located on chromosome X
  Distance between a terminus base of telomere on chromosomal short arm and 5'-terminus of this base sequence : 21376532
  Distance between 3'-terminus of neighbour sequence of sequence listing upward to telomere on chrosomal short arm and 5'-terminus of this base sequence : 102264
gaagtattggttaaaggttgaattaaaagtaggcttttactgccctttaaatgtttggcatcagttctgggagccaggaaaaaataaataaataaataaataaataaataaataaataaataaataaatgtgtggctgacagactccatggtggccttcatgatcctgcctcctggtgttcatgcctttgtgtgataccttcccctcgagtggtgacaggacctgtgacttgattctgaccgatatggta

SEQ ID NO: 25801 - DNA, 318 bp, Homo sapiens
  AC005867.1_65529
  Located on chromosome X
  Distance between a terminus base of telomere on chromosomal short arm and 5'-terminus of this base sequence : 21417830
  Distance between 3'-terminus of neighbour sequence of sequence listing upward to telomere on chrosomal short arm and 5'-terminus of this base sequence : 41048
ggtgacagacgcctgtaatcccagctacttgggaggctgaggcaggagaatcacttgaacccgggaggtggaggttgcagtgagctgagatcatgccactgcattccagcctgggcaacagagcgagactccatcaagaaagaaagaagaaagaaagagggaaggaaagaaagaaagtagaaagaaaaaaagaaagaaagaaagaaagaaagaaagaaagaaagaaagaaagaaagagagaaagaaagagagagagaaagaaagagggagggagggagggaggagaaagaaagagaaaacaaatctaaatgtccgtca

SEQ ID NO: 25802 - DNA, 252 bp, Homo sapiens
  chrX.fa.O7frz.23609873
  Located on chromosome X
  Distance between a terminus base of telomere on chromosomal short arm and 5'-terminus of this base sequence : 21583064
  Distance between 3'-terminus of neighbour sequence of sequence listing upward to telomere on chrosomal short arm and 5'-terminus of this base sequence : 164916
gtccaagctagccttattgtactttctagtcatggcatcttcagcccctggttcttgacttcacttattttgcaaacttaagggaatacaaggctggctttctttctttctttctttctttctttctttctttctttctttctttctttctttctttctttttccttccttccttccttcctctttctctctttctgtttggcttagagcaacacaattttattatcttaacaattctgaaggttagaattc

SEQ ID NO: 25803 - DNA, 139 bp, Homo sapiens
  DXS8058
  Located on chromosome X
  Distance between a terminus base of telomere on chromosomal short arm and 5'-terminus of this base sequence : 22088957
  Distance between 3'-terminus of neighbour sequence of sequence listing upward to telomere on chrosomal short arm and 5'-terminus of this base sequence : 505641
ctccttgttggtggtaagataaattggtaaaagattcctggaggattatttgaagatatatatatatattcttcatacacacacacacacacacacacacacatatatatatatacaccattcaaccattcaaatatgc

SEQ ID NO: 25804 - DNA, 118 bp, Homo sapiens
  DISD22_0007059
  Located on chromosome X
  Distance between a terminus base of telomere on chromosomal short arm and 5'-terminus of this base sequence : 22206584
  Distance between 3'-terminus of neighbour sequence of sequence listing upward to telomere on chrosomal short arm and 5'-terminus of this base sequence : 117488
ctaattccattcagaagtttatgctaaaaacatgaatggcattcttcattcggaatgtactcacactattcacacacacacacacacacacacacacacccttaattaccaaggtgcg

SEQ ID NO: 25805 - DNA, 210 bp, Homo sapiens
  DISD22_0007066
  Located on chromosome X
  Distance between a terminus base of telomere on chromosomal short arm and 5'-terminus of this base sequence : 22470180
  Distance between 3'-terminus of neighbour sequence of sequence listing upward to telomere on chrosomal short arm and 5'-terminus of this base sequence : 263478
accctcagtatggtacactgtcttattaaatgtagcattttttttaattcaagtttttcaggtcttcttgacaaaatatagagaaaggtgtgtgtgtgtgtgtgtgtgtgtgtgtgtgtgtgtgtgtgtgtttatatcatgtctatagtttttgtggtcctgctttgctttctggtgtggaaaataagtttccgaaacttggtggtgaga

SEQ ID NO: 25806 - DNA, 126 bp, Homo sapiens
  DISD22_0007069
  Located on chromosome X
  Distance between a terminus base of telomere on chromosomal short arm and 5'-terminus of this base sequence : 22557832
  Distance between 3'-terminus of neighbour sequence of sequence listing upward to telomere on chrosomal short arm and 5'-terminus of this base sequence : 87442
tctagcctcaaattagcatctcatatatctcatctcatcactctctcatctcttgcttttgccattacacacacacacacacacacacacacactcatacactttccatctcctaacagaaatcgt

SEQ ID NO: 25807 - DNA, 170 bp, Homo sapiens
  DISD22_0007080
  Located on chromosome X
  Distance between a terminus base of telomere on chromosomal short arm and 5'-terminus of this base sequence : 22971255
  Distance between 3'-terminus of neighbour sequence of sequence listing upward to telomere on chrosomal short arm and 5'-terminus of this base sequence : 413297
tcaggatctatggtttggtgcctgccatggactgaatgtttgtgtcctccccaaattcttatgttgataactaatcccaaagtgatgatctctctctctctctctctgtgcgtgtgtgtgtgtgtgtgtgtgtgtatttgtgtgtgtgtgagttggagcatgccttctac

SEQ ID NO: 25808 - DNA, 225 bp, Homo sapiens
  DISD22_0007083
  Located on chromosome X
  Distance between a terminus base of telomere on chromosomal short arm and 5'-terminus of this base sequence : 23063497
  Distance between 3'-terminus of neighbour sequence of sequence listing upward to telomere on chrosomal short arm and 5'-terminus of this base sequence : 92072
aactaagtgccttgttattggtcttttaaattgtaatagtatatatatatatatatatatatatatataaactattatatttatggaaatatatatatgctatatataaaaactattatatatatttatggaaatatatatatttctataaattgcagataaagaagggcagtgtacaatttgtttattgtttcaaaaaatctatgtgtcaattatgcatgaatc

SEQ ID NO: 25809 - DNA, 281 bp, Homo sapiens
  DXS1202
  Located on chromosome X
  Distance between a terminus base of telomere on chromosomal short arm and 5'-terminus of this base sequence : 23191134
  Distance between 3'-terminus of neighbour sequence of sequence listing upward to telomere on chrosomal short arm and 5'-terminus of this base sequence : 127412
cccagcacaggtgtcagaatagaagtagggtgaggaggtaagccacatggaaaacagcactgtgaggagtttgagagcaagaacaggatgcggagggtatccacatgaaggtaacgtttgttgtgtgtgtgtatacatgcatatatatacacatacacacacatcccgcatatatatcatatattatatgtgcatgtggtgtatatatcttacacaaacatgcacacacacacacacacacacacacacacacacacacacacactttggagcaacaaccc

SEQ ID NO: 25810 - DNA, 262 bp, Homo sapiens
  DXS7102
  Located on chromosome X
  Distance between a terminus base of telomere on chromosomal short arm and 5'-terminus of this base sequence : 23398886
  Distance between 3'-terminus of neighbour sequence of sequence listing upward to telomere on chrosomal short arm and 5'-terminus of this base sequence : 207471
taggctctactggatctccaactttcttacaagatcttgagacttctcacccttcataacataatcatcatgtgagccactttcttataataatatctccttctctttccccctccatctctcccgctctctctttaaacacacacacacacacacacacacacacacacacacacaaatatatgcatcctattttttctgtttctctggagaagcctgattaatataccacagaataatctgcacatgaatatttatagca

SEQ ID NO: 25811 - DNA, 388 bp, Homo sapiens
  AC005345.1_39476
  Located on chromosome X
  Distance between a terminus base of telomere on chromosomal short arm and 5'-terminus of this base sequence : 23440176
  Distance between 3'-terminus of neighbour sequence of sequence listing upward to telomere on chrosomal short arm and 5'-terminus of this base sequence : 41028
ttgaactcttaatggctcataaagtttgcttcccaaatgctttgattacttaccttggaataaataagctggaagtatcactaaaggtaatacatatataaaatcttcacatggactttgaaactgtgtgtctgtatgaattacaaattatcaaattttatacccgtattcagtaataaaggacaaaataatcgatagaaaataactgtctcaattacaggggttattgctctcagttgcgcacgtgtgtgtgtgtgtgtgtgtgtgtgtgtatgtgtgtgcatgcgtgtgtatgtgtgtgcatgtgtgtgtttctgtctgcctgcctgtaagtctttgtctctgtttgtgtctgagtatccctaccatgcaacttctaggcaagaat

SEQ ID NO: 25812 - DNA, 170 bp, Homo sapiens
  DXS1048
  Located on chromosome X
  Distance between a terminus base of telomere on chromosomal short arm and 5'-terminus of this base sequence : 23440395
  Distance between 3'-terminus of neighbour sequence of sequence listing upward to telomere on chrosomal short arm and 5'-terminus of this base sequence : -169
ggggttattgctctcagttgcgcacgtgtgtgtgtgtgtgtgtgtgtgtgtgtatgtgtgtgcatgcgtgtgtatgtgtgtgcatgtgtgtgtttctgtctgcctgcctgtaagtctttgtctctgtttgtgtctgagtatccctaccatgcaacttctaggcaagaatt

SEQ ID NO: 25813 - DNA, 467 bp, Homo sapiens
  chrX.fa.O7frz.20959576
  Located on chromosome X
  Distance between a terminus base of telomere on chromosomal short arm and 5'-terminus of this base sequence : 23552123
  Distance between 3'-terminus of neighbour sequence of sequence listing upward to telomere on chrosomal short arm and 5'-terminus of this base sequence : 111558
gccttagaataagttggtagattccaccccactgtctttcccagcttgcatctttgattaaggtttcaagctgtgattgtcaactggacatccatatatatatatatatatatatggagaaatctggaggaatgtaagaattcctgaaattatcttcctttttttaattttcttgatttctacttttccctttcttgatttctacttttccttgacttttattgtccccatcctatagtcttgacttgaccgtggcttctttcatggcttgtatgctttgactttatgatagatctgatttatttattctattctaatcttatgctaataatggaaaaatgactctgtagtctccaacccctaccatctccttggttgtacattcttttatgggtggcctagctgattagtggttttattctggtcatagacagttaaagaaggtgagtaattgcttaacagaaatt

SEQ ID NO: 25814 - DNA, 287 bp, Homo sapiens
  DISO7_10000378
  Located on chromosome X
  Distance between a terminus base of telomere on chromosomal short arm and 5'-terminus of this base sequence : 23897218
  Distance between 3'-terminus of neighbour sequence of sequence listing upward to telomere on chrosomal short arm and 5'-terminus of this base sequence : 344628
aacctcagcatatcctagcctatattaatatttttacagctatatagaactataattagcaatatactgcatatatttaaagtgaataatttgataacttttgacatatatatatatatatatatatacactcatgaaataatcaccacagttaagatagtgaatatatctatcatctccaccaatttcctcctggacttttgaaatccatccttatcttctcctcctccctgtgcccctgcatcacttcaagctactactgatttgctttgtggcatgatagatta

SEQ ID NO: 25815 - DNA, 245 bp, Homo sapiens
  DISO7_10000379
  Located on chromosome X
  Distance between a terminus base of telomere on chromosomal short arm and 5'-terminus of this base sequence : 23970880
  Distance between 3'-terminus of neighbour sequence of sequence listing upward to telomere on chrosomal short arm and 5'-terminus of this base sequence : 73375
tatgcttcaagaatcagtatgaagaaaagggagaaatatcacacttaaagcagaaatgaatcctacccttcactttcctttcctttcctttcctttcctttcctttcctttcctttcctttcctttcctttcctttcctttcctttcctttcctttcctttctttcctccttcctccctccctccctccctccttttttttttcactaaaaccactccgctttgggatatccctgcatcaactat

SEQ ID NO: 25816 - DNA, 240 bp, Homo sapiens
  DXS1061
  Located on chromosome X
  Distance between a terminus base of telomere on chromosomal short arm and 5'-terminus of this base sequence : 24029560
  Distance between 3'-terminus of neighbour sequence of sequence listing upward to telomere on chrosomal short arm and 5'-terminus of this base sequence : 58435
acgatagatcattatgatgtgttatgaattggcaaaaatattttaaggaagtcatttgtgtgtgtgtgtgtgtgtgtgtgtgtgtgtgtgtgtgtgtgtgtgaaagagagagagagagagagaaagggagagttatctgtcccaaagttacttacttatacttgtaaataatcttgaacataatagagttatatcaggataaaataactgctaatgactcaatcagaagggtttacaaat

SEQ ID NO: 25817 - DNA, 348 bp, Homo sapiens
  HUMUT5961
  Located on chromosome X
  Distance between a terminus base of telomere on chromosomal short arm and 5'-terminus of this base sequence : 24102846
  Distance between 3'-terminus of neighbour sequence of sequence listing upward to telomere on chrosomal short arm and 5'-terminus of this base sequence : 73046
gatcctggttgtggtattgtactatagggctttttaatgatgaaaaacacataaaataaactgtaccttcttaatcattcctaagtgtgttagttgagtagtgttaaatatattcacatcattgagcaaacaatctccagaactttttcatcttgcaaatctaacactctgtaccattagaaaactccccatttccccatttcccatccttcttgcccttggcaaacaccattattctttctttctttccttccttccttccttccttccttccttccttccttccttctttctttctttctttctttctttctttcttctttccaatgaagtctcactctgtcgccc

SEQ ID NO: 25818 - DNA, 142 bp, Homo sapiens
  DXS8047
  Located on chromosome X
  Distance between a terminus base of telomere on chromosomal short arm and 5'-terminus of this base sequence : 24305985
  Distance between 3'-terminus of neighbour sequence of sequence listing upward to telomere on chrosomal short arm and 5'-terminus of this base sequence : 202791
ccaaagttttgttgcatccctttgtgtgtgtttcattggttgattgttgtttttgttgtgtgtgtgtgtgtgtgtgtgtgtgtgtgtgtgtgtgtgtgtatgcatgtgtgtgtgttaagaatacataatatgggccgggcac

SEQ ID NO: 25819 - DNA, 469 bp, Homo sapiens
  chrX.fa.O7frz.24586284
  Located on chromosome X
  Distance between a terminus base of telomere on chromosomal short arm and 5'-terminus of this base sequence : 24374503
  Distance between 3'-terminus of neighbour sequence of sequence listing upward to telomere on chrosomal short arm and 5'-terminus of this base sequence : 68376
agatcacttgaaatcaggagtttgagaccagcctggccaacatagcgaaaccccatctgcacttaaagaaaatacaaaaattagccaggtgtggtggcacgcacctgtaataccagctattcgggaggctgaggcaggataatcgcttgaacctgggaggcagaggttgcactgagctgagatcatgccactgcactgcagcctgagggacagagttagactccgtcagaagaaaaaaaaaagaagaaaaagaaagaaagaatgaaagaaagaaagaaggaaggaaggaagagagagagagaaagaaagaaagaaagaaagaaagaaagaaagaaagaaagaaagaaagaaagaaagaaagaaaaagaaagaaagagaaagaaaattgaaatggaaggcattggatggcatgctagaaagaatacagccaagcctgactctaactgtggtttcttgaacaatatgatac

SEQ ID NO: 25820 - DNA, 195 bp, Homo sapiens
  DXS7106
  Located on chromosome X
  Distance between a terminus base of telomere on chromosomal short arm and 5'-terminus of this base sequence : 24454080
  Distance between 3'-terminus of neighbour sequence of sequence listing upward to telomere on chrosomal short arm and 5'-terminus of this base sequence : 79108
aggaccttactaaaaaataagaaattaaaaaattatacatttataattaggttaggaagtgtgtgtgtgtgtgtgtgtgtgtgtgtgtgttaataaggaaagaaattaaaaaatggctggagacttaattcagattcatttcatctgaggtctgaaatgcttgtagagaaatgcttttcgtgcaaactggttccc

SEQ ID NO: 25821 - DNA, 194 bp, Homo sapiens
  AC004553.1_63201
  Located on chromosome X
  Distance between a terminus base of telomere on chromosomal short arm and 5'-terminus of this base sequence : 24573811
  Distance between 3'-terminus of neighbour sequence of sequence listing upward to telomere on chrosomal short arm and 5'-terminus of this base sequence : 119536
tttatcttcacatagcaattcaaactttgaaaacataaacttctgaaattttcatttggatgtttgtaaacatataacaccccacagtagatgtgtgtgtgtgtgtgtgtgtgtgtgtgtgtgtgtaaagatattgtgtgaataaagaagttcccttgttagccgaatgaatcttataagtcggaagacttgaa

SEQ ID NO: 25822 - DNA, 161 bp, Homo sapiens
  DXS8010
  Located on chromosome X
  Distance between a terminus base of telomere on chromosomal short arm and 5'-terminus of this base sequence : 24662125
  Distance between 3'-terminus of neighbour sequence of sequence listing upward to telomere on chrosomal short arm and 5'-terminus of this base sequence : 88120
aaggtggaaggtccactgttcatttcatttctatttattttctcactgtcatcttcaatttaaatatttgctataccccgatgtgtgtgtgtgtgtgtgtgtgtgtgtgtgtgtgtgtgtgtgtgtgttttattattctagaaaattaacctttgggccag

SEQ ID NO: 25823 - DNA, 190 bp, Homo sapiens
  Z67549
  Located on chromosome X
  Distance between a terminus base of telomere on chromosomal short arm and 5'-terminus of this base sequence : 24883739
  Distance between 3'-terminus of neighbour sequence of sequence listing upward to telomere on chrosomal short arm and 5'-terminus of this base sequence : 221453
agccactgctctggaacattaaccaagccaagtgaaattctggttaaattcactactagcagactaaaggtcaacataacaaacacacacacacacacacacacacacattatttgatattttgcaacggtaataattactcctatttcaacacatttaaaatattaaattgtgtatattttcaatgtca

SEQ ID NO: 25824 - DNA, 222 bp, Homo sapiens
  AC003667.1_38673
  Located on chromosome X
  Distance between a terminus base of telomere on chromosomal short arm and 5'-terminus of this base sequence : 24883768
  Distance between 3'-terminus of neighbour sequence of sequence listing upward to telomere on chrosomal short arm and 5'-terminus of this base sequence : -161
aagtgaaattctggttaaattcactactagcagactaaaggtcaacataacaaacacacacacacacacacacacacacattatttgatattttgcaacggtaataattactcctatttcaacacatttaaaatattaaattgtgtatattttcaatgtcaatatgtagctataattaatagtaaaaattaaattcccacatctgtgcataatccaaacaat

SEQ ID NO: 25825 - DNA, 319 bp, Homo sapiens
  AC003667.1_80522
  Located on chromosome X
  Distance between a terminus base of telomere on chromosomal short arm and 5'-terminus of this base sequence : 24925520
  Distance between 3'-terminus of neighbour sequence of sequence listing upward to telomere on chrosomal short arm and 5'-terminus of this base sequence : 41530
taacatgcagaaagttacagtgagagggtttttagttggtgtcccagaatgagaagagagaaatagtggagcagggacaacttttaggacataatggcaaatatacaaaacatataaaagacactaatctacaggaagaaatctacacatacacacacacacacacacacacacacacacacacgcatacatacaccaacccttctatctatatctagagatataccataaatatatatataccataaataaactatggtatattcattcagtagatactacagagcaatgaaatgagtagatttctgctttatgccac

SEQ ID NO: 25826 - DNA, 258 bp, Homo sapiens
  AC003106.1_22925
  Located on chromosome X
  Distance between a terminus base of telomere on chromosomal short arm and 5'-terminus of this base sequence : 25098153
  Distance between 3'-terminus of neighbour sequence of sequence listing upward to telomere on chrosomal short arm and 5'-terminus of this base sequence : 172314
gaaattgtgcttaccacgttagtgaagttataacttgtcatgtttctagttctatttgccgtaaaacttatttaaaagcctgattttgaagtgtgtgtgtgtgtgtgtgtgtgtgtgtgtgtgtgtgtgtctgcgtctgtgtctgtgtatatgtgtgttctaatgatctgtgtggtgctgttaaaagttgagttagttatcactgaagaagggattgctactgtcctcatggaaaagcaggtaaatagctttctatgt

SEQ ID NO: 25827 - DNA, 337 bp, Homo sapiens
  AC002367.1_117925
  Located on chromosome X
  Distance between a terminus base of telomere on chromosomal short arm and 5'-terminus of this base sequence : 25331298
  Distance between 3'-terminus of neighbour sequence of sequence listing upward to telomere on chrosomal short arm and 5'-terminus of this base sequence : 232887
ctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactc

SEQ ID NO: 25828 - DNA, 466 bp, Homo sapiens
  chrX.fa.O7frz.25864432
  Located on chromosome X
  Distance between a terminus base of telomere on chromosomal short arm and 5'-terminus of this base sequence : 25534751
  Distance between 3'-terminus of neighbour sequence of sequence listing upward to telomere on chrosomal short arm and 5'-terminus of this base sequence : 203116
tactctggaatgagataacttgagtttggaaaccacctctaccaattactagcttaacctgctgtgtttatttttctgtccatgtaaaatagaggtggtaataaaatacagcttacagggttatttttagaattaaatgagttaatatatgtaaatgactcataaaaaatgatggccattattgtcattatctgagtccaagccctccactagtgcaatggattccatttcttcatgcctactcaaataatttgctatttatttatttatttattatttccatagtttttggggggaacaagtggcatttggttacagagtaacttctttagtggtgatttgtgagattctgatgcactcattacccgagcagtatacactgaacccaatttgtagccttttgtcctttacctccttcccaccatttcctccagagtccccaaggtccactgtatcattcttatgc

SEQ ID NO: 25829 - DNA, 240 bp, Homo sapiens
  chrX.fa.O7frz.25988837
  Located on chromosome X
  Distance between a terminus base of telomere on chromosomal short arm and 5'-terminus of this base sequence : 25648512
  Distance between 3'-terminus of neighbour sequence of sequence listing upward to telomere on chrosomal short arm and 5'-terminus of this base sequence : 113295
atgtagtgaccaattagatctgaggctagaaagttaattatgttgattagggtttctggaaaaaaattaaaaccctaaactgttacagaaatacacacacacacacacacacacacacacacacacacacacaattttcagagttatttgttttctgtctccacccatgttggcagccccgtgtatgacctccccctcatccccaaatacagatgggtccacttaaatcctatgctaaat

SEQ ID NO: 25830 - DNA, 464 bp, Homo sapiens
  chrX.fa.O7frz.26115567
  Located on chromosome X
  Distance between a terminus base of telomere on chromosomal short arm and 5'-terminus of this base sequence : 25760554
  Distance between 3'-terminus of neighbour sequence of sequence listing upward to telomere on chrosomal short arm and 5'-terminus of this base sequence : 111802
ccaagttagactcatttgatttatttggaataaatttatgttattatggcaggtactataatttctttttatgtggcatggccattatttcatccaattatctctcaaatgtttgtgtgtgtgtgtgtgtgtgtgtgtcccatttcttgcttttcccttttctttacattctcattggtactgccctaactcaacacctaacttttgcacaaaacttcacttttgggagctttaaaatatcttacatgtacagaattttgaaagatggttttgcaccttctttgcctaacctctgttttacaatcctgctaatattccaaagaaccctataaatggtgttttcatttcctatccctgactccttgaaactattccacataccactaaaacaacttttaactatatatggaacagcggatgtcactgccttacttaaaagtcttgagtggtttctaatagcttaa

SEQ ID NO: 25831 - DNA, 267 bp, Homo sapiens
  DXS1218
  Located on chromosome X
  Distance between a terminus base of telomere on chromosomal short arm and 5'-terminus of this base sequence : 25855492
  Distance between 3'-terminus of neighbour sequence of sequence listing upward to telomere on chrosomal short arm and 5'-terminus of this base sequence : 94474
aagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcac

SEQ ID NO: 25832 - DNA, 227 bp, Homo sapiens
  chrX.fa.O7frz.26291305
  Located on chromosome X
  Distance between a terminus base of telomere on chromosomal short arm and 5'-terminus of this base sequence : 25939778
  Distance between 3'-terminus of neighbour sequence of sequence listing upward to telomere on chrosomal short arm and 5'-terminus of this base sequence : 84019
taaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataa

SEQ ID NO: 25833 - DNA, 363 bp, Homo sapiens
  AL031575.1_19595
  Located on chromosome X
  Distance between a terminus base of telomere on chromosomal short arm and 5'-terminus of this base sequence : 26069970
  Distance between 3'-terminus of neighbour sequence of sequence listing upward to telomere on chrosomal short arm and 5'-terminus of this base sequence : 129965
tatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaat

SEQ ID NO: 25834 - DNA, 345 bp, Homo sapiens
  chrX.fa.O7frz.27501100
  Located on chromosome X
  Distance between a terminus base of telomere on chromosomal short arm and 5'-terminus of this base sequence : 26158398
  Distance between 3'-terminus of neighbour sequence of sequence listing upward to telomere on chrosomal short arm and 5'-terminus of this base sequence : 88065
caactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttcctt

SEQ ID NO: 25835 - DNA, 388 bp, Homo sapiens
  chrX.fa.O7frz.27388700
  Located on chromosome X
  Distance between a terminus base of telomere on chromosomal short arm and 5'-terminus of this base sequence : 26270691
  Distance between 3'-terminus of neighbour sequence of sequence listing upward to telomere on chrosomal short arm and 5'-terminus of this base sequence : 111948
ataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagttt

SEQ ID NO: 25836 - DNA, 107 bp, Homo sapiens
  DISD22_0007091
  Located on chromosome X
  Distance between a terminus base of telomere on chromosomal short arm and 5'-terminus of this base sequence : 26416809
  Distance between 3'-terminus of neighbour sequence of sequence listing upward to telomere on chrosomal short arm and 5'-terminus of this base sequence : 145730
tatgagccaggaaccatggacaaaaacctacacacacacacacacacacacacacacacacacacacacacacacacacacacaatgttattacaccctccatggaa

SEQ ID NO: 25837 - DNA, 125 bp, Homo sapiens
  Z67237
  Located on chromosome X
  Distance between a terminus base of telomere on chromosomal short arm and 5'-terminus of this base sequence : 26522647
  Distance between 3'-terminus of neighbour sequence of sequence listing upward to telomere on chrosomal short arm and 5'-terminus of this base sequence : 105731
tcttcagttataccttctggcaaaattctatatatataggaacacacacacacacacacacacacacacacacacacacacagatcaaatagagatactgactaaaaactgcaagtcaagagttc

SEQ ID NO: 25838 - DNA, 261 bp, Homo sapiens
  Z67109
  Located on chromosome X
  Distance between a terminus base of telomere on chromosomal short arm and 5'-terminus of this base sequence : 26543748
  Distance between 3'-terminus of neighbour sequence of sequence listing upward to telomere on chrosomal short arm and 5'-terminus of this base sequence : 20976
tgtaggaactcccatcccagtcatcatctgtgggcctgtgtagtgactatcgtacgtttggtttattcctaccaccatttagtgagaaaacaattctacacttttggtcacaatagtaaggtggccacacacacacacacacacacacacacgtgtaaactgcaatagggttcattggggagggtgaggttaatttgcaaatatatgaagaagaagtgtaagcatttgtaacaatgaaaaggtctcagtatctgtgtgaca

SEQ ID NO: 25839 - DNA, 162 bp, Homo sapiens
  DXS1065
  Located on chromosome X
  Distance between a terminus base of telomere on chromosomal short arm and 5'-terminus of this base sequence : 26557562
  Distance between 3'-terminus of neighbour sequence of sequence listing upward to telomere on chrosomal short arm and 5'-terminus of this base sequence : 13553
gggacattgtgaatacaggcttaaaatttatatgtatatataaactgtaaatatatatgtgtgtgtgtgtgtgtgtgtgtgtgtatataacatagcacatagtaagtactaaatgctgaaagagtaggtaatattactgaaggcaggttggggatcagatta

SEQ ID NO: 25840 - DNA, 266 bp, Homo sapiens
  AC005145.1_48819
  Located on chromosome X
  Distance between a terminus base of telomere on chromosomal short arm and 5'-terminus of this base sequence : 26729492
  Distance between 3'-terminus of neighbour sequence of sequence listing upward to telomere on chrosomal short arm and 5'-terminus of this base sequence : 171768
accacatccaattccttaattctttcagtaagattgagatattggagcagtgtttcttaattacaggtatgtgagtaggtgtcattgggaatgtgacattgtgtgtgtgtgtgtgtgtgtgtgtgtgtactgcttttcctaactttgtatcatgagtgtctccggttttatcagattctcaagaggatccaccagccccaaaagttttaaaagcattgttttgccagtttgaaaaacattacctaatttatgcttcttggattcaa

SEQ ID NO: 25841 - DNA, 309 bp, Homo sapiens
  AC005185.1_18358
  Located on chromosome X
  Distance between a terminus base of telomere on chromosomal short arm and 5'-terminus of this base sequence : 26796390
  Distance between 3'-terminus of neighbour sequence of sequence listing upward to telomere on chrosomal short arm and 5'-terminus of this base sequence : 66632
tttactttgaaactgacaaacctctagccaggctaaccaaaacacacacacacacacacacacacacacacacacacacacacacaacagagaagacacaaagtcctaatatcctaatatcagaaatgaaagaaggatcactactgttcacatggacatgaaaaggataataaaagaatattttgaacaattttatgcccacaaaatatgaataagcctattatctaccaaagagagtaaatcaattaataaacttccaaacataaagcaccagtctgcagatggcttcactagtgactttgaccaaac

SEQ ID NO: 25842 - DNA, 297 bp, Homo sapiens
  AC005185.1_116697
  Located on chromosome X
  Distance between a terminus base of telomere on chromosomal short arm and 5'-terminus of this base sequence : 26894573
  Distance between 3'-terminus of neighbour sequence of sequence listing upward to telomere on chrosomal short arm and 5'-terminus of this base sequence : 97874
accttgtagagctaggatcaagattaaaagatatactccatgaaaaccactcaaaacagtgcttggcacaataaacattagctttttaatttgaaatacaccatgattttttacttgaatacaccatgggtttttagatctatgtattaggagtaaaacaatgtaataatgtagactattttaggtaaatcagacacttttattttattttattttattttattttatttgagacagggtcttgttctgtcacctaggctggagtgcagtggcatgatctcaactcactgcaacctc

SEQ ID NO: 25843 - DNA, 383 bp, Homo sapiens
  U31929.1_4333
  Located on chromosome X
  Distance between a terminus base of telomere on chromosomal short arm and 5'-terminus of this base sequence : 26902665
  Distance between 3'-terminus of neighbour sequence of sequence listing upward to telomere on chrosomal short arm and 5'-terminus of this base sequence : 7795
acatacaaaggataaacagcaaagagaggccacactcttaataggcattacctttctcccaaatataggtacatttgtgtttcaaacacactcagcttagctggttaaactcatattgagagaggattaggaaaagtcaatcaagaataaggaagaatgtgtgtgtgtgtgtgtgtgtgtgtgtgtgtgtgtgtgttaaaagtatataaaacagagtcaagggaaactgttgatactgaaactaatggaatgtaaatttctggaagctgagcccctctcacctttatatcccaacaggacgaggaacatagtggatgattagtaacactggctgaaggaataagaagactgttttccaaataatcttaagaatcatctgcgac

SEQ ID NO: 25844 - DNA, 319 bp, Homo sapiens
  AC005926.1_94393
  Located on chromosome X
  Distance between a terminus base of telomere on chromosomal short arm and 5'-terminus of this base sequence : 26996533
  Distance between 3'-terminus of neighbour sequence of sequence listing upward to telomere on chrosomal short arm and 5'-terminus of this base sequence : 93485
tattgctggaaattgatttgttaatattttacacttctcataatttccattttcttttttctttaaatatgtgattttaaagatttgttcattcttttaaacatttatctcgtggtataagatatatacagtaaagtgcacagtgcacaaatcttaaatttacaactctatcaacacacacacacacacacacacacacacacacacacacatcagaataaccaccactcagttcaagacacagtatatgtagtatatttccaacatcacagagggctccctctttgctcttgccactcgtaccatacttccagaggta

SEQ ID NO: 25845 - DNA, 120 bp, Homo sapiens
  DISD22_0007104
  Located on chromosome X
  Distance between a terminus base of telomere on chromosomal short arm and 5'-terminus of this base sequence : 27068612
  Distance between 3'-terminus of neighbour sequence of sequence listing upward to telomere on chrosomal short arm and 5'-terminus of this base sequence : 71760
tcagagctcacaccagtagggctgctgctgctgctgctgctgctactgctgctgtttcagctgctgctccagctgctgctcaactacaaaatgtagtctaagtagtgcctgttattgtgc

SEQ ID NO: 25846 - DNA, 218 bp, Homo sapiens
  DISD22_0007107
  Located on chromosome X
  Distance between a terminus base of telomere on chromosomal short arm and 5'-terminus of this base sequence : 27150408
  Distance between 3'-terminus of neighbour sequence of sequence listing upward to telomere on chrosomal short arm and 5'-terminus of this base sequence : 81676
tcaacttctccacaaactcagaagtataattaataacacctctcttttttctttcttctttctttctttctttttttctttctttctttctttctttctttctttctttctttctttctttctttctttctttcttcttccttcctttcctcttttcttcatttctttcttttttttttctttccagaatggctaaatttctgaagctggacctccat

SEQ ID NO: 25847 - DNA, 203 bp, Homo sapiens
  DXS992
  Located on chromosome X
  Distance between a terminus base of telomere on chromosomal short arm and 5'-terminus of this base sequence : 27407812
  Distance between 3'-terminus of neighbour sequence of sequence listing upward to telomere on chrosomal short arm and 5'-terminus of this base sequence : 257186
gcttatccactgggacagaaagggttgataattaggcatttgggagaaaggggtgggaaaaaatttcactatacatatgtgtgtgtgtgtgtgtatgtatatgtgtgtgtgtatgtgtgtatatgtgtgtgtgtgtatatatatatatatatatatatatatatttttttttttttttttttttgaaatggagtcccattctt

SEQ ID NO: 25848 - DNA, 473 bp, Homo sapiens
  chrX.fa.O7frz.27891830
  Located on chromosome X
  Distance between a terminus base of telomere on chromosomal short arm and 5'-terminus of this base sequence : 27624645
  Distance between 3'-terminus of neighbour sequence of sequence listing upward to telomere on chrosomal short arm and 5'-terminus of this base sequence : 216630
gaactttcagtgtcagcactattgtctgtacatccccagacaatgacaaaatgtataatgattctatattaagacttggccttactcaagtgaatcgtgtcaatgtggatagaatccctacaaaatattttcttataataatataaatgaagcatctacaacatggcacgtggcatattatttccagatcctgtgggggtttttaaaaaagcttctgtgttaaagtgatgagcaaatagcttgtttcctgcagttttgctatttcagcactttcttgcctattttttatgcttcttctcccactgtatctctgtccagtctgtttccccttttccttcatagcttctgtctttgtaaatgtcatgattttaattctttgtttcttctttcttgtgtgtgtgtgtgtgtgtgtgtgtgtgtgtgttttaaagaaaaggtgccctttttatctaaacaatcagaatccagtttaa

SEQ ID NO: 25849 - DNA, 411 bp, Homo sapiens
  chrX.fa.O7frz.27992405
  Located on chromosome X
  Distance between a terminus base of telomere on chromosomal short arm and 5'-terminus of this base sequence : 27725495
  Distance between 3'-terminus of neighbour sequence of sequence listing upward to telomere on chrosomal short arm and 5'-terminus of this base sequence : 100377
ttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggt

SEQ ID NO: 25850 - DNA, 212 bp, Homo sapiens
  DXS1214
  Located on chromosome X
  Distance between a terminus base of telomere on chromosomal short arm and 5'-terminus of this base sequence : 27828813
  Distance between 3'-terminus of neighbour sequence of sequence listing upward to telomere on chrosomal short arm and 5'-terminus of this base sequence : 102907
aagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttcta

SEQ ID NO: 25851 - DNA, 246 bp, Homo sapiens
  chrX.fa.O7frz.28323243
  Located on chromosome X
  Distance between a terminus base of telomere on chromosomal short arm and 5'-terminus of this base sequence : 28042076
  Distance between 3'-terminus of neighbour sequence of sequence listing upward to telomere on chrosomal short arm and 5'-terminus of this base sequence : 213051
gttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcattt

SEQ ID NO: 25852 - DNA, 326 bp, Homo sapiens
  chrX.fa.O7frz.28446900
  Located on chromosome X
  Distance between a terminus base of telomere on chromosomal short arm and 5'-terminus of this base sequence : 28108352
  Distance between 3'-terminus of neighbour sequence of sequence listing upward to telomere on chrosomal short arm and 5'-terminus of this base sequence : 66030
tgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattag

SEQ ID NO: 25853 - DNA, 422 bp, Homo sapiens
  chrX.fa.O7frz.28547966
  Located on chromosome X
  Distance between a terminus base of telomere on chromosomal short arm and 5'-terminus of this base sequence : 28310148
  Distance between 3'-terminus of neighbour sequence of sequence listing upward to telomere on chrosomal short arm and 5'-terminus of this base sequence : 201470
atcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaac

SEQ ID NO: 25854 - DNA, 149 bp, Homo sapiens
  DXS1036
  Located on chromosome X
  Distance between a terminus base of telomere on chromosomal short arm and 5'-terminus of this base sequence : 28343097
  Distance between 3'-terminus of neighbour sequence of sequence listing upward to telomere on chrosomal short arm and 5'-terminus of this base sequence : 32527
tgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggc

SEQ ID NO: 25855 - DNA, 224 bp, Homo sapiens
  DXS1067
  Located on chromosome X
  Distance between a terminus base of telomere on chromosomal short arm and 5'-terminus of this base sequence : 28377133
  Distance between 3'-terminus of neighbour sequence of sequence listing upward to telomere on chrosomal short arm and 5'-terminus of this base sequence : 33887
cctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacata

SEQ ID NO: 25856 - DNA, 178 bp, Homo sapiens
  Z23710.1_167
  Located on chromosome X
  Distance between a terminus base of telomere on chromosomal short arm and 5'-terminus of this base sequence : 28377189
  Distance between 3'-terminus of neighbour sequence of sequence listing upward to telomere on chrosomal short arm and 5'-terminus of this base sequence : -168
atgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagca

SEQ ID NO: 25857 - DNA, 353 bp, Homo sapiens
  chrX.fa.O7frz.28709843
  Located on chromosome X
  Distance between a terminus base of telomere on chromosomal short arm and 5'-terminus of this base sequence : 28678884
  Distance between 3'-terminus of neighbour sequence of sequence listing upward to telomere on chrosomal short arm and 5'-terminus of this base sequence : 301517
acattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctcc

SEQ ID NO: 25858 - DNA, 337 bp, Homo sapiens
  chrX.fa.O7frz.29038230
  Located on chromosome X
  Distance between a terminus base of telomere on chromosomal short arm and 5'-terminus of this base sequence : 28808476
  Distance between 3'-terminus of neighbour sequence of sequence listing upward to telomere on chrosomal short arm and 5'-terminus of this base sequence : 129239
atttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagagga

SEQ ID NO: 25859 - DNA, 176 bp, Homo sapiens
  AL109609.5_47554
  Located on chromosome X
  Distance between a terminus base of telomere on chromosomal short arm and 5'-terminus of this base sequence : 29009552
  Distance between 3'-terminus of neighbour sequence of sequence listing upward to telomere on chrosomal short arm and 5'-terminus of this base sequence : 200739
atcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagc

SEQ ID NO: 25860 - DNA, 402 bp, Homo sapiens
  chrX.fa.O7frz.29316965
  Located on chromosome X
  Distance between a terminus base of telomere on chromosomal short arm and 5'-terminus of this base sequence : 29086969
  Distance between 3'-terminus of neighbour sequence of sequence listing upward to telomere on chrosomal short arm and 5'-terminus of this base sequence : 77241
tgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtacttt

SEQ ID NO: 25861 - DNA, 477 bp, Homo sapiens
  chrX.fa.O7frz.29436632
  Located on chromosome X
  Distance between a terminus base of telomere on chromosomal short arm and 5'-terminus of this base sequence : 29206597
  Distance between 3'-terminus of neighbour sequence of sequence listing upward to telomere on chrosomal short arm and 5'-terminus of this base sequence : 119226
agctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaa

SEQ ID NO: 25862 - DNA, 288 bp, Homo sapiens
  AC004468.1_22108
  Located on chromosome X
  Distance between a terminus base of telomere on chromosomal short arm and 5'-terminus of this base sequence : 29308800
  Distance between 3'-terminus of neighbour sequence of sequence listing upward to telomere on chrosomal short arm and 5'-terminus of this base sequence : 101726
tcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtc

SEQ ID NO: 25863 - DNA, 194 bp, Homo sapiens
  chrX.fa.O7frz.29668903
  Located on chromosome X
  Distance between a terminus base of telomere on chromosomal short arm and 5'-terminus of this base sequence : 29439086
  Distance between 3'-terminus of neighbour sequence of sequence listing upward to telomere on chrosomal short arm and 5'-terminus of this base sequence : 129998
acttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctc

SEQ ID NO: 25864 - DNA, 330 bp, Homo sapiens
  chrX.fa.O7frz.29793720
  Located on chromosome X
  Distance between a terminus base of telomere on chromosomal short arm and 5'-terminus of this base sequence : 29563751
  Distance between 3'-terminus of neighbour sequence of sequence listing upward to telomere on chrosomal short arm and 5'-terminus of this base sequence : 124471
cagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgag

SEQ ID NO: 25865 - DNA, 289 bp, Homo sapiens
  chrX.fa.O7frz.29890578
  Located on chromosome X
  Distance between a terminus base of telomere on chromosomal short arm and 5'-terminus of this base sequence : 29657085
  Distance between 3'-terminus of neighbour sequence of sequence listing upward to telomere on chrosomal short arm and 5'-terminus of this base sequence : 93004
tgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgagga

SEQ ID NO: 25866 - DNA, 282 bp, Homo sapiens
  chrX.fa.O7frz.29990941
  Located on chromosome X
  Distance between a terminus base of telomere on chromosomal short arm and 5'-terminus of this base sequence : 29757832
  Distance between 3'-terminus of neighbour sequence of sequence listing upward to telomere on chrosomal short arm and 5'-terminus of this base sequence : 100458
cgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatgg

SEQ ID NO: 25867 - DNA, 308 bp, Homo sapiens
  AL031643.1_70841
  Located on chromosome X
  Distance between a terminus base of telomere on chromosomal short arm and 5'-terminus of this base sequence : 29913409
  Distance between 3'-terminus of neighbour sequence of sequence listing upward to telomere on chrosomal short arm and 5'-terminus of this base sequence : 155295
attaagatcactgcttgaagtcacaagttatggcaaaagttcacccagcaatcattcttgaaaagaaaaatgtcttaaaaattttgctgacctgctgcctgagagcctattatgttaggaatctgttacactagagatacgggaagaacacacacacacacacacacacacacacacacacacacacgccatgaaggcagaagcagcccaaaacaaatgaatttgagtactgaatcttcaatatttctaattaattatcaccacaaacagcactccacgtggtagtagactatctgaatctaggcagc

SEQ ID NO: 25868 - DNA, 370 bp, Homo sapiens
  chrX.fa.O7frz.30228197
  Located on chromosome X
  Distance between a terminus base of telomere on chromosomal short arm and 5'-terminus of this base sequence : 29995085
  Distance between 3'-terminus of neighbour sequence of sequence listing upward to telomere on chrosomal short arm and 5'-terminus of this base sequence : 81368
aaatctttaatcaatgctttgtagttttcactgtataaatatttcaccattttagttaaatttattcctcttttattcttcctgatgatactgtaaatgaaattgttttctaagtgccattaacagataaatggataaaaaagtggtatatatatatatatatatacacacacacacaacggaacacacaacggaatattcatttatataaaaaaaacttaccatttgcaacaacatggatagaactgaaggacattttgttaagtgaaataagccaggcacagaaagacaaatattacacgttctcactcatatgtgggagctaaaataattgatctcatggaggtagtgagtacaatagtggttacga

SEQ ID NO: 25869 - DNA, 255 bp, Homo sapiens
  AL050305.9_99929
  Located on chromosome X
  Distance between a terminus base of telomere on chromosomal short arm and 5'-terminus of this base sequence : 30076325
  Distance between 3'-terminus of neighbour sequence of sequence listing upward to telomere on chrosomal short arm and 5'-terminus of this base sequence : 80870
ctttgcttaacttcaaggagaagattagtaaccattcaactaactgaaatgtaaacaaattataatttaactctcaatctatatcaagataaaatttaatacatacatacacacacacacacacacacacacacacacacacacaaacacacatatcccagtcaggtggaattagagaccctcaatctaaaatcataatggtgcccaaaaatcaattttagctctcacacagtctttgagaatcaaatacaggac

SEQ ID NO: 25870 - DNA, 261 bp, Homo sapiens
  DISD22_0007117
  Located on chromosome X
  Distance between a terminus base of telomere on chromosomal short arm and 5'-terminus of this base sequence : 30206794
  Distance between 3'-terminus of neighbour sequence of sequence listing upward to telomere on chrosomal short arm and 5'-terminus of this base sequence : 130214
gcattcaacttatgtatacatcaccaaattcccctgaatgacaccctcaggaaaacaaaacaacccagggaaactattaactaaatgcatgtatggaagtatacataaacatacacgtacatatctatatgtgtacacatcatatatatatatatatatatatatatatatacacatatgtagatatcttctcacaaaaaacacatgttaacttagtctcttatccattttatgaagtggcttccttcggcaatgtcaaat

SEQ ID NO: 25871 - DNA, 133 bp, Homo sapiens
  DISD22_0007121
  Located on chromosome X
  Distance between a terminus base of telomere on chromosomal short arm and 5'-terminus of this base sequence : 30508575
  Distance between 3'-terminus of neighbour sequence of sequence listing upward to telomere on chrosomal short arm and 5'-terminus of this base sequence : 301520
aaagtaggtgatggagactgtgaaaagacagtgtgtctggctttttttttctctctctgtcaaacacacacacacacacacacacacacacacacacacacacacacacttctatagtctgaatccatggagc

SEQ ID NO: 25872 - DNA, 229 bp, Homo sapiens
  DISD22_0007126
  Located on chromosome X
  Distance between a terminus base of telomere on chromosomal short arm and 5'-terminus of this base sequence : 30594672
  Distance between 3'-terminus of neighbour sequence of sequence listing upward to telomere on chrosomal short arm and 5'-terminus of this base sequence : 85964
gataagttgttctgcaacaataggagtgtgtgtgtgtgtgtgtgtgtgtgtgtgtgtgtgtgtagagagagagagagagatacagaaagacagaagaaaagaatatttttggcaagtaaaacttgcatattaatgaaaagaaaggatatttttgataaagtaaattctaaaatacaatatataaactaatacatatatctgtttggatttaatagatcagagaccattg

SEQ ID NO: 25873 - DNA, 173 bp, Homo sapiens
  DISD22_0007131
  Located on chromosome X
  Distance between a terminus base of telomere on chromosomal short arm and 5'-terminus of this base sequence : 30862287
  Distance between 3'-terminus of neighbour sequence of sequence listing upward to telomere on chrosomal short arm and 5'-terminus of this base sequence : 267386
ccaatcttgttagattctggcttttcctttccaaaatatttttgagtgtatattgtatgtactctctctctctctctctctctctctctctctctctctctctctctctctctatatatatatatatatatatatatatatatatatatccttattcttacatgaatggtagc

SEQ ID NO: 25874 - DNA, 171 bp, Homo sapiens
  DISD22_0007140
  Located on chromosome X
  Distance between a terminus base of telomere on chromosomal short arm and 5'-terminus of this base sequence : 31034248
  Distance between 3'-terminus of neighbour sequence of sequence listing upward to telomere on chrosomal short arm and 5'-terminus of this base sequence : 171788
cacgtgcatatagaggaaagagtatttcaacatattggattattattctttgtatgactgtgtgtgtgtgtgtgtgtgtgtgtgtgtgtgtgtgtgtgtgtgtgttttgtggtgggagaaggggaagggtgttctttggtgaaatacttttacgaaatactgttgccacaa

SEQ ID NO: 25875 - DNA, 101 bp, Homo sapiens
  DISD22_0007142
  Located on chromosome X
  Distance between a terminus base of telomere on chromosomal short arm and 5'-terminus of this base sequence : 31157709
  Distance between 3'-terminus of neighbour sequence of sequence listing upward to telomere on chrosomal short arm and 5'-terminus of this base sequence : 123290
tccttataccttcaaacactgtgaactttaaaaaatgtgaatccgaacatgtcactaggacacacacacacacacacaccttaatcaatggtttcctgtgt

SEQ ID NO: 25876 - DNA, 191 bp, Homo sapiens
  DISD22_0007143
  Located on chromosome X
  Distance between a terminus base of telomere on chromosomal short arm and 5'-terminus of this base sequence : 31228732
  Distance between 3'-terminus of neighbour sequence of sequence listing upward to telomere on chrosomal short arm and 5'-terminus of this base sequence : 70922
gtctgagatatcttgtcccaagaaaagaaagctgggtttttatgtcctgcccatcaaacagaggatgtaaatccctaggcatttctagctatgtgtatgtgtatgtgtatgtgtatgtgtatgtgtagtgtatgtgtagtgtgtgtgtgtgtgtacatgcaagcactgcaaaagagccatcagtagcccaa

SEQ ID NO: 25877 - DNA, 207 bp, Homo sapiens
  HUMUT1492
  Located on chromosome X
  Distance between a terminus base of telomere on chromosomal short arm and 5'-terminus of this base sequence : 31367646
  Distance between 3'-terminus of neighbour sequence of sequence listing upward to telomere on chrosomal short arm and 5'-terminus of this base sequence : 138723
atttgttccccttaaggctgatgggttttgccttctgtccctccctctccccctcccttccttccttccttccttccttccttccttccttccttccttccttccttctttccttccttccttccctcctttcttcctttcaagtttgttgtttcatttgtttttatttttattttttgagacaaggtcttgtttagtcacccaggc

SEQ ID NO: 25878 - DNA, 174 bp, Homo sapiens
  DISD22_0007160
  Located on chromosome X
  Distance between a terminus base of telomere on chromosomal short arm and 5'-terminus of this base sequence : 31536318
  Distance between 3'-terminus of neighbour sequence of sequence listing upward to telomere on chrosomal short arm and 5'-terminus of this base sequence : 168465
tccttatcaactccttagtcccccgaaatgggggattgtaaacctagagaaaaacaggattggggtgtgtttgtgtgtgcgtgtgtgtgtgtgtgtgtgtgtgtgtgtgtgtgtgttgcaggatggggagggaggagaaataagtagagaacacccaagatccctatgacattg

SEQ ID NO: 25879 - DNA, 206 bp, Homo sapiens
  DISD22_0007163
  Located on chromosome X
  Distance between a terminus base of telomere on chromosomal short arm and 5'-terminus of this base sequence : 31609214
  Distance between 3'-terminus of neighbour sequence of sequence listing upward to telomere on chrosomal short arm and 5'-terminus of this base sequence : 72722
aatgaggattagcagggaatagtaaaataagttggatataaattaaagtctaaataattatgttaaaatatgcaagtagtaaaataaaattttaaaacagaaattatatttctaaaagaaaatctatagtaagagcaaaagtcgtgtgtgtgtatatatatatatatatatatacacacacatagttgatccacattatttgtgga

SEQ ID NO: 25880 - DNA, 288 bp, Homo sapiens
  DISD22_0007166
  Located on chromosome X
  Distance between a terminus base of telomere on chromosomal short arm and 5'-terminus of this base sequence : 31692821
  Distance between 3'-terminus of neighbour sequence of sequence listing upward to telomere on chrosomal short arm and 5'-terminus of this base sequence : 83401
tcagacatgacttactgacaagagcaattatagttatatatatatgtgtatatatatgtatatatgtatatatgtatatgtatatgtatgtatatacgtatgtatatgtatatatgtatgtatatgtatatgtatatatgtatatgtatatacgtatatatgtgtgtatatatatatgtataaggaatatatatatattccttagcttctcttggggagtgagttaaaaattgtatatgccctgggtcctcagtgtgtgttgggaggggcataatttgcatccttaac

SEQ ID NO: 25881 - DNA, 216 bp, Homo sapiens
  DISD22_0007170
  Located on chromosome X
  Distance between a terminus base of telomere on chromosomal short arm and 5'-terminus of this base sequence : 31845006
  Distance between 3'-terminus of neighbour sequence of sequence listing upward to telomere on chrosomal short arm and 5'-terminus of this base sequence : 151897
catagcattccaaagctgagatttaacttactttaacttacttttctttccaactttacctatgacaatttttttataagcagaacttcaggtattcttaaacacacatacacacacacacacacacacacacacacacacacacactgtattatcattttctttaatgtatttgcaaatttggtggattttttttggtaggtggaggagtttcat

SEQ ID NO: 25882 - DNA, 232 bp, Homo sapiens
  HUMUT411
  Located on chromosome X
  Distance between a terminus base of telomere on chromosomal short arm and 5'-terminus of this base sequence : 31933717
  Distance between 3'-terminus of neighbour sequence of sequence listing upward to telomere on chrosomal short arm and 5'-terminus of this base sequence : 88495
ggtgagaatgagagaattgtgttgccatcagacgttaggacagttggtcttacaactatatatatatatatatatatatatatatatatatatatatacacacacacacacacacacacatatatacacacacatatatatacatatatatactttatttttcaagtaaatttttgattcataaaaaatttgagtagaaagtacagagaattcccatatactccctccccac

SEQ ID NO: 25883 - DNA, 242 bp, Homo sapiens
  DISD22_0007177
  Located on chromosome X
  Distance between a terminus base of telomere on chromosomal short arm and 5'-terminus of this base sequence : 32088587
  Distance between 3'-terminus of neighbour sequence of sequence listing upward to telomere on chrosomal short arm and 5'-terminus of this base sequence : 154638
gattgaggagaaataataccttacccctactttgtttataaacaaagtagaagatatggatccttttttatctcagaatacacacacacacacacacacacacacacacacacacacacggagacctacaattactgtgtgtcaaatacgtacatatgtgcacatgtgcatgcatatacacaaacatacataaacaaaagataatacattctatttttttccatctgatgatcaatttgatt

SEQ ID NO: 25884 - DNA, 144 bp, Homo sapiens
  DISD22_0007182
  Located on chromosome X
  Distance between a terminus base of telomere on chromosomal short arm and 5'-terminus of this base sequence : 32212868
  Distance between 3'-terminus of neighbour sequence of sequence listing upward to telomere on chrosomal short arm and 5'-terminus of this base sequence : 124039
caatggaatactatgtgctgatgaaaacacacacacacacacacacacacacacacacacacactgactcagaattctatatccatcaaatttatctcttcagaatggaaaagagataaagcctttctcagcaaacaagcatgg

SEQ ID NO: 25885 - DNA, 101 bp, Homo sapiens
  DISD22_0007193
  Located on chromosome X
  Distance between a terminus base of telomere on chromosomal short arm and 5'-terminus of this base sequence : 32561199
  Distance between 3'-terminus of neighbour sequence of sequence listing upward to telomere on chrosomal short arm and 5'-terminus of this base sequence : 348187
aatgtgaggcagaagacatggtaaaagtgtgtgtgtgtgtgtgtgtgtgtgtgtgtgtgtagaataaggtatatgaaaaagcaagagcaataagatgtgaa

SEQ ID NO: 25886 - DNA, 136 bp, Homo sapiens
  DISD22_0007201
  Located on chromosome X
  Distance between a terminus base of telomere on chromosomal short arm and 5'-terminus of this base sequence : 32741552
  Distance between 3'-terminus of neighbour sequence of sequence listing upward to telomere on chrosomal short arm and 5'-terminus of this base sequence : 180252
tcttactcttctgcatgtatttctctctctcacacacacacacacacacacacacacacacacacacactagtgaaacttctgtgttccacatatagtaatgatagaattacagtctactcaataagtactgaggc

SEQ ID NO: 25887 - DNA, 193 bp, Homo sapiens
  DISD22_0007206
  Located on chromosome X
  Distance between a terminus base of telomere on chromosomal short arm and 5'-terminus of this base sequence : 33028231
  Distance between 3'-terminus of neighbour sequence of sequence listing upward to telomere on chrosomal short arm and 5'-terminus of this base sequence : 286543
ttctcatctccactgacccaaaacctaaacccaacacattctctctgtctgtctgtctgtctgtctctctgtctctctctctctctgtcacagacacacagacacacacacacacacacacacacacacacacacacacacacacacacacacacactcacattctcccccagctggttgagctccaaggaac

SEQ ID NO: 25888 - DNA, 249 bp, Homo sapiens
  DISD22_0007218
  Located on chromosome X
  Distance between a terminus base of telomere on chromosomal short arm and 5'-terminus of this base sequence : 33227780
  Distance between 3'-terminus of neighbour sequence of sequence listing upward to telomere on chrosomal short arm and 5'-terminus of this base sequence : 199356
ttctgctaagctccctggattttcactttagggtaaaactttgacttggaattttccaatagttttgcttgctctttgacacttttaacatggttttaatttcttatattcaaagttttgaggtgtgtgtgtgtgtgtgtgtgtgtgtgagtgagagagagagagagagagagagagagagagaatttatctaaatagcttaccatttccaaaaagcaaaatttgacagaaatagtactctagcatgga

SEQ ID NO: 25889 - DNA, 160 bp, Homo sapiens
  DISD22_0007225
  Located on chromosome X
  Distance between a terminus base of telomere on chromosomal short arm and 5'-terminus of this base sequence : 33377692
  Distance between 3'-terminus of neighbour sequence of sequence listing upward to telomere on chrosomal short arm and 5'-terminus of this base sequence : 149663
tcagccaaatccgtaagtgaaagagagagagattattatgtttgtgtgtgtgtgtgtgtgtgtgtgtgtgtgtgtgtgtgtgtgtgtgtgtattcctttaaatgggggctaggctagatggggcattttagttaataagtcaaggatcattactaaggcc

SEQ ID NO: 25890 - DNA, 456 bp, Homo sapiens
  chrX.fa.O7frz.30637159
  Located on chromosome X
  Distance between a terminus base of telomere on chromosomal short arm and 5'-terminus of this base sequence : 33552219
  Distance between 3'-terminus of neighbour sequence of sequence listing upward to telomere on chrosomal short arm and 5'-terminus of this base sequence : 174367
gactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctg

SEQ ID NO: 25891 - DNA, 253 bp, Homo sapiens
  AJ239329.2_38362
  Located on chromosome X
  Distance between a terminus base of telomere on chromosomal short arm and 5'-terminus of this base sequence : 33673161
  Distance between 3'-terminus of neighbour sequence of sequence listing upward to telomere on chrosomal short arm and 5'-terminus of this base sequence : 120486
gttgctgtttaaacgcactaagtcataccctcatgcaagtattggatcaaacataacataactttattgtaatttcaacattattgtatttgaaaatatttaaagtgaattggaatcctctcagttccattgattttgcatacagacacacacacacacacacacacacacacacacacacacagacacagacacaattttgtccattttgttttatcacaaactggtctgtcttataccatggattgttaaa

SEQ ID NO: 25892 - DNA, 249 bp, Homo sapiens
  AL121577.1_84072
  Located on chromosome X
  Distance between a terminus base of telomere on chromosomal short arm and 5'-terminus of this base sequence : 33862757
  Distance between 3'-terminus of neighbour sequence of sequence listing upward to telomere on chrosomal short arm and 5'-terminus of this base sequence : 189343
tactgaattttagacataggcgacagaggaatttgaagagatggaaaggccagagagacacctcagctgccagaaaattcagctagccctaccaggaaatctctctctctctctctctctttctctctctctcttacacacacacacacacacacacacacacacacgcacacacacacattgaggagcaagataaattttacaaagttataatttttttttttttgagacaaggtcttgctttatcag

SEQ ID NO: 25893 - DNA, 331 bp, Homo sapiens
  chrX.fa.O7frz.31199881
  Located on chromosome X
  Distance between a terminus base of telomere on chromosomal short arm and 5'-terminus of this base sequence : 34153356
  Distance between 3'-terminus of neighbour sequence of sequence listing upward to telomere on chrosomal short arm and 5'-terminus of this base sequence : 290350
gtccaccttaaagatacaggatgaacaaccacccaaatttgatttcggtatggggaccaatgatcacacacacacacacacacacacacacacacacacacacacacacacgaagagggtatgaagatttcttactcacataataaggctttctaggaagagtagggtgactcacaagcagtaaaaatggcttgaagttttatggtggttagtgagtaaggccagggtggttcccatgcacaggaaggggttggtggcggtttgaattttccactggcaccaaaggagagaacacctagactttattgttagcttgatcacttgtaggata

SEQ ID NO: 25894 - DNA, 283 bp, Homo sapiens
  AL121578.1_241226
  Located on chromosome X
  Distance between a terminus base of telomere on chromosomal short arm and 5'-terminus of this base sequence : 34250535
  Distance between 3'-terminus of neighbour sequence of sequence listing upward to telomere on chrosomal short arm and 5'-terminus of this base sequence : 96848
ccatcttgagttcatttatcactctttgggtcacccacaatgctttgtgcctttgcaccaccaatcatattgcactctgacaccccctcaacacacacacacacacacacacacacacatgcacacacttaattgtaagcttctttagtggtagaccagtggtttctttgcttctgtgttgcagtatctagcatggcacctgactcatcaaaaacaatcagtggcttgattgaataagtaactcagagcccacaaatgcctctaggagttgtcatttgcagac

SEQ ID NO: 25895 - DNA, 407 bp, Homo sapiens
  AL121578.1_310468
  Located on chromosome X
  Distance between a terminus base of telomere on chromosomal short arm and 5'-terminus of this base sequence : 34319619
  Distance between 3'-terminus of neighbour sequence of sequence listing upward to telomere on chrosomal short arm and 5'-terminus of this base sequence : 68801
tcggttgtctaagataggttacacaggaatcacaaggaatgtcagttctggcactaaaacattgtcctctgaaaatggaaacctcaaagcctatcaagttcatccatgtctctgatgtctataatcctccagttacaggcatgagctgtctccctcactggtcttgttgttgtctcattctcatactgctctgagtgtccccttgcccaactctcttccagactttgatgcctctggactattgccgtacacacacacacacacacacacacacacacacacacacacacacatttcatagtaaagtgaccttttgccttagtccacttgtgttgctataaaggaatagctgaggctgggtaatttataaagaaaagaggtttacgtttacttggttcatggttctg

SEQ ID NO: 25896 - DNA, 201 bp, Homo sapiens
  AL121578.1_312529
  Located on chromosome X
  Distance between a terminus base of telomere on chromosomal short arm and 5'-terminus of this base sequence : 34321839
  Distance between 3'-terminus of neighbour sequence of sequence listing upward to telomere on chrosomal short arm and 5'-terminus of this base sequence : 1813
tatgtttacagctgcactattcacaagagcaaagctatggaatcaatctaagtgtgcatcaagagatgattggatagagaaaatgtgatacacacacacacacacacacacacacaatggaatactactcagccataacaaaaagaatgaaatcatgtcctttgcaacaacatggatggaactggaggccattaagtaaac

SEQ ID NO: 25897 - DNA, 464 bp, Homo sapiens
  chrX.fa.O7frz.32151324
  Located on chromosome X
  Distance between a terminus base of telomere on chromosomal short arm and 5'-terminus of this base sequence : 34626626
  Distance between 3'-terminus of neighbour sequence of sequence listing upward to telomere on chrosomal short arm and 5'-terminus of this base sequence : 304586
gaggttatttggtctttaggatatattcctcaaagaatttaagggggttaaaagggtttcatttaaaaatcacttgaaatagtacttctgtggttgtgccaccaaactgaactataattagatttcatcactacaatctaatttaattttggttttgtgtaaaaattattctatgattctgaagtcaaaattatagaataaggtacattcagagagtcctaacttccttcattgttcttgttcacatatccccacatatttccttccccctcctctaagtaatatttctttattaattttttccttccattgtttcttattgaagcaagtgtgtgtgtgtgtgtgtgtgtgtgtgtgtgtgtcccaagaccttttttgtgccaaaggtggcaagctatacgtattttacttcaccttgctttttttggttttaacagtatatcttggagattacctacaatggt

SEQ ID NO: 25898 - DNA, 186 bp, Homo sapiens
  chrX.fa.O7frz.32233941
  Located on chromosome X
  Distance between a terminus base of telomere on chromosomal short arm and 5'-terminus of this base sequence : 34709450
  Distance between 3'-terminus of neighbour sequence of sequence listing upward to telomere on chrosomal short arm and 5'-terminus of this base sequence : 82360
atataatcttggtcaggtccagattgctcatctcaaggggagtttcacatacttgttgtgcttctccatgaagaagggaaataaggaagcagggaattccttgggaaatctgcagggtttttttgtttgtttgtttgtttgtttgtttgtttgtttgtttgcctttgtaaggatttgtaacatgtt

SEQ ID NO: 25899 - DNA, 392 bp, Homo sapiens
  chrX.fa.O7frz.32380637
  Located on chromosome X
  Distance between a terminus base of telomere on chromosomal short arm and 5'-terminus of this base sequence : 34856193
  Distance between 3'-terminus of neighbour sequence of sequence listing upward to telomere on chrosomal short arm and 5'-terminus of this base sequence : 146557
gtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagat

SEQ ID NO: 25900 - DNA, 437 bp, Homo sapiens
  chrX.fa.O7frz.32497572
  Located on chromosome X
  Distance between a terminus base of telomere on chromosomal short arm and 5'-terminus of this base sequence : 34973151
  Distance between 3'-terminus of neighbour sequence of sequence listing upward to telomere on chrosomal short arm and 5'-terminus of this base sequence : 116566
cttctatttcacatgttgaggtctctttggaaacatcagttaagcttatattgtgtgtgtgtgtgtgtgtgtgtgtgtgtgtgtgtgtgtgtgtatgtgtgtgtgtgttttgagacggggtctcactctgttgcccaggctggagtgcagtggcatgatctcggctcactgcaacttccgccccctgggttcaagtgattctcctgcctcagcctcccaagtagctgggattacaggcatgcacaaccatgcccagctaaatttttttgtatttttagtagagatggggtttcactatgttggccaggctggtctcaaactcctgacctcaagtgatctacccacctcagcctcccaaagtgctgggattacaggtgtgagccactgcgcctggcctatattatgttgtctttgtcttctctatccaacatttcctc

SEQ ID NO: 25901 - DNA, 408 bp, Homo sapiens
  chrX.fa.O7frz.32584400
  Located on chromosome X
  Distance between a terminus base of telomere on chromosomal short arm and 5'-terminus of this base sequence : 35059726
  Distance between 3'-terminus of neighbour sequence of sequence listing upward to telomere on chrosomal short arm and 5'-terminus of this base sequence : 86138
gtaagcatagctttaactgcaccccacaagttttgctatgctatatttttattaccactcagttcaaagtttttttctaacctttattgggatttttttttttacctgggagttatttagaagtataatacttaagttccaaatatttgaggattttccagttatatatccttaaattgctttttaatttattctagctgtggtcagggaacatactctaagtgatctcaattgttcaaaatttattcgatgtgctttatggcccagctatatataattttggtaaatgtttcatgtacacttgatatatatatatatataatatatagtatgcaatattaaacatatgcacaaaatatatcaattaaatcaagtttgttatttgtatgtttcaaatcttccttattg

SEQ ID NO: 25902 - DNA, 396 bp, Homo sapiens
  chrX.fa.O7frz.32672455
  Located on chromosome X
  Distance between a terminus base of telomere on chromosomal short arm and 5'-terminus of this base sequence : 35147849
  Distance between 3'-terminus of neighbour sequence of sequence listing upward to telomere on chrosomal short arm and 5'-terminus of this base sequence : 87715
agtttagcttggctttaggtcgggtggcttccttccctaaaacctgacccagacccagtgaaaaaaatgagaaatacagcagtggataactctttgtcctggtgagcacagaactcagagaccacgaaaatgtgtattcccctctctctggtcccaggtgacattaaagactaataattttcatttatataaattacttctatttttgtatcttaccttatgaggcaataaaattaatatatatatatatatatatatatatatatgctcaatgaatgggaatcagattaagttgaagattgttttggatttcatcacttaaaaatgtcagccacttgagaaggttcaccatgtgatagtgggaagtagaatgtatgagttgataggtctattcca

SEQ ID NO: 25903 - DNA, 251 bp, Homo sapiens
  DXS1068
  Located on chromosome X
  Distance between a terminus base of telomere on chromosomal short arm and 5'-terminus of this base sequence : 35224591
  Distance between 3'-terminus of neighbour sequence of sequence listing upward to telomere on chrosomal short arm and 5'-terminus of this base sequence : 76346
cctctaaagcatagggtccagggcaagaatattttgtgtttgagaccaggagaggaagtgctcatgactgagggtgctgggtcacgcctaagatggagtggcctctatcattatgactaaggttctagggacactcccttctaccacacacacacacacacacacacacacacacacacacataaaagcaggccatggtctgggtcttagaaatgatcaatatagtaaaaaacagcgtgttctcagatggg

SEQ ID NO: 25904 - DNA, 220 bp, Homo sapiens
  DXS8016
  Located on chromosome X
  Distance between a terminus base of telomere on chromosomal short arm and 5'-terminus of this base sequence : 35291163
  Distance between 3'-terminus of neighbour sequence of sequence listing upward to telomere on chrosomal short arm and 5'-terminus of this base sequence : 66321
ttttagaagccaccattccctttggaagcaccatttctaacatagtgtttctctctaattgagtatcatttgcatctctctctctctctctgtctctctctctctctctgtctctctctctctctctctctctgtgtgtgtgtgtgtgtgtgtgtgtgtgtggtgttttcatgggtggtcatttgtcttttgtagtggatcctgggactgggttgcttga

SEQ ID NO: 25905 - DNA, 273 bp, Homo sapiens
  DXS8014
  Located on chromosome X
  Distance between a terminus base of telomere on chromosomal short arm and 5'-terminus of this base sequence : 35334366
  Distance between 3'-terminus of neighbour sequence of sequence listing upward to telomere on chrosomal short arm and 5'-terminus of this base sequence : 42983
ggcaaagttgtcagaggcactgtgtggtcacacacacacacacatacacacacacacacacacacacacacacacacacacacacacactgtatttagtcagagcagaagaaagcctttcagtggatccaggtaaacaatgaattgccgtgtgctctctgcagaggggctccctgataatcagcagggttgaaagcagtggctgttttctgtgggtccccttgtagcctctcatcaccctctgcctattagtgaaactggaacaagccatttg

SEQ ID NO: 25906 - DNA, 240 bp, Homo sapiens
  DXS8102
  Located on chromosome X
  Distance between a terminus base of telomere on chromosomal short arm and 5'-terminus of this base sequence : 35403888
  Distance between 3'-terminus of neighbour sequence of sequence listing upward to telomere on chrosomal short arm and 5'-terminus of this base sequence : 69249
gtgaccttcctgagaggcaaagaaaattaagccccatcatacacacacacacacacacacacacacacacacgcaaactgtgactgacagatttgaaagagtagggtgtgtgtgtgtgtgtgtgtgaaagagagagtgaaagagaaagacagagggaagggacaggaaggaaaaggaaggaaggaaggaagggagggaatcaaatgagtaactgtttggggtgggatgaattggttagct

SEQ ID NO: 25907 - DNA, 239 bp, Homo sapiens
  chrX.fa.O7frz.33052269
  Located on chromosome X
  Distance between a terminus base of telomere on chromosomal short arm and 5'-terminus of this base sequence : 35532994
  Distance between 3'-terminus of neighbour sequence of sequence listing upward to telomere on chrosomal short arm and 5'-terminus of this base sequence : 128866
accattaccaagctaccactacatgaactgctaaaaggagctctaaatcttgaaacaaatcctggaaacacatcaaaacagaacctctttaaagcataaatcatacagtacctataaaacaaaaatacaagttaaaaagcaaacaaacaaacaaacaaacaacaaaaaaaaaaacccaccaaagtacacaggcaacaaagaacatgaggaatgcaatggtacctcaaatttcaatacta

SEQ ID NO: 25908 - DNA, 199 bp, Homo sapiens
  DXS8025
  Located on chromosome X
  Distance between a terminus base of telomere on chromosomal short arm and 5'-terminus of this base sequence : 35857758
  Distance between 3'-terminus of neighbour sequence of sequence listing upward to telomere on chrosomal short arm and 5'-terminus of this base sequence : 324525
tgggtaattctttgacatcactctctggttcaataatttctgtttaacttatatactgagattttttatttcaatgactctgtgtgtgtgtgtgtgtgtgtgtgtgtgtgtgtgtgtgtgtgtgtgtgttttgttttttgacatttcttttttttgttttgttttgttttgagacagagtcttgctctgctgcccagct

SEQ ID NO: 25909 - DNA, 275 bp, Homo sapiens
  DXS1058
  Located on chromosome X
  Distance between a terminus base of telomere on chromosomal short arm and 5'-terminus of this base sequence : 35932836
  Distance between 3'-terminus of neighbour sequence of sequence listing upward to telomere on chrosomal short arm and 5'-terminus of this base sequence : 74879
acatgaaccactgggcctctctgtgcctctgtgcctatgcacatgctatttgctgagtggaatgaactccccctccctcacctacctccagccttgtctgcctggcaggctcctactcacccttcaaaacccagtttcccttctgtaaggccaccttttattccctccagagattctcaccctctcctctgtctccctacagtgtcttacacacacacacacacacacacacacacacacacacacacaaataaagataataattgccacacagt

SEQ ID NO: 25910 - DNA, 119 bp, Homo sapiens
  DXS8018
  Located on chromosome X
  Distance between a terminus base of telomere on chromosomal short arm and 5'-terminus of this base sequence : 36108186
  Distance between 3'-terminus of neighbour sequence of sequence listing upward to telomere on chrosomal short arm and 5'-terminus of this base sequence : 175075
gaataccccacccaccccatctcacatacatgcatgtgcgcacgcacgcacacacacacacacacacacacacacacacaaaggttaacatttactctcctctccttacgcccatgtgt

SEQ ID NO: 25911 - DNA, 186 bp, Homo sapiens
  DXS8015
  Located on chromosome X
  Distance between a terminus base of telomere on chromosomal short arm and 5'-terminus of this base sequence : 36120459
  Distance between 3'-terminus of neighbour sequence of sequence listing upward to telomere on chrosomal short arm and 5'-terminus of this base sequence : 12154
agtcttctcaggccagagcatgtaaccctgactttcttggccttacacacaagcacacccatacacatacacacacacacacacacacacacacacacacacacacacctgctgctttgatattggtgcatttgcattatttaacttggtttctttttccctaaaaagcatgtgaaagttggtcct

SEQ ID NO: 25912 - DNA, 165 bp, Homo sapiens
  DXS8042
  Located on chromosome X
  Distance between a terminus base of telomere on chromosomal short arm and 5'-terminus of this base sequence : 36181720
  Distance between 3'-terminus of neighbour sequence of sequence listing upward to telomere on chrosomal short arm and 5'-terminus of this base sequence : 61075
ctagtatgaatttcccatgaggccaaggaatatgaaaacccaaatttctgactttttttttcttgttgcttcctccttccttcaggtaaaacacacacacacacataaacacacacacacacacacacacacacacacacacttgtttcatcccctggtctttga

SEQ ID NO: 25913 - DNA, 282 bp, Homo sapiens
  HUMUT661B
  Located on chromosome X
  Distance between a terminus base of telomere on chromosomal short arm and 5'-terminus of this base sequence : 36181727
  Distance between 3'-terminus of neighbour sequence of sequence listing upward to telomere on chrosomal short arm and 5'-terminus of this base sequence : -158
gaatttcccatgaggccaaggaatatgaaaacccaaatttctgactttttttttcttgttgcttcctccttccttcaggtaaaacacacacacacacataaacacacacacacacacacacacacacacacacacttgtttcatcccctggtctttgagttcatgcccaattccttctggtcttttccttgggaggcaaagtggcatgaacccaagctgaggaatcagatgggctgggctgaaccccagctctgccacccacccatgggcagggcagtttac

SEQ ID NO: 25914 - DNA, 250 bp, Homo sapiens
  DXS1056
  Located on chromosome X
  Distance between a terminus base of telomere on chromosomal short arm and 5'-terminus of this base sequence : 36186532
  Distance between 3'-terminus of neighbour sequence of sequence listing upward to telomere on chrosomal short arm and 5'-terminus of this base sequence : 4523
gccactacaccctggctgattttgtgtgtgtgtgtgtgtgtgtgtgtgtgtgtgtgtgtgtatttttagcagagacagggtttcaccatgttgcccaggctggtctcaaactcctgacctcaagtgatccgcctgcctcggcctcccaaagtgctgggattacaggcgtgagccaccgtgcccggccacttcttgctttcttagtcaaccactggagtctatgcttacacttcctgacaaccgcaacaag

SEQ ID NO: 25915 - DNA, 132 bp, Homo sapiens
  DISD22_0007235
  Located on chromosome X
  Distance between a terminus base of telomere on chromosomal short arm and 5'-terminus of this base sequence : 36279525
  Distance between 3'-terminus of neighbour sequence of sequence listing upward to telomere on chrosomal short arm and 5'-terminus of this base sequence : 92743
tagcagagcggttcactgtcgtgtgtgtgtgtgtgtgtgtgtgtgtgtgtgtgtgtgtgtgtgttttgggagggaaggggtggaggatggggctgaacataaaagcaaaaggggggaacacattgttggatc

SEQ ID NO: 25916 - DNA, 399 bp, Homo sapiens
  chr17.fa.O7frz.23680543
  Located on chromosome X
  Distance between a terminus base of telomere on chromosomal short arm and 5'-terminus of this base sequence : 36643851
  Distance between 3'-terminus of neighbour sequence of sequence listing upward to telomere on chrosomal short arm and 5'-terminus of this base sequence : 364194
aagtttatttggctcacaattctgaagagtgtacaagaagcatggcaccagcgtctgcttctggtgaggcctcaggaagcttccactcatggcagaaggcaaggggagctggggtgtcacgtggcaagaggggaagcaaggaagatgccaggctctgtttgtttatttatttatttatttatttatttatttatttatttatttatatattagatggagttttgctcttgtagcccaaactggagtgcaatggtgtgatctcggcttactgcaacctctgcctcccgggttcaagcagttctcctgtctcagcctcccaagtagctgggattataggagcctaccaccacgcccaacataagatttggaggggacaaatatccaaaccatatcaggaat

SEQ ID NO: 25917 - DNA, 350 bp, Homo sapiens
  chrX.fa.O7frz.34268694
  Located on chromosome X
  Distance between a terminus base of telomere on chromosomal short arm and 5'-terminus of this base sequence : 36764574
  Distance between 3'-terminus of neighbour sequence of sequence listing upward to telomere on chrosomal short arm and 5'-terminus of this base sequence : 120324
ggagtttagattgctattaaggtctttcaaatgctaacgaaccacccctagggtaagtataatcacacacacacacacacacacacacacacacacacacgcaccactctgcatatatagaggtgttttagagtaaattgtcacacagataatataataccattctgggcttgatgaggtgctacatgtggccttttaagaagttctccctttccttgatttcactgggagggaaaagaggtaactaacaaaactttgagccaatcaggggaagccctgtggtgcatagggaggtaaggatctcagaggaccatggagaggccccgtgctatcaaggagtcctctgactc

SEQ ID NO: 25918 - DNA, 461 bp, Homo sapiens
  chrX.fa.O7frz.34548149
  Located on chromosome X
  Distance between a terminus base of telomere on chromosomal short arm and 5'-terminus of this base sequence : 37078138
  Distance between 3'-terminus of neighbour sequence of sequence listing upward to telomere on chrosomal short arm and 5'-terminus of this base sequence : 313214
aggaacgacctcataaactaagctgaagagaacagactttatcacaggcagtgagaagccactgtaaggtttatgtgtaaccaacaacaggttcatcttgcccactgcccagatagagccaatttatcaagacagaggaactgcaatagagaaagagtttcatacatgtagagctggctaaacagaagactgggtttgtgtgtgtgtgtgtgtgtgtgtgtttttgtgtgtgtgtgtgtgtgcgtgtgtgtgtgtgttttgagacagagtctcactttgttgcccagcctggagtacagtggtgcaatctcagttcactgcaacctccgccttgactagggttttattattactcaaatcagcctctctgaacattcagaggctagggttttttaaagacagtttggcaggcagggggttagggaatgggtactgctgattggttggaggtgcaatcatag

SEQ ID NO: 25919 - DNA, 287 bp, Homo sapiens
  chrX.fa.O7frz.34022149
  Located on chromosome X
  Distance between a terminus base of telomere on chromosomal short arm and 5'-terminus of this base sequence : 37324652
  Distance between 3'-terminus of neighbour sequence of sequence listing upward to telomere on chrosomal short arm and 5'-terminus of this base sequence : 246053
caacagagcaagactccatctaaaatatatatatatatatatatatatatatatatatatatatatatatatatatatatatatatgtatgtatatatatacaccaaagttcctcaccttttggtaagacagatgtgttggtgaccaaaacagagcaaacggaatcctgaatgagactgaagggctgcagctatgtggtagaaaagacaggagactaccctaaggcctctttgcctacaacacagatgcctaacaatatttttttctaaggttctcagtgacagttg

SEQ ID NO: 25920 - DNA, 306 bp, Homo sapiens
  DXS993
  Located on chromosome X
  Distance between a terminus base of telomere on chromosomal short arm and 5'-terminus of this base sequence : 37596997
  Distance between 3'-terminus of neighbour sequence of sequence listing upward to telomere on chrosomal short arm and 5'-terminus of this base sequence : 272058
ggatcctgtttacagcctgtgacagtgatgtctggtgaaagagagaaagaaaacgtaagagggacatgggaaatcaagaaacacccaagagacagggaatgagtaggatgcgttcaagggctaggtcagccttgggaaggtgcatgaccactcagccagtttgcttcaggaaggatctgatgggcacatggagacacaaacacacacacacacacacacacacacacacacacacacccccagaggtgaaggcaaggccagttcaccaggcctgggaagaggaggccccagtgaactgctctgtag

SEQ ID NO: 25921 - DNA, 362 bp, Homo sapiens
  chrX.fa.O7frz.35074664
  Located on chromosome X
  Distance between a terminus base of telomere on chromosomal short arm and 5'-terminus of this base sequence : 37773126
  Distance between 3'-terminus of neighbour sequence of sequence listing upward to telomere on chrosomal short arm and 5'-terminus of this base sequence : 175823
acattcagaccataactgtgattatcttttactgttttttactctatgtaatatgtctttttgttttggatacttttaagaattttctatctttggctatgatgggccgtgcgtgtgtgtgtgtgtgtgtgtgtgtgttttatgttacttggggcttgctaagcttcttgttttaatcaaatttggaaactgtcatcaactatcttttagccatattctgtatcttctctcctctgagactccacatacatgtatattagtctaattgcttgatattgttccacaggtcattgaggctctgataatttttcccccagtcttctttttattttctctctgtgcttcactttggttaataacta

SEQ ID NO: 25922 - DNA, 460 bp, Homo sapiens
  chrX.fa.O7frz.35337558
  Located on chromosome X
  Distance between a terminus base of telomere on chromosomal short arm and 5'-terminus of this base sequence : 38018464
  Distance between 3'-terminus of neighbour sequence of sequence listing upward to telomere on chrosomal short arm and 5'-terminus of this base sequence : 244976
gacttcaccttaagacaattgtatctagaaattcaaaagaagtgattggtaataaaatggccaggaaaccttggccctagaaagagacagtgaagtggagaattctgggcactgatatatgatgccttttaaattcgctaaatctcactgcaatccaagtcactgtttcccagggtatagattttgtgtgtgtgtgtgtgtgtgtgtgtgtgtgtgtgtgtgtgtgtgtgtgtgttttgtacctggggtgatacaatggaacagcattatttttggaattctatcctcaactgctttattcatagaaatctttatctacttttggctttttaaagaatctacagaaaagaatggttagttctgaagcataatatgaaccaagtttgactgatttgaagatgtcaaaattcaaaatttgtccctcaaatatatttttgcctcacgtaattcaatgctaaag

SEQ ID NO: 25923 - DNA, 470 bp, Homo sapiens
  chrX.fa.O7frz.35541734
  Located on chromosome X
  Distance between a terminus base of telomere on chromosomal short arm and 5'-terminus of this base sequence : 38162428
  Distance between 3'-terminus of neighbour sequence of sequence listing upward to telomere on chrosomal short arm and 5'-terminus of this base sequence : 143504
caatatacagtccaagtcaagaaccaaaatatataagtaacttgtaaatacaataagaaaaaaaacacactccaataaaatctgggcaaaagacttgaacaaacactttacaaagagaaaggcctgcgtggtttggtctccaaccctctccagtttcacctgaaatcacagagaaatccttaattttcctcaaacttcaaattagaattgtttgaaattactagaggaaaggaagtaatttctatgagcacagccactggtctagctatttgctgacccagacctcacagttgaatcagctgagatgatttaaagatgcccataccctggtccagggaacatgcgcgcgcgcgcgggcgcgcgcacacacacacacacacacacacacacacacacacacacacacacacacggttccctgtggttaccagttataaaagaaatatctgaactcagttaagataatccaa

SEQ ID NO: 25924 - DNA, 205 bp, Homo sapiens
  AL023875.1_114638
  Located on chromosome X
  Distance between a terminus base of telomere on chromosomal short arm and 5'-terminus of this base sequence : 38541167
  Distance between 3'-terminus of neighbour sequence of sequence listing upward to telomere on chrosomal short arm and 5'-terminus of this base sequence : 378269
agtggttctcaactttagctgtacattagaatcacttgagaagcttttataaaatagcttgcctaggtgttaatacagaccatttaaatcagaatttctggggagtagaatctgggcatctctgtgtgtgtgtgtgtgtgtgtgtgtgtgtgtctttttaagcttctcaggtgatgctgatgtacaatgaggtttaattactggc

SEQ ID NO: 25925 - DNA, 279 bp, Homo sapiens
  DXS1201
  Located on chromosome X
  Distance between a terminus base of telomere on chromosomal short arm and 5'-terminus of this base sequence : 38700673
  Distance between 3'-terminus of neighbour sequence of sequence listing upward to telomere on chrosomal short arm and 5'-terminus of this base sequence : 159301
ggaaacttcaacactgtactctcaaaaattggtagtactacattaaaaggttaagaaagaaatactgtgtgtattagagttttccagaaaaaaagaaccaatattttatacacataaatattgtgtgtgtgtgtgtctgtgtgtgtgtgtgtgtgtgtgtgtgtgtgtgtgtgtgtgtgtgtggaggggagggagagagaaggggagagagaaagaggtttattaaaaggtattggctcatgcagttgtggaggctgagaagtcccctgatctgccatt

SEQ ID NO: 25926 - DNA, 159 bp, Homo sapiens
  DXS8085
  Located on chromosome X
  Distance between a terminus base of telomere on chromosomal short arm and 5'-terminus of this base sequence : 38774867
  Distance between 3'-terminus of neighbour sequence of sequence listing upward to telomere on chrosomal short arm and 5'-terminus of this base sequence : 73915
tcaaagaggttttgccacaaactagatatgggttccaactcctggatcattttgaattcgctagttcagactgaagatgacaggtgattcagagtacacacacacacacacacacacacacacacactgccctgggaactaggcaggatgtctttatct

SEQ ID NO: 25927 - DNA, 258 bp, Homo sapiens
  Z93403.1_59189
  Located on chromosome X
  Distance between a terminus base of telomere on chromosomal short arm and 5'-terminus of this base sequence : 38777812
  Distance between 3'-terminus of neighbour sequence of sequence listing upward to telomere on chrosomal short arm and 5'-terminus of this base sequence : 2786
tagcatgagagcaatcatagaccaatacaatacaatacaatacaatacaatacaatacaatacaatacaatactaaattattgagcatagctgtgttccaataaaactctatttacaaacatagatgactgtctatatttggtatgtggccatagattgccaacccttgctctaggtaaataaacttccatgcaaagtgattaaatgatcctcccaactttatatagctggtagaagtatgaatggaacctagacctc

SEQ ID NO: 25928 - DNA, 244 bp, Homo sapiens
  Z93403.1_10645
  Located on chromosome X
  Distance between a terminus base of telomere on chromosomal short arm and 5'-terminus of this base sequence : 38826245
  Distance between 3'-terminus of neighbour sequence of sequence listing upward to telomere on chrosomal short arm and 5'-terminus of this base sequence : 48175
tactctgagtatctggattccaacatttcctcttacactgaacttctcatggtcacctcatctggggttggagtatgtgcgctccttacgttttatgtgctgggcaggaggtaagttcacaggaatgtatggttttgtgtgtgtgtgtgtgtgtgtgtgtgtgtgtgtgtgtgtgtgtgtgtgtacacaagcagctgccaccctcaggccctgggacgatcttcgtactcaagtggagtacatt

SEQ ID NO: 25929 - DNA, 218 bp, Homo sapiens
  DISO7_10004630
  Located on chromosome X
  Distance between a terminus base of telomere on chromosomal short arm and 5'-terminus of this base sequence : 38955152
  Distance between 3'-terminus of neighbour sequence of sequence listing upward to telomere on chrosomal short arm and 5'-terminus of this base sequence : 128663
ttctagaactatgcaaacaatggggatttgttattctccttaaatgttgtatggaaaatatttgtgtgtgtgtgtgtgtgtgtgtgtgtgtgtgtgtgtgtcttaagggaaaatgaggtgtttaattacagagagagactcctttagagtatttcctaatgacaggaatttataactttagggatgtttggtttctttccaagtttggaccttagctt

SEQ ID NO: 25930 - DNA, 277 bp, Homo sapiens
  chrX.fa.O7frz.37778030
  Located on chromosome X
  Distance between a terminus base of telomere on chromosomal short arm and 5'-terminus of this base sequence : 39092793
  Distance between 3'-terminus of neighbour sequence of sequence listing upward to telomere on chrosomal short arm and 5'-terminus of this base sequence : 137423
tctggcagattgtataagtcaggattctctggagaaacaaaaccaacaaaaatacagatagatagatagatagatagatagatagatagatagataagaagagatttatcatgggaattagcttgcatgattatggataccaagaaccagaaaagccagtggtgtaattaagtttgagtttgaaggcctcagaaccaggggagccaatggtgtaactcgcaatttacggcagtagtctcgagaaccagagggatgctgatgtaaatcatggagtctg

SEQ ID NO: 25931 - DNA, 417 bp, Homo sapiens
  chrX.fa.O7frz.37590128
  Located on chromosome X
  Distance between a terminus base of telomere on chromosomal short arm and 5'-terminus of this base sequence : 39271479
  Distance between 3'-terminus of neighbour sequence of sequence listing upward to telomere on chrosomal short arm and 5'-terminus of this base sequence : 178409
atggacagtaatctgaatagacacttaaccaaagaagatatacaaatggccaacaggtatatggaaaatatgctcaatatcactaatcatcaggaaaatgcaaatcaaaatcacaatgggatgaaagctcatcccagtcaaaatggctattatcaaaaagacaaacatatatatatatatatatattttatatgtatatattatatatatattatatataaaatatatacatataaaaaatatatatataatatatacatataaaatatatatatattaaacaaatgccattgaagatgcagggaaagggaaatgccagtacactgttggtgggaatatagattactacagctgctaggagaaactgtatagaggttcctttaaaaactaaaaatctatctaccatacgattcagca

SEQ ID NO: 25932 - DNA, 221 bp, Homo sapiens
  DXS6810
  Located on chromosome X
  Distance between a terminus base of telomere on chromosomal short arm and 5'-terminus of this base sequence : 39419816
  Distance between 3'-terminus of neighbour sequence of sequence listing upward to telomere on chrosomal short arm and 5'-terminus of this base sequence : 147920
cccagccctgaatattatcatatactttgaaaatgttatctacatgatagggagtagatatatgatagatgatagatagatagatagatagatagatagatagatagatagatagatagatagacagacagatagatagacaggtagagatgtagatatggttaatgaccacatatattttgggcaggacattttacttaaggtcccaaaaggttttctgt

SEQ ID NO: 25933 - DNA, 194 bp, Homo sapiens
  AL022158.1_49900
  Located on chromosome X
  Distance between a terminus base of telomere on chromosomal short arm and 5'-terminus of this base sequence : 39578978
  Distance between 3'-terminus of neighbour sequence of sequence listing upward to telomere on chrosomal short arm and 5'-terminus of this base sequence : 158941
tcctggctcttaggctagatagactatagaaagtaggatttcttgttgttgttgttgttgttttcccttggtgtttgcctattgatgtttctgagttgctggcttctccagtgcccggtttggaaaatatgtgtcaaacacacacacacacacacacacacacgattcaccactaatcactcctttgatcctga

SEQ ID NO: 25934 - DNA, 408 bp, Homo sapiens
  chrX.fa.O7frz.37141238
  Located on chromosome X
  Distance between a terminus base of telomere on chromosomal short arm and 5'-terminus of this base sequence : 39742981
  Distance between 3'-terminus of neighbour sequence of sequence listing upward to telomere on chrosomal short arm and 5'-terminus of this base sequence : 163809
attagaactaccatttgatccagcagtcccactactgggtacctatccagaggaaaataagtcattatatgaaaaagatacttgcacacgcatgttcatagtagcacaatttgcaattgcaaatatatggaaccagcccaaatgcccatcaatcaatgagtggataaagaaattgtgtgtgtgtgtgtgtgtgtgtgtgtgtgtgtgtgcatatatatgtgtatatatatatatatatgatggaatactactcagccataaaaaggaatgaattaatggcattcacagaaacctggaaggaactggagactattattctaagtgaagtaactcaggaatggaaaacgaaacatcatatattctcacttataagtgggagctaagctatgaggatacaaaagcattaga

SEQ ID NO: 25935 - DNA, 217 bp, Homo sapiens
  Z97181.1_32862
  Located on chromosome X
  Distance between a terminus base of telomere on chromosomal short arm and 5'-terminus of this base sequence : 39862582
  Distance between 3'-terminus of neighbour sequence of sequence listing upward to telomere on chrosomal short arm and 5'-terminus of this base sequence : 119193
agaataagaatcagcttgcataaccaagttcatcatcaggcaacgtgagcttgctttattcatgaccactgaaactcatgtcagtaactagaatgagaattgaaagcacagcccatatcagtgtccaaaaaaagtctacacacacacacacacacacacacacacacacacacacacacatcaatgccttttcctggtcattgtacttgtctattca

SEQ ID NO: 25936 - DNA, 171 bp, Homo sapiens
  Z97181.1_34888
  Located on chromosome X
  Distance between a terminus base of telomere on chromosomal short arm and 5'-terminus of this base sequence : 39864717
  Distance between 3'-terminus of neighbour sequence of sequence listing upward to telomere on chrosomal short arm and 5'-terminus of this base sequence : 1918
ccttggttaagataatgctatcattttaacacacacacacacacacacacacacacacacacaaatatttatgtatatataatttttgaatttatcttcctctgtttattatttctcttctcccccagggatttttcccccaactgtgtctaggcacataggactgacaag

SEQ ID NO: 25937 - DNA, 236 bp, Homo sapiens
  Z97181.1_135052
  Located on chromosome X
  Distance between a terminus base of telomere on chromosomal short arm and 5'-terminus of this base sequence : 39964758
  Distance between 3'-terminus of neighbour sequence of sequence listing upward to telomere on chrosomal short arm and 5'-terminus of this base sequence : 99870
ccattaaggtcagaactgacatggatttcagtctctccttatgagatcccagactgcattttcccttccccactttacagttatcttttctcatgacacactgctctgtggacttaacattctaacatcagatacaaagaaacacagacatacacacacacacacacacacacacacacacacacacacacacatccttgtggctctgtctctctagttgaaccataatggataca

SEQ ID NO: 25938 - DNA, 172 bp, Homo sapiens
  HUMUT1223
  Located on chromosome X
  Distance between a terminus base of telomere on chromosomal short arm and 5'-terminus of this base sequence : 40026002
  Distance between 3'-terminus of neighbour sequence of sequence listing upward to telomere on chrosomal short arm and 5'-terminus of this base sequence : 61008
aaggggattagaagatttggcctttcctaaagcagagaattatgtatctgaaaggaagtacaaaatacagataggcataggtatagattagatagatagatagatagatagatagatagatagatagatagataggaatggttttatatatcaagggcaagtttgtgtgtat

SEQ ID NO: 25939 - DNA, 250 bp, Homo sapiens
  Z67126
  Located on chromosome X
  Distance between a terminus base of telomere on chromosomal short arm and 5'-terminus of this base sequence : 40036969
  Distance between 3'-terminus of neighbour sequence of sequence listing upward to telomere on chrosomal short arm and 5'-terminus of this base sequence : 10795
ggctctggagatacagcaataagcaaaaatgagcaaagaccctattttcgtgtaggcttaattaaataacatacaaaaaatgtgtgtgtgtgtgtgtgtgtgtgtgtgtagtgccaggtagtaatgtgtactaagaagaaaaataaattcagggtagcagggacagagtgtgacagatgactatattgattgtctgcattgatggtggggtcactgggcattttttatgaggagtacactacatttccag

SEQ ID NO: 25940 - DNA, 277 bp, Homo sapiens
  AL109855.16_76095
  Located on chromosome X
  Distance between a terminus base of telomere on chromosomal short arm and 5'-terminus of this base sequence : 40044756
  Distance between 3'-terminus of neighbour sequence of sequence listing upward to telomere on chrosomal short arm and 5'-terminus of this base sequence : 7537
gtaagtcagtggacgaaagaggaaggggtgctcaacagtcaactgacacaatatgaaggcaaacaaaacaaaacaaaacaaaacaaaacaaaacaaaaaccctcgcatttgacagaagttcattaattaatgagcccctttgctagagtacacaaatagagtgttaaagactagggattgagagtaaagacaaaactagactgttgaagtgactggaaagaaaggaagcatctatctaactagaagatgcttcagttagactaataacagaatggcg

SEQ ID NO: 25941 - DNA, 136 bp, Homo sapiens
  DXS8035
  Located on chromosome X
  Distance between a terminus base of telomere on chromosomal short arm and 5'-terminus of this base sequence : 40150621
  Distance between 3'-terminus of neighbour sequence of sequence listing upward to telomere on chrosomal short arm and 5'-terminus of this base sequence : 105588
cccaacaaaagcatcctgcacatctatatctatatctatatctatatctatatctatatctatatctatatctatatctacacatagacacacacacacacacacacacacacacagagtcttgctctgctgccca

SEQ ID NO: 25942 - DNA, 78 bp, Homo sapiens
  DXS6741
  Located on chromosome X
  Distance between a terminus base of telomere on chromosomal short arm and 5'-terminus of this base sequence : 40220398
  Distance between 3'-terminus of neighbour sequence of sequence listing upward to telomere on chrosomal short arm and 5'-terminus of this base sequence : 69641
tcctctatacccagcctttgtgtgtgtgtgtgtgtgtgtgtgtgtgtgtgtgtgtggagaccatgtctcattacgttg

SEQ ID NO: 25943 - DNA, 365 bp, Homo sapiens
  AL034370.1_33350
  Located on chromosome X
  Distance between a terminus base of telomere on chromosomal short arm and 5'-terminus of this base sequence : 40294861
  Distance between 3'-terminus of neighbour sequence of sequence listing upward to telomere on chrosomal short arm and 5'-terminus of this base sequence : 74385
gtttcacatgtatttccagtcttacttacaactattctcatcactctactacccactccctactccagtcaaacttaactacttaggagtccaagaaagtgccctgaattctcctgcctcttgcctttgcttatgtcttctgtctcccaaatatgtcctttccaccttgctctgcctaataaaatcccacctatctattctctgtagccaaattcaaatgctctttcctggaagaaaagactatgaagcaattattgaaccattgatgttctcaacacacacacacacacacacacacacacacactcctagaaggaaatctatctctgttttgtgtgttgaagtggtaaagcagaagtttgaaa

SEQ ID NO: 25944 - DNA, 132 bp, Homo sapiens
  Z67403
  Located on chromosome X
  Distance between a terminus base of telomere on chromosomal short arm and 5'-terminus of this base sequence : 40344962
  Distance between 3'-terminus of neighbour sequence of sequence listing upward to telomere on chrosomal short arm and 5'-terminus of this base sequence : 49736
ggacatctcagcctccataattgcaggagtcaattccttataataaatctccttgtgtgtgtgtgtgtgtgtgtgtgtgtgtgtgtgtcctattggttctttttctctggagaaccctgactaaggcggtag

SEQ ID NO: 25945 - DNA, 356 bp, Homo sapiens
  AL034370.1_118398
  Located on chromosome X
  Distance between a terminus base of telomere on chromosomal short arm and 5'-terminus of this base sequence : 40380078
  Distance between 3'-terminus of neighbour sequence of sequence listing upward to telomere on chrosomal short arm and 5'-terminus of this base sequence : 34984
ctgcctatttgaaagaactgtaaggaaacaatgaagaagaatggcaaggggagtggctcccagggccctctattagttcctattctttatacaatgcatacaaagacacacacacacacacacacacacacacacacacacatttttctaccaccactttccatccatgtacattgtgttcatccatatctgctgttctcaatacttcttttgacttagttcactcacactgactttacatttctgaggccggaaagattgcatctcccacatgcatttatttctttgctccgtgtgttttgagagtatatttcctgaccatcaatctaccccttgtctccttagagcaaatgtag

SEQ ID NO: 25946 - DNA, 379 bp, Homo sapiens
  chrX.fa.O7frz.38632346
  Located on chromosome X
  Distance between a terminus base of telomere on chromosomal short arm and 5'-terminus of this base sequence : 40494447
  Distance between 3'-terminus of neighbour sequence of sequence listing upward to telomere on chrosomal short arm and 5'-terminus of this base sequence : 114013
gtcctacatagctacatttggtcctcacacttccaacaagaaaagttaagtagaaaacaaggcagttcttgaagcgacactactcttctctctcaaggatgctgcctctcagaagttgagcccaaaccaccaactggcagtatgaagagggaaatcaccattcagacggctgatggctaaacccactcctaaggggtgttttgtgcaactcataccacatggaacttggtaaaacaaagttgctactttactacttactacttacaccaaaaagtagtaaaccattacacacacacacacacacacacacacacacaaaacaatatattttaatcaatgaaggctaagatcaatagtcattcaactccactatttaaca

SEQ ID NO: 25947 - DNA, 390 bp, Homo sapiens
  AL133344.28_117658
  Located on chromosome X
  Distance between a terminus base of telomere on chromosomal short arm and 5'-terminus of this base sequence : 40621873
  Distance between 3'-terminus of neighbour sequence of sequence listing upward to telomere on chrosomal short arm and 5'-terminus of this base sequence : 127047
atgcctaatagacgtaccatgaaaaaaaagtaactgtaaaacaatagttctcaccctggctacacattagaatcacctatagagcttttaaaaatcctgatgcattggccacactgtccaccaccagccccccaacccccgccacagacatccaccatcccccatacacacacacacacacacacacacacacacacacacagaaatcagattctctcagggtgggcctaggcatcagtaatttttaaagctccccaagtgattacaaactgcaagccaaggttgagaactactgctacagaacaatttcactacttatgatttacagaagatcctaagtaaaatacaagcaaacagaatttaatagtctgtaacagttacaagccacct

SEQ ID NO: 25948 - DNA, 191 bp, Homo sapiens
  DXS8080
  Located on chromosome X
  Distance between a terminus base of telomere on chromosomal short arm and 5'-terminus of this base sequence : 40726191
  Distance between 3'-terminus of neighbour sequence of sequence listing upward to telomere on chrosomal short arm and 5'-terminus of this base sequence : 103928
tccttagacccaaacttcctcctccattcatatgttgcttcctggggaaaacaagggcaaagaaataggtgccctcctaccctgttggtaaatccttggtggcccatcttctgggctgctcgtgtgtgtgtgtgtgtgtgtgtgtgtgtgtgtgtgtgtgtgtgtgtgacagagttttgctcttgttgccc

SEQ ID NO: 25949 - DNA, 288 bp, Homo sapiens
  HUMUT1469
  Located on chromosome X
  Distance between a terminus base of telomere on chromosomal short arm and 5'-terminus of this base sequence : 40981953
  Distance between 3'-terminus of neighbour sequence of sequence listing upward to telomere on chrosomal short arm and 5'-terminus of this base sequence : 255571
tgcactgaaccaagattatgtcactgcactccagcctgggcaacagagcaagactctgtcaaaaaaaaaaaagaaagaaagagaaagaaagaaagaagaaagaaagaaagaaggaaagaaagaaagaaggaaagaaaaagaaagaaaaagaaagaaagaaagaaagaaagaaagaaagaaagaaagaaagaaggaaagaaagaaagaaaaaagaaggaaagaaggaaagaaacagaaaggaagaaggaaagaaagaaaacgaaatttagaagaaagcaagtttcagct

SEQ ID NO: 25950 - DNA, 161 bp, Homo sapiens
  DXS8054
  Located on chromosome X
  Distance between a terminus base of telomere on chromosomal short arm and 5'-terminus of this base sequence : 41051630
  Distance between 3'-terminus of neighbour sequence of sequence listing upward to telomere on chrosomal short arm and 5'-terminus of this base sequence : 69389
gagctatttgacccaagccaagggcaccaggctatacatgttttcttgtgtgtgtgtgtgtgtgtgtgtgtgtgtgtgtgtgtgtgtgtgtgtgagagagagagagagagagagagagatggagtttcactctatttcccaggctggagtgctgtggtgtg

SEQ ID NO: 25951 - DNA, 319 bp, Homo sapiens
  chrX.fa.O7frz.39404266
  Located on chromosome X
  Distance between a terminus base of telomere on chromosomal short arm and 5'-terminus of this base sequence : 41266464
  Distance between 3'-terminus of neighbour sequence of sequence listing upward to telomere on chrosomal short arm and 5'-terminus of this base sequence : 214673
ggaatagagcaacctttagtcttgggctaatgttgcccagtgtggaggcaatatccttgttaggattctttgggatgccacttgtattacaagtttttccactttgacttgtgggagcacaactgtgtttggtactgtttgagccatgtggatatttccagtgtttgttttaggtggtcctgggtgtgtgtgtgtgtgtgtgtgtgtgtgtgtgtgtgtgtgtgtctatgtatttatttatttattgaaacagggtcttgccctgttggctggagtgcagtggcacgatcatgtctcattatagcctttaccttccaag

SEQ ID NO: 25952 - DNA, 267 bp, Homo sapiens
  DISO7_10019236
  Located on chromosome X
  Distance between a terminus base of telomere on chromosomal short arm and 5'-terminus of this base sequence : 41369151
  Distance between 3'-terminus of neighbour sequence of sequence listing upward to telomere on chrosomal short arm and 5'-terminus of this base sequence : 102368
cgtttgttagttcagtagtctgaagataatgaaagtttagggctgggctcagtagcttatgcctgtaatcccagcactttgggaagctgaggcaggtggatcacctgaagttagaagtttgagagcaacctgggcaacatagtgagacacacatacacacacacacacgcaacatagtgtgaaacacacacacacacacacacacacacacacacccgcccgtctcttaaagaaaaagttattatttctccatacttgctctgccct

SEQ ID NO: 25953 - DNA, 211 bp, Homo sapiens
  HUMUT2106
  Located on chromosome X
  Distance between a terminus base of telomere on chromosomal short arm and 5'-terminus of this base sequence : 41581886
  Distance between 3'-terminus of neighbour sequence of sequence listing upward to telomere on chrosomal short arm and 5'-terminus of this base sequence : 212468
gctcctggctttctgcttgtcaccttgtagtacaacctcctgtctctctcctccatcgctccctcatctcccctgcctctgccctctctgtttgctgccatctatctatctatctatctatctatcatctatctatctatctatcttttatctatctatctcactttctttctctctctccccccctctttcctgcatcgtttcagtcctc

SEQ ID NO: 25954 - DNA, 101 bp, Homo sapiens
  DISO7_10019273
  Located on chromosome X
  Distance between a terminus base of telomere on chromosomal short arm and 5'-terminus of this base sequence : 41644621
  Distance between 3'-terminus of neighbour sequence of sequence listing upward to telomere on chrosomal short arm and 5'-terminus of this base sequence : 62524
tctcttacgtgcccacagacacacacacacacacacacacacacacacacacacacacacacacacacacacacctgaccaggtcctaggtaacctaaata

SEQ ID NO: 25955 - DNA, 127 bp, Homo sapiens
  DISO7_10000382
  Located on chromosome X
  Distance between a terminus base of telomere on chromosomal short arm and 5'-terminus of this base sequence : 41798528
  Distance between 3'-terminus of neighbour sequence of sequence listing upward to telomere on chrosomal short arm and 5'-terminus of this base sequence : 153806
cgatctcagttatgcactttaagggccccaaatataagcagcctattggttagggttcttctgtgtgtgtgtgtgtgtgtgtgtgtgtgtgtgtgtgtgtcgtggggtgggctgtgcacccaagtat

SEQ ID NO: 25956 - DNA, 243 bp, Homo sapiens
  HUMUT6128
  Located on chromosome X
  Distance between a terminus base of telomere on chromosomal short arm and 5'-terminus of this base sequence : 41957259
  Distance between 3'-terminus of neighbour sequence of sequence listing upward to telomere on chrosomal short arm and 5'-terminus of this base sequence : 158604
aaggtgacatgagactgtgtgttcacaatgtttctcaatgcatgagattgtttgggcaaacaaaaacaaaagctctctttagtctctctttccttctttccttctttctttctttctttctttctttctttctttctttctttctttctttctttcatggagtttcactcttgttgcccaggctggaaagcaatggcgtgatattgtctcactgcaacctgcacctctgggttcaagcgattc

SEQ ID NO: 25957 - DNA, 101 bp, Homo sapiens
  DISD22_0007273
  Located on chromosome X
  Distance between a terminus base of telomere on chromosomal short arm and 5'-terminus of this base sequence : 42359818
  Distance between 3'-terminus of neighbour sequence of sequence listing upward to telomere on chrosomal short arm and 5'-terminus of this base sequence : 402316
tgctacacatgctcgagggcgcgcgcgcgcacacacacacacacacacacacacacacacacacactgcatcgtttcactttcttcctaattcttggtcct

SEQ ID NO: 25958 - DNA, 224 bp, Homo sapiens
  DXS8026
  Located on chromosome X
  Distance between a terminus base of telomere on chromosomal short arm and 5'-terminus of this base sequence : 42498039
  Distance between 3'-terminus of neighbour sequence of sequence listing upward to telomere on chrosomal short arm and 5'-terminus of this base sequence : 138120
acacacgacccttgctgtacccagggtgtgtgtgtgtgtgtgtgtgtgtgtgtgtgtgtgtatgtgtgtgatgcagatgatgcatatgtgtcatgtgagtcatgtgtgtgtatggggatggggaattattgagaagagaagaaagcaaggagtaggagaggcaagggcaggtggaaattcaccaggttgagagactagtccctaggctggcagttaaaaatctg

SEQ ID NO: 25959 - DNA, 179 bp, Homo sapiens
  DXS8083
  Located on chromosome X
  Distance between a terminus base of telomere on chromosomal short arm and 5'-terminus of this base sequence : 42554571
  Distance between 3'-terminus of neighbour sequence of sequence listing upward to telomere on chrosomal short arm and 5'-terminus of this base sequence : 56308
tccaggaggccgtatgtcttcttttgagaaatgtctatttatgttctttgcccactttttaatgggattgtgtgtgtgtgtgtgtgtgtgtgtgtgtgtgtgtgtgtgtgtctgtgtaaactgttgtttgagttccttgtatattctggatattggtcccttgtcagatgaatagttcg

SEQ ID NO: 25960 - DNA, 263 bp, Homo sapiens
  AL020989.2_33780
  Located on chromosome X
  Distance between a terminus base of telomere on chromosomal short arm and 5'-terminus of this base sequence : 42635854
  Distance between 3'-terminus of neighbour sequence of sequence listing upward to telomere on chrosomal short arm and 5'-terminus of this base sequence : 81104
tgagctttcagagttctttacatattctggatacaaattctttatcgtgtgtgtgtgtgtgtgtgtgtgtgtgtgtgtgtacatatatagcatacatatgatacatttgatataatatgtatttctcccagtatgcatcttgtcttttcattctctttagcaatgtctttataagagcagaaatttaaaccttgatgacatttgatttttttttcttttatggatcatttttaagtgatgtagacatctttgcttaatccaag

SEQ ID NO: 25961 - DNA, 312 bp, Homo sapiens
  chrX.fa.O7frz.40054552
  Located on chromosome X
  Distance between a terminus base of telomere on chromosomal short arm and 5'-terminus of this base sequence : 42806539
  Distance between 3'-terminus of neighbour sequence of sequence listing upward to telomere on chrosomal short arm and 5'-terminus of this base sequence : 170422
ttgtttctaggcatcttattctattagtctatcattatatcaatactatatacactgccataagtattatagctaattattgctatctagtaaggatattttctctttaggagtgtcttggctatttttacactttgttccttcatatttgttttaaatctttttgtcaagttacacacacacacacacacacacacacacacacacacacacacatgcctgctgggtttgtgttgcaattccattgaatctgttgatcaactggagggcaatattaagtcttcctacccacgactacagtttccacttaga

SEQ ID NO: 25962 - DNA, 433 bp, Homo sapiens
  chrX.fa.O7frz.40165972
  Located on chromosome X
  Distance between a terminus base of telomere on chromosomal short arm and 5'-terminus of this base sequence : 42919198
  Distance between 3'-terminus of neighbour sequence of sequence listing upward to telomere on chrosomal short arm and 5'-terminus of this base sequence : 112347
ctatccaaatgatacctttcataggggggaaagagaaaaaaagaggtaaaacaaaaacaggtaagaggtaaaacatggataaatatccagattcctcccccttgtagtattgaaagcaaatagacctcatcattcataaaaccttgaaggttcccaagccccagctgataatgttggacttaacaccctagaacttgactctctcctctctctctgtctctctctctctctctctctctttgtgtgtgtgtgtgagtgtgtgtgtgtgtgtgtgtgtgtgtgtgtgtgtgtaattcaaggtaaagttttcattattaaagactgcccaataatctctctcaggacactgaagcagaagctagaagatgccatcagagacccagtagccagatgtagctgctgattacgaaagacaggatctacactggctact

SEQ ID NO: 25963 - DNA, 267 bp, Homo sapiens
  AL031584.1_69194
  Located on chromosome X
  Distance between a terminus base of telomere on chromosomal short arm and 5'-terminus of this base sequence : 43049105
  Distance between 3'-terminus of neighbour sequence of sequence listing upward to telomere on chrosomal short arm and 5'-terminus of this base sequence : 129474
ccttgatggttattgcttaaatacattaaaatcaagttaaggggctgacttaatgtttaggtgtgataatgtaaaacacaaggaagtactcccagcagacacattcactgtcgtgtgtttttatttaactaattttcttctatatgtttgagtagtgcaatggagtgatgcatatggacatttttgcagctgttgctggtgtgtgtgtgtgtgtgtgtgtgtgtgtgtgtgtgtgtttaatgctcataactaatcagacaagacctg

SEQ ID NO: 25964 - DNA, 286 bp, Homo sapiens
  AL031585.1_75467
  Located on chromosome X
  Distance between a terminus base of telomere on chromosomal short arm and 5'-terminus of this base sequence : 43128083
  Distance between 3'-terminus of neighbour sequence of sequence listing upward to telomere on chrosomal short arm and 5'-terminus of this base sequence : 78711
aaatgcaattgaaatttgagttacttttaacataaactatctatgaatttctcacaaagtgtttacataatgacataattatgaacagatcaaaagcgagatgtgggtttgatttcaaaatcttgtatagtttgtcagaatatggaaatgtgtgtgtgtttgtgtgtgtgtgtgtgtgtgtgtgtgtgtatgttttaaaagatggcttgccttattcagtatttcaccatactttctatttccaattaacagtaaaggaagagttggcttaaaattgatcagatta

SEQ ID NO: 25965 - DNA, 329 bp, Homo sapiens
  chrX.fa.O7frz.40609737
  Located on chromosome X
  Distance between a terminus base of telomere on chromosomal short arm and 5'-terminus of this base sequence : 43362946
  Distance between 3'-terminus of neighbour sequence of sequence listing upward to telomere on chrosomal short arm and 5'-terminus of this base sequence : 234577
acaaacagcgactattactgagtgatttttaatttccttctccttcttcttcttcttcttctgcttctcttctcctcctcctcctacaccccctcctcatcccccttcttctccttctccttcttctccttctcctctttcttctgcttctgcttcttctgcttctgcttctcttctcctcctcctcctacacccccttctcatcccccttcttctccttcttctccttcttctctttcttctccttctcctcctttttcttcttctttcttcttcttcttttttcttcttcttcttctttcttcttcttcctgatagagtcttgctct

SEQ ID NO: 25966 - DNA, 283 bp, Homo sapiens
  AL034402.9_20313
  Located on chromosome X
  Distance between a terminus base of telomere on chromosomal short arm and 5'-terminus of this base sequence : 43492879
  Distance between 3'-terminus of neighbour sequence of sequence listing upward to telomere on chrosomal short arm and 5'-terminus of this base sequence : 129604
gagcatgataagtgaagcaaagaagaagacgtgtgtgtgtgtgtgtgtgtgtgtgtgtgtgtgtgtgtgtgtgtgtgtgtgtagacctgtacacaaaacctccattatttttatgctttcatttctacacagccagataatgtcaggtaaaagtataacttatgactcagtcagagcaatgcttttgctttgatatatcgatgttggctgagtcaagtaagggtggagatggcaagagaaagataataagtagcaaatatatgtgttcagcggaaagacaaag

SEQ ID NO: 25967 - DNA, 87 bp, Homo sapiens
  DXS1055
  Located on chromosome X
  Distance between a terminus base of telomere on chromosomal short arm and 5'-terminus of this base sequence : 43739507
  Distance between 3'-terminus of neighbour sequence of sequence listing upward to telomere on chrosomal short arm and 5'-terminus of this base sequence : 246345
atgggatacactgttctgggattatacacacacacacacacacacacacacacacacacacaccacacccagttgtgcattgtttaa

SEQ ID NO: 25968 - DNA, 374 bp, Homo sapiens
  AL022165.1_154705
  Located on chromosome X
  Distance between a terminus base of telomere on chromosomal short arm and 5'-terminus of this base sequence : 43845642
  Distance between 3'-terminus of neighbour sequence of sequence listing upward to telomere on chrosomal short arm and 5'-terminus of this base sequence : 106048
gctttctgcttaatttgatatcagaaaacagagtcctaaatatctgctcatggaacctgaagcgtctccttatattcatctagattaatgtctgaagcctgggaaagagggacaatagagatggatgtggagaaatgagaaacagatagttccatttaagatggccaagtttatacaagaagaaacacatatcaatatcacagctagaaattattcagaaagtggcaaaactgcaatcctttcaatgcttctgcacattcattggttaccttaaaaatataaacacacacacacacacacacacacacacggatttacttgttttaccatgttgtcttggaaggatttacttcttacaagtcattaggcctgtg

SEQ ID NO: 25969 - DNA, 185 bp, Homo sapiens
  DXS1003
  Located on chromosome X
  Distance between a terminus base of telomere on chromosomal short arm and 5'-terminus of this base sequence : 43847544
  Distance between 3'-terminus of neighbour sequence of sequence listing upward to telomere on chrosomal short arm and 5'-terminus of this base sequence : 1528
ccattcctcactggcaagttttaacatgttattgtatatgtgtgtgtgagtgagggagagagagagagaaagagagagagagtgaatgtgtgtgtgtgtgtgtgtgtgtgtgtgtgtgtgtgtgtgtgtgtgtgtgtgtgtgtgtttggtgggggagtccaccaataacggcttctatgggtgaa

SEQ ID NO: 25970 - DNA, 310 bp, Homo sapiens
  AL050307.13_63317
  Located on chromosome X
  Distance between a terminus base of telomere on chromosomal short arm and 5'-terminus of this base sequence : 43980969
  Distance between 3'-terminus of neighbour sequence of sequence listing upward to telomere on chrosomal short arm and 5'-terminus of this base sequence : 133240
aaactcctgacttcaagtgatccacccacctctgcctcccaaagtgctgggattacagacgtgagccaccacctccagcctgttttgttgttgttgttgttgttgttgttgttgttgttgttgtttttcaaaatgaaccttaacttttccacactatattcattgttcccatctcctctcctttcagtctctcttgaacaccctccagtcaggctttcgttcctgtatctccacaaaaactgctcttgtcctaagtccctaacaacctccacgtaaccaaatcctgtggtcatttcagtctacgtgaaag

SEQ ID NO: 25971 - DNA, 236 bp, Homo sapiens
  Z67451
  Located on chromosome X
  Distance between a terminus base of telomere on chromosomal short arm and 5'-terminus of this base sequence : 43986557
  Distance between 3'-terminus of neighbour sequence of sequence listing upward to telomere on chrosomal short arm and 5'-terminus of this base sequence : 5278
ggattgcaggggtgagccactgtgcttggccctcatattggtttatatcactaggtctgtgagagcaagaggttatctataagttcactattatacccccagtgcccagaacagtacttggcacatagtaggtgatcaactattttgttaataaattcaagaggtaaactttggtgattccttactaaacacacacacacacacacacacacacacaaaccaccaaaaaacatctg

SEQ ID NO: 25972 - DNA, 186 bp, Homo sapiens
  DISD22_0007281
  Located on chromosome X
  Distance between a terminus base of telomere on chromosomal short arm and 5'-terminus of this base sequence : 44068976
  Distance between 3'-terminus of neighbour sequence of sequence listing upward to telomere on chrosomal short arm and 5'-terminus of this base sequence : 82183
atatacgtatattcccaccacgcattcttctggcaggctgggcaccgtgggtgtatgtgtgtgtgtgtgtatatatatatgtatgtgtgtgtgtatgtatatatatatgtgtgtgtgtatatatatatgtgtgtgtgtgtatatatatatatatatatataatttcctactggttctgatcctttg

SEQ ID NO: 25973 - DNA, 210 bp, Homo sapiens
  DISD22_0007283
  Located on chromosome X
  Distance between a terminus base of telomere on chromosomal short arm and 5'-terminus of this base sequence : 44165149
  Distance between 3'-terminus of neighbour sequence of sequence listing upward to telomere on chrosomal short arm and 5'-terminus of this base sequence : 95987
aggcctcactatatgcttccctggatgagagaggatgagagaggatgagagagagagaggatgagagagagagagagagagagagagaggatgagagagagagagagagagaggatgagagagagtgagagagagagagagagagagacagacctcccattagagagagagagagagagagaaagaaacacctctcattgtacttggaat

SEQ ID NO: 25974 - DNA, 135 bp, Homo sapiens
  DISD22_0007290
  Located on chromosome X
  Distance between a terminus base of telomere on chromosomal short arm and 5'-terminus of this base sequence : 44333093
  Distance between 3'-terminus of neighbour sequence of sequence listing upward to telomere on chrosomal short arm and 5'-terminus of this base sequence : 167734
gtacttgccaaaggtcattgggtaaatcagtagtgaagataggtaaaaggtgaagttggttctctctctctctctctctctttctctctctctctgctagagaactgaaactacaggtataccctgttatagcca

SEQ ID NO: 25975 - DNA, 420 bp, Homo sapiens
  AL096791.12_130925
  Located on chromosome X
  Distance between a terminus base of telomere on chromosomal short arm and 5'-terminus of this base sequence : 44509148
  Distance between 3'-terminus of neighbour sequence of sequence listing upward to telomere on chrosomal short arm and 5'-terminus of this base sequence : 175920
tttatttgaggctgctcagtatttgggatagccttttatgtgtcagaaatgccacagcagaacaggtgtgtgtgtatgtgtgtgtgtgtgtgtgtgtgtgtgtgtgtgtgtgtgtgtttaggcaggaggaggtttatgtctgtgagcttttatgtccaagtcctgaagtccaagctgtcagaacaatgacagctaaaattcatttagcacttattatatgtcaagtattttccaaacttcaggatttctcacaaaggtagatttcaatatagttctaaatggttatccttgtagtacatataagtttcacctttaaaagagagctagttgaactgtatactgaaaaatgcttgatggtaagttttatgttacatgtttttatcacagtttttaagagaaccataagctcaggaatttact

SEQ ID NO: 25976 - DNA, 381 bp, Homo sapiens
  Z84466.1_103745
  Located on chromosome X
  Distance between a terminus base of telomere on chromosomal short arm and 5'-terminus of this base sequence : 44930672
  Distance between 3'-terminus of neighbour sequence of sequence listing upward to telomere on chrosomal short arm and 5'-terminus of this base sequence : 421104
gagcttcctatgcactaaagacaggccaggtgcagtggctcacgcctgtaatcccagcactttgggaggccaaggtgggcagattgcttgaggtcacaagtttgagaacagcctggccaccatggtgaaatcctgtctctactaaaaatacaaaaattagccgggtgtggtggcatgcacctgcagtctcagctactcaggaggctgaggcaggataatggcttgaaccgaggaggtggaggttgcagtgagctgagatcatgccactgcactccagcctgggcgacagagcgagattctgtctcaacaaaacaaaacaaaacaaaacaaaacaaaacaaaacaaaaccaacgaaaagacaataacagttaattggagttg

SEQ ID NO: 25977 - DNA, 389 bp, Homo sapiens
  AL009172.1_5132
  Located on chromosome X
  Distance between a terminus base of telomere on chromosomal short arm and 5'-terminus of this base sequence : 45039585
  Distance between 3'-terminus of neighbour sequence of sequence listing upward to telomere on chrosomal short arm and 5'-terminus of this base sequence : 108532
tcaatcaggtttatcatggaagggggatgagggggagagacactttcagggctactggtcactgacacacatacaatcagggtcttggacagacacacacacacacacacacacacacacacacacacggcacaaatggaccctggtgacttgactgacatatgcaagagaccccaagtacagctacttctttttccttgctctctctctgacacacacacacacacacacacacacacacacaccatcgctgacactatcccctcagaagtgttgagagagaatctctctcagccctgcacatttttcatctataaactgatgagtggggatgatgagggtgtatcactgtttctaaaacttttctgaccataagtgtagttggatac

SEQ ID NO: 25978 - DNA, 420 bp, Homo sapiens
  chrX.fa.O7frz.42103893
  Located on chromosome X
  Distance between a terminus base of telomere on chromosomal short arm and 5'-terminus of this base sequence : 45140455
  Distance between 3'-terminus of neighbour sequence of sequence listing upward to telomere on chrosomal short arm and 5'-terminus of this base sequence : 100481
ctttaaatctcctggaaatcacatcagtgggggtgggtggatgggaggtgaggttgtttgtttgtttgtttgtttgtttgtttgagacagagtcttgctctatcacccaggctggagtgcagtggcatgatcttggctcactgcaacctccaggaggtgaggctttcaacagtagtgggaggtgtaacaacaatggctgctaattcattttctgcaattctgtgatcagaagcagtgatcagtgatccaagcacagatccctgatactggaagatagagttctttttgcctactctgctcctgcaagttgtgtgcaagctgctccaggaacatgcgcacggctgtttgccatagggctgaaaagtcagggatggggaactgctactgtgctaagagcttaaattgactgaaattaactgc

SEQ ID NO: 25979 - DNA, 299 bp, Homo sapiens
  DISO7_00006185
  Located on chromosome X
  Distance between a terminus base of telomere on chromosomal short arm and 5'-terminus of this base sequence : 45260315
  Distance between 3'-terminus of neighbour sequence of sequence listing upward to telomere on chrosomal short arm and 5'-terminus of this base sequence : 119440
agggttctgattgagcaaggggcacaaaaacaggaacgaccctgccaccaactacgagtttcacttaaagtcaaaaactgctatccaggccaggcatggtagctcacaactataatcctagcactttgggaggctgaggcaggaggatcgcttgaggacaggagtttggtatcagcctgggcaacatagcgagaccccgtctctctctagtgtgtgtgtgtgtgtgtgtgtgtgtgtgtgtgtgtgtgtgtgtgtgtgtgtgtgtgtgtgtatacacacatacagctacctaagccaaa

SEQ ID NO: 25980 - DNA, 270 bp, Homo sapiens
  U13795.1_258
  Located on chromosome X
  Distance between a terminus base of telomere on chromosomal short arm and 5'-terminus of this base sequence : 45410589
  Distance between 3'-terminus of neighbour sequence of sequence listing upward to telomere on chrosomal short arm and 5'-terminus of this base sequence : 149975
ggtgatgctggaggttattttgagccataggagagggaagctgaagggtttttaaagtgtgtgtggggtgtgtgtgtgtgtgtgtgtgtgtgtgtgtgtgtgtgtgttatggtataagtttcatcactttgcttcttttatagcaaggaatgagatgagatcatttgctaaaagagagggaaaaacaacttggagtggaggtttgaaggaagcaagaaaggtgttataagacatggaatcaaacctaagtgtccatcaaggaatatcaac

SEQ ID NO: 25981 - DNA, 385 bp, Homo sapiens
  chrX.fa.O7frz.42579676
  Located on chromosome X
  Distance between a terminus base of telomere on chromosomal short arm and 5'-terminus of this base sequence : 45617065
  Distance between 3'-terminus of neighbour sequence of sequence listing upward to telomere on chrosomal short arm and 5'-terminus of this base sequence : 206206
taactggcagtgactgatagaggggaatcggatgaggggagtacatgctgaacaggaaacagagtgaggggggcttgaccaggacacatggggaaaagcagttgggagatgcctatactggtacttggtgtgtgtgtgtgtgtgtgtgtgtgtgtgtgtgtgtgtgcgcgcgcgcgcgcatgtgtgtctgtgtggcatgtgtgtgtgtttgtgtaaatgcagaggaaaaaatctgaaattaaacactcagaactgccctcagtggtcacatctgggaagagaggagggtagtgttgttctatgcagagaatacctgacgatacttgttttctgaggtaggtgcatggatacacaaactgaaatatgcattaagtatgtcttgctc

SEQ ID NO: 25982 - DNA, 138 bp, Homo sapiens
  DISD22_0007305
  Located on chromosome X
  Distance between a terminus base of telomere on chromosomal short arm and 5'-terminus of this base sequence : 45730829
  Distance between 3'-terminus of neighbour sequence of sequence listing upward to telomere on chrosomal short arm and 5'-terminus of this base sequence : 113379
cagtgaattgctcagctctgttatatatatatatatatatatatatatatatatatatatatcctttctttccatcattttcccctatgaaatcatccataaagtatccttttataactatctgttgcctgtgaagtg

SEQ ID NO: 25983 - DNA, 174 bp, Homo sapiens
  DISD22_0007308
  Located on chromosome X
  Distance between a terminus base of telomere on chromosomal short arm and 5'-terminus of this base sequence : 45805528
  Distance between 3'-terminus of neighbour sequence of sequence listing upward to telomere on chrosomal short arm and 5'-terminus of this base sequence : 74561
aagtaatcaatgagaattcctcagatttaaaaaaatgacttaagatttaaaggtattatagtacacacacacacacacacacacacacaggaaaagtgaaatgtaaaattgtgaaagacaaagaaaaaatattttaaaaatgaacagagagaaatagcaggttacttacagagg

SEQ ID NO: 25984 - DNA, 212 bp, Homo sapiens
  HUMUT592
  Located on chromosome X
  Distance between a terminus base of telomere on chromosomal short arm and 5'-terminus of this base sequence : 45885423
  Distance between 3'-terminus of neighbour sequence of sequence listing upward to telomere on chrosomal short arm and 5'-terminus of this base sequence : 79721
ttacactccatcctgggcaaccagagtgaacctctgactcaaataaataaataaataaataaataaataaataaataattattttcctcttacggcagttacaacatcagaaggtagcttcatgggttcatttctcaagataatacccattttttttctgtattttcagcaaggttttcttcttctaaaacctcaagggctgcaattgtcac

SEQ ID NO: 25985 - DNA, 376 bp, Homo sapiens
  AF196969.1_110025
  Located on chromosome X
  Distance between a terminus base of telomere on chromosomal short arm and 5'-terminus of this base sequence : 46069453
  Distance between 3'-terminus of neighbour sequence of sequence listing upward to telomere on chrosomal short arm and 5'-terminus of this base sequence : 183818
ctttaatcttcaatcagcgaggatcgtcaagttggctgctggatctttctggatctttttttcattacctcgcctttcatgttgtttgtccacatagcttgaggctttatcacagattgctcttgggggcagtgttactccagaaatgccggaatgctccgctattcctcactccacccctaaatatacagcatctcctcccgcccttaagctctgaaaaaaatgctgcggagccagaaaggctgcagaaagccgggtgtgaccactggctctgtagccaacctgttccctgctgctgctgctgctgctgctgctgctgcagtcgtttggtttcctctttgaatctgagatgattctgaggtctacactgcaaact

SEQ ID NO: 25986 - DNA, 362 bp, Homo sapiens
  AF196970.1_66680
  Located on chromosome X
  Distance between a terminus base of telomere on chromosomal short arm and 5'-terminus of this base sequence : 46134080
  Distance between 3'-terminus of neighbour sequence of sequence listing upward to telomere on chrosomal short arm and 5'-terminus of this base sequence : 64251
tgtttgctagtgaatgtcacagtatgtgagtgtctcttttgtgtgtatttgtcaaggatgtgaggtctaattcaacatgtcccggattgtaagatacctaacctggtagtgggtttatgtctgagaatgtttctttctgcagtgtgtgtgtgtgtgtgtgtgtgtgtgtgtgtgtgtgtgtgtgtatgtcccaggtttggagatttgatctgttgggggtgcattttgcagcatgtggggcccctgatatcttcgtgggtatatatcctatcatgtcaggtccatgttttctttgagtgtgtatgtcccagatggtgagttctcttatgtgtttgtgagtttaattccaagtgattgaagac

SEQ ID NO: 25987 - DNA, 136 bp, Homo sapiens
  DISD22_0007317
  Located on chromosome X
  Distance between a terminus base of telomere on chromosomal short arm and 5'-terminus of this base sequence : 46429298
  Distance between 3'-terminus of neighbour sequence of sequence listing upward to telomere on chrosomal short arm and 5'-terminus of this base sequence : 294856
aggaaactcagctgtcagataggtgtgtgtgtgtgtgtgtgtgtgtgtgtgtgtgtgtgtgtgtgagagagagaaagagagagagagagagagagagacagagagagaatgtgcatctatatgaatgtatgaatgc

SEQ ID NO: 25988 - DNA, 149 bp, Homo sapiens
  DISD22_0007322
  Located on chromosome X
  Distance between a terminus base of telomere on chromosomal short arm and 5'-terminus of this base sequence : 46501069
  Distance between 3'-terminus of neighbour sequence of sequence listing upward to telomere on chrosomal short arm and 5'-terminus of this base sequence : 71635
cgaagaccattccctctcaaacacaaacgaaatcacacacacacacacacacacacacacacacagagagagagagagacagagagagagagagagagacacgcccataggccaagccaacacacataataaggattcacaaatatcca

SEQ ID NO: 25989 - DNA, 440 bp, Homo sapiens
  AF207550.1_41823
  Located on chromosome X
  Distance between a terminus base of telomere on chromosomal short arm and 5'-terminus of this base sequence : 46597020
  Distance between 3'-terminus of neighbour sequence of sequence listing upward to telomere on chrosomal short arm and 5'-terminus of this base sequence : 95802
ccataatgatttgaactgttaataacagcagaactgggctgggcgcgttggctcacgcctgtaatcccagcattttgggaggccgagatgggtggatcacctgaggtcaggagttcgagaccagcctttgacatggtgaaaccccgtctctactaaaaacacaaaaattagctgggcgtggtggcgggtgcctgtaatcccagctactcgggaggctgaggcaagagaattgcttgaacccgggaggcagaggttgcagtgagccaagattgcgccattgcactccagcctgggtgatgagagagaaacttcgtctcaaaaaaaagatgataataataataataataataataataataataataatagcagaactgtgtttgggaagagaaggatatgtgggaattctgtattatctcctcaattgttctgtaaatcta

SEQ ID NO: 25990 - DNA, 206 bp, Homo sapiens
  AF196779.1_78064
  Located on chromosome X
  Distance between a terminus base of telomere on chromosomal short arm and 5'-terminus of this base sequence : 46753637
  Distance between 3'-terminus of neighbour sequence of sequence listing upward to telomere on chrosomal short arm and 5'-terminus of this base sequence : 156177
agctgagatcgtaccattacactctagcctaggtgacagagcactactctgcctcaaaaaaagaaaaagaaaaagaaatgtaattgccattgtaacagtattaagaggtgagatctttaagaggtcatcaagcaagcaagagagagagagagagagagagagagtctttttctaccacgtgagaacatagtgaggtaatctgcaag

SEQ ID NO: 25991 - DNA, 249 bp, Homo sapiens
  DXS1208
  Located on chromosome X
  Distance between a terminus base of telomere on chromosomal short arm and 5'-terminus of this base sequence : 46880309
  Distance between 3'-terminus of neighbour sequence of sequence listing upward to telomere on chrosomal short arm and 5'-terminus of this base sequence : 126466
cggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaac

SEQ ID NO: 25992 - DNA, 393 bp, Homo sapiens
  chrX.fa.O7frz.44058536
  Located on chromosome X
  Distance between a terminus base of telomere on chromosomal short arm and 5'-terminus of this base sequence : 47074586
  Distance between 3'-terminus of neighbour sequence of sequence listing upward to telomere on chrosomal short arm and 5'-terminus of this base sequence : 194028
tatcgttacagctgatggttagagtttaggtcaggagagattaaactcttctgagtattatgagagatcattggcccattctattttgcaaaaacttagtgagtggatcaatgtgagcaaggaagtttttgttttaatgggagtactttacacagtttcttaagtatttccacctgtaaagtgaaattttctatcactagagagtaatatatgtactctatcactagagagtaatgcaggtgggaaaaaacaatatctatcaatctattatctatctatctatctctatctatctatctatctatctatctatctatctatctatctatctatcttttcaccttttagcaagggaaaactttaatccaagtataaacctaacgcaccattata

SEQ ID NO: 25993 - DNA, 430 bp, Homo sapiens
  chrX.fa.O7frz.43962076
  Located on chromosome X
  Distance between a terminus base of telomere on chromosomal short arm and 5'-terminus of this base sequence : 47171023
  Distance between 3'-terminus of neighbour sequence of sequence listing upward to telomere on chrosomal short arm and 5'-terminus of this base sequence : 96044
gaattaaaggcatgatgtcttattaaagtaatgggtccgggcacggtagctcacgcctgtaatcctagcactttgagaggcggaggtgggcggattgcctgagctcaggagttcgagaccaggctgggcaacacggtgaaaccctgtctctactaaaatacaaaaaattagccaggcatggtggcatgcgcctgtagttccagctactcaggaggctgaggcagcagaattgcttgaacctgggaggcagaggttgcagcgagctgaggatcatgccactgcactccagcctgggagacagagcaagactccgtctccaaaaaataataaataaataaataaataaacaaataaataaaattaattaattaattaaataatggataaaaacataacagcagtaatatctatcacctactatgagtcaggc

SEQ ID NO: 25994 - DNA, 196 bp, Homo sapiens
  AF222686.1_3311
  Located on chromosome X
  Distance between a terminus base of telomere on chromosomal short arm and 5'-terminus of this base sequence : 47267654
  Distance between 3'-terminus of neighbour sequence of sequence listing upward to telomere on chrosomal short arm and 5'-terminus of this base sequence : 96201
atctaactagaatctggcggactccctgagtcaaggagacacaagtgaccaagtactggagacttcacgtacagcatagtgacaatagttagtaatgtttacttgaaatttactaagagagtggatcttaagtgttctaaacacacacacacacacacacacacacggtgaggtgatgaatatgttaaccggcttt

SEQ ID NO: 25995 - DNA, 429 bp, Homo sapiens
  chrX.fa.O7frz.43763256
  Located on chromosome X
  Distance between a terminus base of telomere on chromosomal short arm and 5'-terminus of this base sequence : 47370066
  Distance between 3'-terminus of neighbour sequence of sequence listing upward to telomere on chrosomal short arm and 5'-terminus of this base sequence : 102216
gctgacaagtgcaagttctcttgcgtctgtctgtctgtctgtctctctgtctctgtctctgtctctgtctctctctctctctctctgtgtgtgtgtgtgtgtgtgtgtgtgtgtggtgtgtgtgtggacacaaagtggttggtggctgagagcttgagcctccttttttgagtcctctttctaatgacctgcatgccagattctaagctttcttaccatctgttctcgtatgtgtgttatttcatctgtaaaatagggataatgatcacctcatggatattttatgagaaataaatgagctatgtgtgaaaagcacttaaaacagtgctctgcaaatgtaaatactatactggtgttaggaataaaaataaaggaaaagaaagaaggaaggaaaacaaatatgttgtagatagtgaacatttctgaagg

SEQ ID NO: 25996 - DNA, 101 bp, Homo sapiens
  DISD22_0007336
  Located on chromosome X
  Distance between a terminus base of telomere on chromosomal short arm and 5'-terminus of this base sequence : 47721636
  Distance between 3'-terminus of neighbour sequence of sequence listing upward to telomere on chrosomal short arm and 5'-terminus of this base sequence : 351141
tctggttaatgatgcaaagagacattaaaaggtaaacacacacacacacacacacacacacacacacacacacttactgacaggcatttgtggcagtcatg

SEQ ID NO: 25997 - DNA, 186 bp, Homo sapiens
  DXS6725
  Located on chromosome X
  Distance between a terminus base of telomere on chromosomal short arm and 5'-terminus of this base sequence : 47800630
  Distance between 3'-terminus of neighbour sequence of sequence listing upward to telomere on chrosomal short arm and 5'-terminus of this base sequence : 78893
aacggatctctccagaagtcaattgaaaatatggatttggagtgtgtgtgtgtgtgtgtgtgtttgtgtgcatgcacatgcatgtgagtgtgtgtgtatgtgtttttctgtgtgtcacagtttcttaaatgaaaatggctgactgcctagtcctaagaatgactgttattgcttgggaatgaaaca

SEQ ID NO: 25998 - DNA, 374 bp, Homo sapiens
  AL121865.7_89406
  Located on chromosome X
  Distance between a terminus base of telomere on chromosomal short arm and 5'-terminus of this base sequence : 47908564
  Distance between 3'-terminus of neighbour sequence of sequence listing upward to telomere on chrosomal short arm and 5'-terminus of this base sequence : 107748
aagttcagaaacaaagcagactacctataaaaacatcatatacataatcttcccccaaaaaggagataaagaaatattatttaataaatctttttgagataactgcaaagcagtgctttttggagctacatcatatattatataccaaaataaattccagatcaagagtcatggatatgtgtgtgtgtgtgtgtgtgtgtgtgtataattttaatatattatatatgttatatgtgtatatatatgtgtatatattatgcacatatataacataagaaaaacctatcagaaaattaaaaagactatcattgtgaggtgaaataagattctcataagcaatagaagaaaacctccaaataagtccaggtttattt

SEQ ID NO: 25999 - DNA, 132 bp, Homo sapiens
  DXS8023
  Located on chromosome X
  Distance between a terminus base of telomere on chromosomal short arm and 5'-terminus of this base sequence : 47909379
  Distance between 3'-terminus of neighbour sequence of sequence listing upward to telomere on chrosomal short arm and 5'-terminus of this base sequence : 441
cttttgtgcaaactgttccacctggcatattctctctctctctctctctcacacacacacacacacacacacacacacacagtgatggacaagtggaaagtaaaaaaatgacaaacgtgtaccaggcagaga

SEQ ID NO: 26000 - DNA, 377 bp, Homo sapiens
  AL121865.7_52521
  Located on chromosome X
  Distance between a terminus base of telomere on chromosomal short arm and 5'-terminus of this base sequence : 47945445
  Distance between 3'-terminus of neighbour sequence of sequence listing upward to telomere on chrosomal short arm and 5'-terminus of this base sequence : 35934
tggcttgtttatttgacagaagaggggaaaagctgcctggtcaccatggagggacacagagctctgaaggcccacccccacccactgttggctggggtccttgcagcctggtaatcaggaaacccttccttattatagacccaaccaaggggggaagagtgtgtgtgtgtgtgtgtgtgtgtgtgtgtgtgtgtgtgtgtgtgtgtgtaatttgaaagagaactttcaggacaatggctttctcatcagtctgggaaagctataatctgggtcatctgagagatgaatactctctggagaaggggcttttggtacccagctctgcctccctgcctcccctcctctccccacctcctctgaatagccagttcaagttc

SEQ ID NO: 26001 - DNA, 230 bp, Homo sapiens
  Z66978
  Located on chromosome X
  Distance between a terminus base of telomere on chromosomal short arm and 5'-terminus of this base sequence : 48042158
  Distance between 3'-terminus of neighbour sequence of sequence listing upward to telomere on chrosomal short arm and 5'-terminus of this base sequence : 96336
ccttttgacataacccattcagtagtgtgtgtgtgtgtgtgtgtgtgtgtgtgcactttagtacttccttacttcctggcactacgagattctccagactcatgtagttcctgatccagtcctagaaccagccattttttcaaggatccctggttcctttcattgaaaaatggtattagaatccaagttctgggcactagttgtgttcactgctgcttcagtatggtttt

SEQ ID NO: 26002 - DNA, 365 bp, Homo sapiens
  HUMUT662
  Located on chromosome X
  Distance between a terminus base of telomere on chromosomal short arm and 5'-terminus of this base sequence : 48071014
  Distance between 3'-terminus of neighbour sequence of sequence listing upward to telomere on chrosomal short arm and 5'-terminus of this base sequence : 28626
tctgcaacgtattgttagttgtaaaaacataggctagaaaacattacatataatatgaccttgttttttatgtgtgtgtgtgtgtgtgtgtgtgtgtgtgtataaacatggaagaatgaagtgtgagatatgcatacacctaaatatcaatgcctgttacctctaggaggtaggaatgtggctaattttaattttcttctttaaacttctgtgtattttctaagttaatattaaatcaacaaacattattgcttttgatgatgtggaaaacaataaagctacggtcattttggaaaggagagaaaacatgtggtaacaacaataatagtagctaacatttactgagcagttactatgtaccttgg

SEQ ID NO: 26003 - DNA, 176 bp, Homo sapiens
  HUMUT584
  Located on chromosome X
  Distance between a terminus base of telomere on chromosomal short arm and 5'-terminus of this base sequence : 48093624
  Distance between 3'-terminus of neighbour sequence of sequence listing upward to telomere on chrosomal short arm and 5'-terminus of this base sequence : 22245
cacagaagacaaggaagctttgcactcaaaaaactgtccctccaactacccaaccaccctccatcattctctctctgacacacacaaacacacacacatacacacacacacacacacacactaaaattcacagtctctagattcacaatctctagattgtgtggtgaggtacctac

SEQ ID NO: 26004 - DNA, 465 bp, Homo sapiens
  AL359272.9_90844
  Located on chromosome X
  Distance between a terminus base of telomere on chromosomal short arm and 5'-terminus of this base sequence : 48119697
  Distance between 3'-terminus of neighbour sequence of sequence listing upward to telomere on chrosomal short arm and 5'-terminus of this base sequence : 25897
gagattgcactgaatctgtagatcactttgggtatggactaaaagaacatttgttaacaatcaacaaagtgaagaaacaacccacagaataaaagaaaatatttgtgaactacccatctgacaagggattaataaccagaatatataaggaactcaaacaactcaatagttaaacacacacacacacacacacacacacacacacacacacacacgaatactccaactaaaaaacaggctaaaggtctgaatagacttttctcaaaagacatacaaatggccaacaggtttatgaaaaaaatgctcaatatcactaattatcagagaaatgcaaatcaagatcacaattagatatcacatcaccctaccccagctaaaatcacttttatcaaaaagagataataatggatggggagaaaggagaaccttcatatactgttggttggaatacaatttaatacagcc

SEQ ID NO: 26005 - DNA, 181 bp, Homo sapiens
  DXS8024
  Located on chromosome X
  Distance between a terminus base of telomere on chromosomal short arm and 5'-terminus of this base sequence : 48124293
  Distance between 3'-terminus of neighbour sequence of sequence listing upward to telomere on chrosomal short arm and 5'-terminus of this base sequence : 4131
tgccagttttcttatggaatctcaggatcttggcttcgtattagatttgagactagattcaaagcctcttcatccttcttgagttaataaatctagacagcattcgtgtgtgtgtgtgtgtgtgtgtgtgtgtgtgtgtgtgtgtaaaaggctgctatctgtggtggttggtgctctcaga

SEQ ID NO: 26006 - DNA, 104 bp, Homo sapiens
  DISO7_10004631
  Located on chromosome X
  Distance between a terminus base of telomere on chromosomal short arm and 5'-terminus of this base sequence : 48252099
  Distance between 3'-terminus of neighbour sequence of sequence listing upward to telomere on chrosomal short arm and 5'-terminus of this base sequence : 127625
actgcctgggagaatgtggaaagcatgcctcagtgcgctcccgtgtgcgcgacacacacacacacacacacacacacacacacccaatctagcttcaagattgg

SEQ ID NO: 26007 - DNA, 318 bp, Homo sapiens
  chrX.fa.O7frz.46048510
  Located on chromosome X
  Distance between a terminus base of telomere on chromosomal short arm and 5'-terminus of this base sequence : 48569959
  Distance between 3'-terminus of neighbour sequence of sequence listing upward to telomere on chrosomal short arm and 5'-terminus of this base sequence : 317756
gctagtctcataccattaacagacaaaaatgtatccatgcaagatgtcagctctttcccatcttaattaccttaaaccaattaataaccttaatcaaactgattaattaccctaatctatttcttttcattttgtaacatttatgttccagaaatcagctcattttcaggttcatacacacacacacacacacacacacacacacacacacacacacaagcacacacatccaatcacaccagggcactgatgtgtttcagtggacattgtgattgactccccaacatccattctgtctcctgtttatctaagccagtc

SEQ ID NO: 26008 - DNA, 140 bp, Homo sapiens
  DISO7_10004636
  Located on chromosome X
  Distance between a terminus base of telomere on chromosomal short arm and 5'-terminus of this base sequence : 48651387
  Distance between 3'-terminus of neighbour sequence of sequence listing upward to telomere on chrosomal short arm and 5'-terminus of this base sequence : 81110
gcaatataatggaaatctcagctctctcgtaattcaagtcacacattcaggagaagatagcaaaataaataaataaataaataaataaataaataaataaataaaataaaatacaataaaaaggatgacaggtgtgctga

SEQ ID NO: 26009 - DNA, 118 bp, Homo sapiens
  DISD22_0007349
  Located on chromosome X
  Distance between a terminus base of telomere on chromosomal short arm and 5'-terminus of this base sequence : 48930131
  Distance between 3'-terminus of neighbour sequence of sequence listing upward to telomere on chrosomal short arm and 5'-terminus of this base sequence : 278604
gcagtcagacttgttctgtctcttttcctttcccttcccctatagcatgtgtgtgtgtgtgtgtgtgtgtgtgtgacattttcatgtatacagggtttgatttctggacctgctatcc

SEQ ID NO: 26010 - DNA, 131 bp, Homo sapiens
  DISD22_0007350
  Located on chromosome X
  Distance between a terminus base of telomere on chromosomal short arm and 5'-terminus of this base sequence : 49111967
  Distance between 3'-terminus of neighbour sequence of sequence listing upward to telomere on chrosomal short arm and 5'-terminus of this base sequence : 181718
agctccatgaccttctgcatatgtatatatacatatatatacacatacatatatatatatatatatatatatatacacacacacatatatatatatatgcctcttagctacccaaatccttcagagaatcc

SEQ ID NO: 26011 - DNA, 369 bp, Homo sapiens
  DISO7_00006202
  Located on chromosome X
  Distance between a terminus base of telomere on chromosomal short arm and 5'-terminus of this base sequence : 49439793
  Distance between 3'-terminus of neighbour sequence of sequence listing upward to telomere on chrosomal short arm and 5'-terminus of this base sequence : 327695
ctgccgtaggatctggtttaacacagtgcggtgagtctctgaggggagaagtgacagcaggaattaagcacatcatctgccccagaagctgtaagacagccaaccagctagcaactctctcttccttcctcttccttatttcagggctctaaaaggactagtcaaaaccaagggccagcccttgaggtgtgaacgtgaatctgagcatttctattctaaacctgagtatcctgaggccaagggaaaccatgcagggtttacgtgcacgggtgtgtgtatgtacacacacacacacacacacacacacactctctctctctctctctctctctctctcatcaactaaggattaactgtatgaaacaatcc

SEQ ID NO: 26012 - DNA, 207 bp, Homo sapiens
  HUMUT5630
  Located on chromosome X
  Distance between a terminus base of telomere on chromosomal short arm and 5'-terminus of this base sequence : 49467375
  Distance between 3'-terminus of neighbour sequence of sequence listing upward to telomere on chrosomal short arm and 5'-terminus of this base sequence : 27213
agtgtaataaggtgtgtgagaccaaccaggtgcccactaacaccagagcagctctgcttttatctgctttatgtgtgtatttatgtgtgagtctatgtatgtatgtatgtatgtatgtatgtgtgtgtgtgtgtgtatatatatatatatatatatatatatatatgctcactagtagtaccaagatggcagtctctgatatcacat

SEQ ID NO: 26013 - DNA, 287 bp, Homo sapiens
  DXS1199
  Located on chromosome X
  Distance between a terminus base of telomere on chromosomal short arm and 5'-terminus of this base sequence : 49596869
  Distance between 3'-terminus of neighbour sequence of sequence listing upward to telomere on chrosomal short arm and 5'-terminus of this base sequence : 129287
ggtgactgactctgtggcctgtggtagtggctttcaaaggtttttgagataaatttacagaataagaaacataccatatttgacatcacaactcagtacatatacctgtgcatgcaaacacacacacacacacacacacacacacacacacacacacatctgaagccagtgtttcacaaaacaatatttacctttattatgtaatgcactctgtttaaagaaaaaaaaaactatttcttttttttttcatatttctattcattatgttaaatgttgatttcactcca

SEQ ID NO: 26014 - DNA, 241 bp, Homo sapiens
  DXS1204
  Located on chromosome X
  Distance between a terminus base of telomere on chromosomal short arm and 5'-terminus of this base sequence : 49842219
  Distance between 3'-terminus of neighbour sequence of sequence listing upward to telomere on chrosomal short arm and 5'-terminus of this base sequence : 245063
atgaacccttaactcatttagcaggttgttagtaaagagtacttcatttaggccaggcatggtggctcacacctgtaatcccagcactttgggaagccaaggcaggcaggatcgcttaagcccagttcaagaccagccagggcaacatagcgagaccccatctccacacacacacacacacacacacacacacacacacacacacacaccaaaatattagtcaggcatgttggtgcatgct

SEQ ID NO: 26015 - DNA, 274 bp, Homo sapiens
  DXS1044
  Located on chromosome X
  Distance between a terminus base of telomere on chromosomal short arm and 5'-terminus of this base sequence : 50241092
  Distance between 3'-terminus of neighbour sequence of sequence listing upward to telomere on chrosomal short arm and 5'-terminus of this base sequence : 398632
acatacaaccaggcacagaggagcacgtaacacatacagacccagagacacacatggatctatatgcaaacatacagatggccatacagaaacaagaacattaagacacacacacaaaatagatccacggggacaaagaaggccaggcacatgcgcgcgcacacgcgcgcacacacacacacacacacacacacacacacagacaaaccaagcagccacatgagagcacaagcagcccatccctcttccagttccttgattactgtgagggcct

SEQ ID NO: 26016 - DNA, 467 bp, Homo sapiens
  chrX.fa.O7frz.49146081
  Located on chromosome X
  Distance between a terminus base of telomere on chromosomal short arm and 5'-terminus of this base sequence : 50309113
  Distance between 3'-terminus of neighbour sequence of sequence listing upward to telomere on chrosomal short arm and 5'-terminus of this base sequence : 67747
gaaagaggtgcttagatacagagacacagagagaaacaaagataagatagagaaagagactgagtgggagagatacaagaaaaggaaaaagtggtgatactgagaatgggaatgaccgagagagagagagagagagagagagagagatgtgtagagacttccatgcatggtgataatttagaatgagaatgacctagagagagggaggggggagagaggtgtgcagaggcttcatgcacgagaggtatacttagacatataccttttttttctttaggcaatcagctttctcgggttgaaacaagcatatgcttgagacaatagtacacacatgtaaattgagcacatacagaaagagaacggtgagaatgaggcccagtgaggggaaacacaaagacatccacaggctgagaatggctgacagatgcacaaacagcaaaatacacacctcaggtagacagctgcac

SEQ ID NO: 26017 - DNA, 442 bp, Homo sapiens
  chrX.fa.O7frz.49257034
  Located on chromosome X
  Distance between a terminus base of telomere on chromosomal short arm and 5'-terminus of this base sequence : 50444351
  Distance between 3'-terminus of neighbour sequence of sequence listing upward to telomere on chrosomal short arm and 5'-terminus of this base sequence : 134771
cttgtacctatggaactagttgagaagaaatgacatcttcacaatattgagtcttcctacccaagagcatggaatatctcttcatttattcagtttttctttgatttctttcatcagggtttagacgtttttcctttcctttcctttccttttctcctttctttctttctttttctttctttccttcttccttccttccttccttccttccttccttcctttctttccttcttccttccttccttccttccttccttccttccttcctttctttctttctttctttctttctttctttctttctttctttctttctttttctttctttctttctttctttttgagatggggtcttactctgtcacctaggctggcgtgcagtggcgtgatccgagctcactgcaacctctgcctcctgggttcaagtattcttgtgccttag

SEQ ID NO: 26018 - DNA, 190 bp, Homo sapiens
  DXS8032
  Located on chromosome X
  Distance between a terminus base of telomere on chromosomal short arm and 5'-terminus of this base sequence : 50560315
  Distance between 3'-terminus of neighbour sequence of sequence listing upward to telomere on chrosomal short arm and 5'-terminus of this base sequence : 115522
ctcctagaacagtacctgacacgtagtagacactcaaaaaatacttgttgaatgagtgaatacaataaaagcatataattcaaggaaaaaagaaaggcttttagaaactctgtgtgtgtgtgtgtgtgtgtgtgtgtgtgtgtgtaattattcaagaaagtcttggccaaatacaaagcaaaataaaatg

SEQ ID NO: 26019 - DNA, 468 bp, Homo sapiens
  Z98046.1_47471
  Located on chromosome X
  Distance between a terminus base of telomere on chromosomal short arm and 5'-terminus of this base sequence : 50562039
  Distance between 3'-terminus of neighbour sequence of sequence listing upward to telomere on chrosomal short arm and 5'-terminus of this base sequence : 1534
ttgagtccaagaattttggaccagcctgggcaacatggtgaaaccccatctctaccaaaaatacaaacaaacaaacaaaaccccaaaaattagtagggcgtgttggcatgtgcctgtagtcccagctacttctggaggctgaggtgggaggatcgcttgagcccaggaggtggaggttgcagtgagctgggatcacaccactgcacttcaaccagagtgacggagtgagaccctgggggaggtggggggaagacagagagagagagagagagagagagagagagaggatatagaagcctggaaatggaaaggagagaagttgccagcatgttgggggacagaaagggtccaacaggggtggggcatggggcctaggagaaggaacaattattaggcctttcccagtggtgggaatggttatggaaatctgaagaacaagaaagtctgatgtccaatttaaagttgatt

SEQ ID NO: 26020 - DNA, 285 bp, Homo sapiens
  DISO7_10004639
  Located on chromosome X
  Distance between a terminus base of telomere on chromosomal short arm and 5'-terminus of this base sequence : 50669674
  Distance between 3'-terminus of neighbour sequence of sequence listing upward to telomere on chrosomal short arm and 5'-terminus of this base sequence : 107167
ccatcagttctgtcttgccttttctgggttatagttaaaatctcagtatagttcttaaaactggtatatatatatttatatatatatatttatatatataaatatatatatttatatatatatatataaatatatatatttatatatatatatttatatatataaatatatatatatttatatatatatttatatatatatttatatatatatatttatatatatatatatttatatatatatatatttgaggctgagacttttgtaggcgatttaattctctgc

SEQ ID NO: 26021 - DNA, 276 bp, Homo sapiens
  MX_51012852
  Located on chromosome X
  Distance between a terminus base of telomere on chromosomal short arm and 5'-terminus of this base sequence : 51012750
  Distance between 3'-terminus of neighbour sequence of sequence listing upward to telomere on chrosomal short arm and 5'-terminus of this base sequence : 342791
ggaaactttggttcaggaatactatattctggtgttacctgtatggatatggatatttctctctctctctctatctctatgtatgtatctgtctgtctgtctatctatctatctatctatctatctatctatctatcatctatctatctatatgtgtgtgtatgtgtttatatatgttggaaaaatgtctttagatgtgtgattcgatgcacatatgcatttgtgtatttatattattgactttttattcacacacacacttacacccttaggtcc

SEQ ID NO: 26022 - DNA, 184 bp, Homo sapiens
  DISO7_10004645
  Located on chromosome X
  Distance between a terminus base of telomere on chromosomal short arm and 5'-terminus of this base sequence : 51067085
  Distance between 3'-terminus of neighbour sequence of sequence listing upward to telomere on chrosomal short arm and 5'-terminus of this base sequence : 54059
catattcaaggaaacaaccatgaaaatgtgtgtgtgtgtgtgtgtgtgtaggtatgtattcttttcctaagatagtgttcattttcatatgttaattctgtcatttaataaaatctcattcttctttcagtaaaactgtaaccttacgtcttttccaaaccttgccaattggcaaacacctctt

SEQ ID NO: 26023 - DNA, 459 bp, Homo sapiens
  chrX.fa.O7frz.49792041
  Located on chromosome X
  Distance between a terminus base of telomere on chromosomal short arm and 5'-terminus of this base sequence : 51129575
  Distance between 3'-terminus of neighbour sequence of sequence listing upward to telomere on chrosomal short arm and 5'-terminus of this base sequence : 62306
gatttgctacagcctaagactagcctcacaaatcctttttagagacaggaatttttacggtttaccagtttgcacagagagagagagagagagagagagagagagagagagagaccaaaagactttctggtaagaaattcttacccttttgccagcatgccaggttcctggagtccctttccctgagtggctctggtgaccctgcttgccgcaccataatcacaaagaaaaatcacctttttctgtttcatggaagcataggcaaaagcttctcaatcttgcaagatgccgcccaatgggctgcatgggggaactgagttaacattttccatcccagctgacacaaaatacacataacaaaacagacactgacccaatatcgacctgcctgtgttggtccttgtcatctttgacccactcaaggtagggagggatgacctttgaccaggaattcaatag

SEQ ID NO: 26024 - DNA, 183 bp, Homo sapiens
  DISD22_0007381
  Located on chromosome X
  Distance between a terminus base of telomere on chromosomal short arm and 5'-terminus of this base sequence : 51204143
  Distance between 3'-terminus of neighbour sequence of sequence listing upward to telomere on chrosomal short arm and 5'-terminus of this base sequence : 74109
gtgttaccctgtatggatatggatatttctctctctctctctctctctctctctctctctctctctatatatatatatatatatatatatatatatatatatatatacacacatacatgtgtgtgtgtgtgtatatatatctgttggaaaaatgtctttagatttatgattcgatgcacatat

SEQ ID NO: 26025 - DNA, 176 bp, Homo sapiens
  DISD22_0007384
  Located on chromosome X
  Distance between a terminus base of telomere on chromosomal short arm and 5'-terminus of this base sequence : 51288849
  Distance between 3'-terminus of neighbour sequence of sequence listing upward to telomere on chrosomal short arm and 5'-terminus of this base sequence : 84523
tagttgcgaggcatcatgccctctcctccctgccatatctaactatatgtatatctatctatctatctatctatctatctatctatctatctatctatcatctatctatctatctatctatctatctatctatctatctatctatttgaacaattttggaggagcaatcctcctag

SEQ ID NO: 26026 - DNA, 373 bp, Homo sapiens
  chrX.fa.O7frz.50338569
  Located on chromosome X
  Distance between a terminus base of telomere on chromosomal short arm and 5'-terminus of this base sequence : 51898630
  Distance between 3'-terminus of neighbour sequence of sequence listing upward to telomere on chrosomal short arm and 5'-terminus of this base sequence : 609605
gttctaggaaagttctggaagatactgataattttagtttaaaatgaaaatctcatgtttctgtgttttatcatcttcaataagacttcttaagtgttttggaaaatacacacacacacacacacacacacacacacacacacacacacactcttcattctcccttttacttacctttacagtttcttcaagaccttttccattttatgccaatattcactagttgagttattttttgtctctctacactataatatccataagaaaaggaactctacacatgtgcttatgatgtagtaatattttaaatatcagctcaacaaagatttgtgtaacaaaagaatgaatcaagtgtagcattgataagaactgc

SEQ ID NO: 26027 - DNA, 242 bp, Homo sapiens
  Z67761
  Located on chromosome X
  Distance between a terminus base of telomere on chromosomal short arm and 5'-terminus of this base sequence : 52048412
  Distance between 3'-terminus of neighbour sequence of sequence listing upward to telomere on chrosomal short arm and 5'-terminus of this base sequence : 149409
ctaacccctgcacacctattcttttttttgaatttctacacactgttttagtttttactcaatagatatttacttagtgaaacatttttaaacccctcattcacactcatcacactttgtacttctcatttgtagcacacagaaaattgtaattaatcaatttgtgtgtatgtgtgtgtgtgtgtgtgtgtgtgtgtgtgtgtgtgtttaagtgtctaccttcctccagtagactgtgagct

SEQ ID NO: 26028 - DNA, 406 bp, Homo sapiens
  chrX.fa.O7frz.50587093
  Located on chromosome X
  Distance between a terminus base of telomere on chromosomal short arm and 5'-terminus of this base sequence : 52162731
  Distance between 3'-terminus of neighbour sequence of sequence listing upward to telomere on chrosomal short arm and 5'-terminus of this base sequence : 114077
cagctttattgaggtatacttcagaaataaaatattgtctatatcatggtatacagtatgatgttctgatatatatatatatatatatatatatatatatagtgaaatgattcccacaatcaagataattaacatatctatcaccttacagttaccgtattttctttttttgtgtgtagtgagaacatttaagatctaccctcttagcagatttcatgtatacaatgcaatatcattaactatagtcaccatgctgtaccttagctcactaggcatttgaaatgttctgcctttaaaataccttaacagttcataaacattgtaacatgttagaactcttatctatactttctttggtgcaatatcatgctttaataaattcctaacatgagttcttgagtgaact

SEQ ID NO: 26029 - DNA, 135 bp, Homo sapiens
  DISO7_10019299
  Located on chromosome X
  Distance between a terminus base of telomere on chromosomal short arm and 5'-terminus of this base sequence : 52273968
  Distance between 3'-terminus of neighbour sequence of sequence listing upward to telomere on chrosomal short arm and 5'-terminus of this base sequence : 110831
ttatgggtgtggtggtatctagggtctaaaatggagttaaaaacccatacatactcaaccccctagccccaacacacacacacacacacacacacacacacacacacacacacacctagtcaagctccttgctca

SEQ ID NO: 26030 - DNA, 375 bp, Homo sapiens
  chrX.fa.O7frz.50994962
  Located on chromosome X
  Distance between a terminus base of telomere on chromosomal short arm and 5'-terminus of this base sequence : 52465506
  Distance between 3'-terminus of neighbour sequence of sequence listing upward to telomere on chrosomal short arm and 5'-terminus of this base sequence : 191403
cctacaagacctagacaatagactcaaaacagcaaatctaagacttgttgaccttagagaagaaatatatctatatgtatctatctatccatatctatatatctgtacacacacacacacacacacacacacagagagagagagagagagagaaatcagggtagaatatttattgaaaagaataataacagagaacttttcaaacttagaggaagatataaatatccaggtaaagaaggtcatagcacatcaagatgattcaacccaaataatactacatcaaggaatattaaactctaaagtcagggataaagagaggattctgaaagcaagagaaaataagcaaataacatataaaggagctctgaaacatct

SEQ ID NO: 26031 - DNA, 371 bp, Homo sapiens
  chrX.fa.O7frz.51114862
  Located on chromosome X
  Distance between a terminus base of telomere on chromosomal short arm and 5'-terminus of this base sequence : 52579123
  Distance between 3'-terminus of neighbour sequence of sequence listing upward to telomere on chrosomal short arm and 5'-terminus of this base sequence : 113242
caacactatgaggcagatttaccactatttcctatgtaaaatatgttggaaaatcaaggcacaaagagattagtcaacctgctcaaatttatttagctagtaaataatatcaaagtagttatgagtagaggcttctcacattaatatgaatgattatatcgtgtgtgtgtgtgtgtgtgtgtgtgtgtgtgtgtgtgtgtatagagttagaaataattattagaaattgaatttagaattttgtggtacttggatcagataccaaaggatcacattgtgatttaatatcctctgaatgtgtagcacctcaatctccttgagtgtcaatatatatccaatcaagcaaagttagcataatcaggaagtctaca

SEQ ID NO: 26032 - DNA, 477 bp, Homo sapiens
  chrX.fa.O7frz.51378357
  Located on chromosome X
  Distance between a terminus base of telomere on chromosomal short arm and 5'-terminus of this base sequence : 52773486
  Distance between 3'-terminus of neighbour sequence of sequence listing upward to telomere on chrosomal short arm and 5'-terminus of this base sequence : 193992
caacgatccagatttcagtgtgtataggcaggctgtctctcccacgtgcccatttgcccactctcactcacacaggcaggcacccagagaccacagacacagacacaaccacatggactcacagggaaaccccgacaaccacaaatataatcacaaacacacatgcacagggagatacacacacagacacaaagacatacactaacacatgcacactcacaaactcatagacacacacacacacacacacacacacacacacacacacaaatcctcacacaggcccaggggtgcgggctcaagcattcacccacacagacgcacacacacatgtgtcgccatagccaccagactgcccacgaactctcccataaaggctctcagtcggccacaggcaatgggctatgggtgaggattcctggctccaggcctgggtcattatgctgttgattgggcacctaaggccttctcctgaga

SEQ ID NO: 26033 - DNA, 218 bp, Homo sapiens
  DXS1190
  Located on chromosome X
  Distance between a terminus base of telomere on chromosomal short arm and 5'-terminus of this base sequence : 52927188
  Distance between 3'-terminus of neighbour sequence of sequence listing upward to telomere on chrosomal short arm and 5'-terminus of this base sequence : 153225
atcaccagacagaatcaccttcagacacacacacacacacacacacacacacacacacacacacacacacaccaggaaagaaaaaaggaagaccacagaacaactagaaaaataataacaaaatgacaggagtaattccttagttatcaataataacactgaatataaataaactaaattctctcatcaaatgacacagagtggctgaatggataaaa

SEQ ID NO: 26034 - DNA, 530 bp, Homo sapiens
  chrX.fa.O7frz.53123858
  Located on chromosome X
  Distance between a terminus base of telomere on chromosomal short arm and 5'-terminus of this base sequence : 52981084
  Distance between 3'-terminus of neighbour sequence of sequence listing upward to telomere on chrosomal short arm and 5'-terminus of this base sequence : 53678
ccaattcatgaacaaagaatatatatatatatatgtatatatatatatatatacgtatatatatatatgtatatatatatatatatgtatatatatatatatatatatatatatatatatatagagagagagagagagagagagagagagatggagttttactctgtcacccaggctgtagtacagtggcacgacctcagctcactgcaacctctgcctcacagtttcaaccgattctcctgcctcagccttctgagtagctgggattacaggtgcacgacaccacgtctggctaatttctgtgtttttagtagagatggggtttcaccatgttggccaggctggtctctaactcctgacctcaggtgatctacccgccttggcctcccaaagttctgggattacaggcatgagccaccgtgcctggccagagtatttttcagtattttggtgttctcttcaatttctttcatcagctttttatagttttcattatagagatctctctctttggtaaattcctaggtatt

SEQ ID NO: 26035 - DNA, 437 bp, Homo sapiens
  chrX.fa.O7frz.52916913
  Located on chromosome X
  Distance between a terminus base of telomere on chromosomal short arm and 5'-terminus of this base sequence : 53187494
  Distance between 3'-terminus of neighbour sequence of sequence listing upward to telomere on chrosomal short arm and 5'-terminus of this base sequence : 205880
gtagaacaataagaacacatggacacagagaggggcacaacacactctgaaacctgtcaggtggtgggggcaaggggaaggagagcatcaggacaaatagctaaaaacctagatgacaggttgttgggtacagcaaaccaccatggcactcatatatatatatatatatatatatatatacctgcacgttctgctcatgtatcccaaaacataaagtaacaacaacaacaataacaaaatgctttatgtaggggagaagtgtgtacgcgtatgtgtgtgtgtagtgtcactgttcaaatgaaaatcagaaacgaaaatccattggtgggattttctgagccattttaaaataaatttacattttttttaaattttgtttttctgtaagttattggggtacaggtggtttttggttacatgagtaagtcatttagtgg

SEQ ID NO: 26036 - DNA, 407 bp, Homo sapiens
  chrX.fa.O7frz.52721784
  Located on chromosome X
  Distance between a terminus base of telomere on chromosomal short arm and 5'-terminus of this base sequence : 53404316
  Distance between 3'-terminus of neighbour sequence of sequence listing upward to telomere on chrosomal short arm and 5'-terminus of this base sequence : 216385
ctggctgttaatgaagatattaacaatattaattttccaatctgtgaacatggaatatctttccattcttttctgcctattttaattttttcatcaatgttatatagttattaatgtacagactttctcctcttggttgaacttatgtgttagtattttaatcattttaattctattgtaaattagattatttcctgatttatttctaacattttatgtgaaatattaggatttttacgtatgagaacatgtcatctgcaaacacaattttgcattttcctttccaatttgcatgctatttatttatttatttatttatttatttatttgcctcattgctctggctaagacttccagtgacatgttgaatagaaatagccaaagtgaacacctttatcttattcctt

SEQ ID NO: 26037 - DNA, 331 bp, Homo sapiens
  chrX.fa.O7frz.52639198
  Located on chromosome X
  Distance between a terminus base of telomere on chromosomal short arm and 5'-terminus of this base sequence : 53481481
  Distance between 3'-terminus of neighbour sequence of sequence listing upward to telomere on chrosomal short arm and 5'-terminus of this base sequence : 76758
agtggctcacctggtaatcccagcactttgggaagctgaagtaggaggatttcttgagcccaagagtttgagactagcttgggaaaaaaaagcaagaccctgtctttacaaaaataaaaataagaaaattatctgggagtagtggtacacaactaaagtcccagctgcttggccggaagatgtgggaggatcacttgagcctgggaggtcaaagctgcagtaagccatgattgcacgactgcactccagcctgggcaacagagaaagatcttatctgaataaaataaaataaaataaaataaacaatctaacaatacacctcaaagaaatg

SEQ ID NO: 26038 - DNA, 168 bp, Homo sapiens
  AL031115.2_61606
  Located on chromosome X
  Distance between a terminus base of telomere on chromosomal short arm and 5'-terminus of this base sequence : 53564565
  Distance between 3'-terminus of neighbour sequence of sequence listing upward to telomere on chrosomal short arm and 5'-terminus of this base sequence : 82753
aacttgcagttggtgtattgagattaggttagggaagaattcccaagctggttgtactgtgtgtgtgtgtgtgtgtgtgtgtgtgtgtgtgtattttaagaaatgtcttggcccaggtaatgtgtagtatgcattaccttcctggtatgcattgattagcaactagtg

SEQ ID NO: 26039 - DNA, 229 bp, Homo sapiens
  Z93019.1_118188
  Located on chromosome X
  Distance between a terminus base of telomere on chromosomal short arm and 5'-terminus of this base sequence : 53811146
  Distance between 3'-terminus of neighbour sequence of sequence listing upward to telomere on chrosomal short arm and 5'-terminus of this base sequence : 246413
ctcagcatttcagataaaggacactcaacctgtatacacacacacacacacacacacacacacacacacatatatacacatatacacatatatacacatatacacatatatacatatatacacatatgtgtgtgtgtgtatgtgcatgcgtgtatgtataaaatgaaatgttattaggccttaagaaagaaggaaattttgtcctttgtgacaatatggacagaccttg

SEQ ID NO: 26040 - DNA, 285 bp, Homo sapiens
  AL354756.10_128095
  Located on chromosome X
  Distance between a terminus base of telomere on chromosomal short arm and 5'-terminus of this base sequence : 53877542
  Distance between 3'-terminus of neighbour sequence of sequence listing upward to telomere on chrosomal short arm and 5'-terminus of this base sequence : 66167
ggcagtgttaagatgaaagtttatagcattaaatgtctacatcaaaaatatagaaatatctcaaatcaacaacctaacatcacaccacaaagaatgagaaaagcaagaccaaaccaaaaccaaaataagcagaagaaaaggaataatgaagatcaaagcagaaccaaattagagacaaaaacaaacaaacaaacaaacaaacaaaaaagagaagatcaacgatatgaatagttgggtcttcaaaaagataaaactgataaaccactatctagaatggccatgaaa

SEQ ID NO: 26041 - DNA, 394 bp, Homo sapiens
  AL034396.6_19762
  Located on chromosome X
  Distance between a terminus base of telomere on chromosomal short arm and 5'-terminus of this base sequence : 53888613
  Distance between 3'-terminus of neighbour sequence of sequence listing upward to telomere on chrosomal short arm and 5'-terminus of this base sequence : 10786
ctacaaggaaatagcatggagtacaaagaatgtaagagaaatcaattaaggtgggaggcagcaaacagttataaacaaaatagtcatgaaactcaagagtcgaatgggagagtgggaaatatttcctctttgttttgagctacacacacacacacacacacacacacacacacattactaagtgaaatacatttgtaatctgagctaggtaaattttaatatgaattgtagatctgactttgccataattacctcacaggattgtgaggatcaaatataatagttgtgaaagtgctaaattgtaaaatgctatactcacataagatagatggtatctactcaaaatgcagacaaaaccctctcatttcaactctaagagtaagccagcaatgag

SEQ ID NO: 26042 - DNA, 206 bp, Homo sapiens
  AL024458.1_80943
  Located on chromosome X
  Distance between a terminus base of telomere on chromosomal short arm and 5'-terminus of this base sequence : 53974402
  Distance between 3'-terminus of neighbour sequence of sequence listing upward to telomere on chrosomal short arm and 5'-terminus of this base sequence : 85395
agtttcaggccttacatttaagtcttttaaatccaatttgaggggtgtgtgtgtgtgtgtgtgtgtgtgtgtgtgtgtgtgtgtgttttgaaattaggttttcttcatgtggatatccagttttctcagcatcatttgttcaagagactgttcttttcccactgtgtgtttctggcctctttgttgaaactcaattgaccttaaga

SEQ ID NO: 26043 - DNA, 218 bp, Homo sapiens
  AL024458.1_70480
  Located on chromosome X
  Distance between a terminus base of telomere on chromosomal short arm and 5'-terminus of this base sequence : 53984894
  Distance between 3'-terminus of neighbour sequence of sequence listing upward to telomere on chrosomal short arm and 5'-terminus of this base sequence : 10286
acaccaagctatctgcagtagtttgttgttgttgttgttgttgttgttgttgttgttttttcataccccagtggcacctggaatgccagagagagagaaccattcactcccctggaaagggggctgatgtcagggagccaagtgttctggctcagtgagttccacctccatggagcccagcaagctaagatccactggtgtgaaattctcactgccaa

SEQ ID NO: 26044 - DNA, 413 bp, Homo sapiens
  chrX.fa.O7frz.58625310
  Located on chromosome X
  Distance between a terminus base of telomere on chromosomal short arm and 5'-terminus of this base sequence : 57652961
  Distance between 3'-terminus of neighbour sequence of sequence listing upward to telomere on chrosomal short arm and 5'-terminus of this base sequence : 3667849
cctacgatcaatttcaatgtaagaggtttttgttgttgttgttgttgttgttgttgttgttgttgttttaatctggtaaggatgaggtttaaggaaacatgcaataaaatggtagaggaagcaacaccctgtggtacatgacccacagagtctgccaaatattgacaccaaagacgtgaaccagaatggagcttagaagagtctcaacaaaggtgacatttccatactgggtgttgtagatggcaatactgtgaggcaaagcagtagcagaccttggaaaaaccagatccaaagagttcaacaaacattttcatataataaaacaagagtcagagaaggaaaaaagttataaagagttcagaaaaatacaggaggtagacaacattccccagtcagacctagcatactttcct

SEQ ID NO: 26045 - DNA, 321 bp, Homo sapiens
  chrX.fa.O7frz.58843670
  Located on chromosome X
  Distance between a terminus base of telomere on chromosomal short arm and 5'-terminus of this base sequence : 57924272
  Distance between 3'-terminus of neighbour sequence of sequence listing upward to telomere on chrosomal short arm and 5'-terminus of this base sequence : 270898
tgttttccatactattagaagcacagtccttagcatttttgggtctaacaatattaagcagccaaatccagaaaccccaaaaccaatgaaagaactccacccttaatattctgttcctgtagaaccactcctggtaccaaaatttgtattagtcagggttctctagagggacagaactaataggatatatatatatatatatataaactggatcctgatatatatatatatatatatatctcctattagttatgggtatataatagaatatatctatataatagaatatatatgggagtttcttaggtgttaagtcacatg

SEQ ID NO: 26046 - DNA, 223 bp, Homo sapiens
  DISO7_10019304
  Located on chromosome X
  Distance between a terminus base of telomere on chromosomal short arm and 5'-terminus of this base sequence : 58171571
  Distance between 3'-terminus of neighbour sequence of sequence listing upward to telomere on chrosomal short arm and 5'-terminus of this base sequence : 246978
ccttcatattgtaggaatcctctcttggtggttttggtaaaataatcatatatatatatatatatatatgtatatatatatatacacatacacacacatatatacacacacacatatatacacatttatatacacacacacacacacacacacatatatattaagatatagcatactagtcttattgttaatatatgtactttagcaacatgcccatgatcaa

SEQ ID NO: 26047 - DNA, 165 bp, Homo sapiens
  Z67619
  Located on chromosome X
  Distance between a terminus base of telomere on chromosomal short arm and 5'-terminus of this base sequence : 58294767
  Distance between 3'-terminus of neighbour sequence of sequence listing upward to telomere on chrosomal short arm and 5'-terminus of this base sequence : 122973
ggtaagctgccccacaccaggcaaattccctttatttcacaattggcaaaacacacacacacacacacacacacacacacacacacgaacgagagctatgccaggaggtgtctttttacttcttttattgaactccataaatattttcataaggctttgtgtcat

SEQ ID NO: 26048 - DNA, 269 bp, Homo sapiens
  chrX.fa.O7frz.56466539
  Located on chromosome X
  Distance between a terminus base of telomere on chromosomal short arm and 5'-terminus of this base sequence : 58557145
  Distance between 3'-terminus of neighbour sequence of sequence listing upward to telomere on chrosomal short arm and 5'-terminus of this base sequence : 262213
acatttagaagctgcagtaattagggcaagttgggaagaggcaaagaaagaaaagctaggaagagtcttggcaagcccagaacttttgcccaaaggtagggaggagagagagagaagaaagaaagaaagaaagaaagaaaaaaagaaagaaagaaagaaagaaagaaagaaagaaagaaagaaagaaagaaagaaagggaaatagaaagacaaatgtacacacatgcacactttgacgctaatttttgtttggaaattaatagctttgc

SEQ ID NO: 26049 - DNA, 285 bp, Homo sapiens
  chrX.fa.O7frz.56848064
  Located on chromosome X
  Distance between a terminus base of telomere on chromosomal short arm and 5'-terminus of this base sequence : 58889108
  Distance between 3'-terminus of neighbour sequence of sequence listing upward to telomere on chrosomal short arm and 5'-terminus of this base sequence : 331694
accataatttcacattgctaatagcaaataagccccacttccccaagcgggaggcaatgcagacttggctgctaatcagtggttcatcattcattgggggaaaggggcagggggcactaaaggtttagcctgtgtcaaggatgcatgctatatatgtgtgtgcatgtgtgtttgtgtgtgtgtgtgtatgtatgtgtgtgtgtgtgtgtgtgtgtgtgtgtgtatatatatatatatatatatatatatatatatatatatatataatcactaacttggcaactg

SEQ ID NO: 26050 - DNA, 434 bp, Homo sapiens
  chrX.fa.O7frz.56921129
  Located on chromosome X
  Distance between a terminus base of telomere on chromosomal short arm and 5'-terminus of this base sequence : 58963170
  Distance between 3'-terminus of neighbour sequence of sequence listing upward to telomere on chrosomal short arm and 5'-terminus of this base sequence : 73777
cagacttaatatggaagccactggtttcacacatgccaacttccgagcatatttttgttcagctcctgcaagacccatgggtctaaatgagacagctgcttttttatttttgcttttttgtaatatgttctttattattattattattattattattattattattattattatttaagttttagggtacatgtgcacaacgtgcaggtttgttacatatatatatatgtcatgttggtgtgctgcacccattaacttgtcatttaacattaggtatatctactaatgctatccctcccccctcccaaccccacaacaggccccggtgtgtgatgttccccttcctgtgtccatgtgttctcattgttcaatttcgacctatgagtgagaacatgtgatgtttggttttttgtccttgcaatagtttactgaga

SEQ ID NO: 26051 - DNA, 272 bp, Homo sapiens
  chrX.fa.O7frz.57099212
  Located on chromosome X
  Distance between a terminus base of telomere on chromosomal short arm and 5'-terminus of this base sequence : 59141120
  Distance between 3'-terminus of neighbour sequence of sequence listing upward to telomere on chrosomal short arm and 5'-terminus of this base sequence : 177516
tgcttaaactcaggattcaaggctgcagtcagctgtgattgtgccattgcactccagcctgggttgtagagtgagaatttctctattatctatctatctatctatctatctatcatctgtctatctatccatctatcatctgtctgtctgtctatctatctatctatctatctatctatctatctatctatctatctctatactcctgctcacttttagtttccatttgcataaaatatctttttatgcgttatttccattaccttcacatc

SEQ ID NO: 26052 - DNA, 229 bp, Homo sapiens
  DISD22_0007422
  Located on chromosome X
  Distance between a terminus base of telomere on chromosomal short arm and 5'-terminus of this base sequence : 59572097
  Distance between 3'-terminus of neighbour sequence of sequence listing upward to telomere on chrosomal short arm and 5'-terminus of this base sequence : 430705
accaagtccactcaacactgtataaaaaccatgaaatcatgtttgctttgtgtgtgtgtgtgtgtgtgtgtgtgtgtgtgtgtgtgtgtgtgtatgtgtgtgtcagtgaaattttgggattaaataatctttgggtaaatatgtaattttgtttccttaagaaattcagcttatacttttttgttgccatttgacaaaataaaagataatattcaattgttgtatggca

SEQ ID NO: 26053 - DNA, 443 bp, Homo sapiens
  chrX.fa.O7frz.58303718
  Located on chromosome X
  Distance between a terminus base of telomere on chromosomal short arm and 5'-terminus of this base sequence : 59732385
  Distance between 3'-terminus of neighbour sequence of sequence listing upward to telomere on chrosomal short arm and 5'-terminus of this base sequence : 160059
tgatctccaatctgatacttctacttaattagttctagagtgattcactctttttcgcctttccaattgttcttctctttcttcagtactttttggctggtctgtataaagtttcattttagtttgacagtccatttgagctctcctctaatgtttcttctttctttccttccttccttccttccttccttccttccttccttccttccttctttcttttttttgggggacggagtcttgttgtgtcgcctagatggagtgcaatggtgccatctcggctcactgcaacctccacctcctaggttcaagtgattctactgcccccgcctcccaagtagctgggattacaggcaagtgccaccacgcctggctaatttttgtatttttagtagaggagggattttgccatgttggccaggctggtcttgaactcctgacgtcag

SEQ ID NO: 26054 - DNA, 446 bp, Homo sapiens
  chrX.fa.O7frz.58017547
  Located on chromosome X
  Distance between a terminus base of telomere on chromosomal short arm and 5'-terminus of this base sequence : 59892248
  Distance between 3'-terminus of neighbour sequence of sequence listing upward to telomere on chrosomal short arm and 5'-terminus of this base sequence : 159420
atcttagataaaaggcttgcagtttttcctcagtatgatagtagctgtgggtcagtggtatatggcttttattttattgaggtatgtttattctgtacccagttttttggtaggtttatttaggaggatgttgaatattatcaaatgctttatcagcatcagttgaatttatcatatgatttttgtccttcattcttttgatacgatggattacattggctgacttgcatatgttgaactattcctccctccctaggataaatcccacttggtcatgatgaatgatatttttatgttgtttaatttgttttgctaatattttattggggattttcccagatagatagatagatagatagatagatagatagattgtttttgagatggagtctcgctctattgctgggctggagtgcagtggcacaatctcgactagtttcaagcga

SEQ ID NO: 26055 - DNA, 311 bp, Homo sapiens
  chrX.fa.O7frz.57941896
  Located on chromosome X
  Distance between a terminus base of telomere on chromosomal short arm and 5'-terminus of this base sequence : 59922341
  Distance between 3'-terminus of neighbour sequence of sequence listing upward to telomere on chrosomal short arm and 5'-terminus of this base sequence : 29647
agtagacatggtgtacaccaatagcaactaagctgagaataaattcaagaattcaaccccttttacaatagctgcaaaataataataataataataataataataataataataataataataataaaacacttaggaaattacataaccaaggctgtgaaagacctctacatggaaaaactaaaaacactattgaaagaaatcatagatgacacaaagaaatggaaacatcccatgctcatggatggctagaatcaatattgtgaaaatgaccatactgccaaaggcagtctacaaattcagtgcaattc

SEQ ID NO: 26056 - DNA, 288 bp, Homo sapiens
  G08111
  Located on chromosome X
  Distance between a terminus base of telomere on chromosomal short arm and 5'-terminus of this base sequence : 60135271
  Distance between 3'-terminus of neighbour sequence of sequence listing upward to telomere on chrosomal short arm and 5'-terminus of this base sequence : 212619
aatcagtgctttctgtactattggaaatagagtccttagcatttttaagtgtgatgacattagagagccagttctaaaaatcttccaaaaccaatttacaaaactcattcttaaaattttatttctatagaaccactcctggtgccaaactctattagtcaacgttctccagagaaacagaaccaataggatagatagatagatagatagatagatagatagatagatagatagatagatagatagacagtcagatagatgagaggggatttattatgaaaatgggct

SEQ ID NO: 26057 - DNA, 153 bp, Homo sapiens
  HUMUT767
  Located on chromosome X
  Distance between a terminus base of telomere on chromosomal short arm and 5'-terminus of this base sequence : 60242636
  Distance between 3'-terminus of neighbour sequence of sequence listing upward to telomere on chrosomal short arm and 5'-terminus of this base sequence : 107077
gaggagggtcagaatcttgtagcctctagctccatgactcctaaaccataatttcttttctttcttttctttctttctttctttctttctttctttctttctttctttctttctttctttctttctttttttagacagagacttgctgtgtcg

SEQ ID NO: 26058 - DNA, 405 bp, Homo sapiens
  Z98946.15_73594
  Located on chromosome X
  Distance between a terminus base of telomere on chromosomal short arm and 5'-terminus of this base sequence : 60383006
  Distance between 3'-terminus of neighbour sequence of sequence listing upward to telomere on chrosomal short arm and 5'-terminus of this base sequence : 140217
cattgcataatttaatcctgagaggtttgtgcacctgaggtttagggatttggttggcccctgtgctgaggcctaggaagagacaggcatagaccagggaggatagcaaggaagtcctggcgatcataatgttggggcatccagtggatatccactcttgctattgctactgttgccgccgccgccaccaccaccaccaccaccaccaccaccaccaccaccaccaccaccacccaggctgctttagggcccagagctgcttatctttgcagacttggtattttttggccaaggtagactaattttgggggcagtaggagatattttcctcccatccactcctgagaaaagggtagggccagcatttgagaggtgtaggtttatgcttactaggtaaggttgact

SEQ ID NO: 26059 - DNA, 379 bp, Homo sapiens
  AL034397.1_69633
  Located on chromosome X
  Distance between a terminus base of telomere on chromosomal short arm and 5'-terminus of this base sequence : 60684225
  Distance between 3'-terminus of neighbour sequence of sequence listing upward to telomere on chrosomal short arm and 5'-terminus of this base sequence : 300814
agcactattcacaatagcaaatacatgaaatcaacccaaatgcccatcaatggtagcctggataaagaaaatgaggtacatatataccatggaatactatgcagcccaaacaaaacaaaacaaaacaaaacaaaacaaaacatgagataatgtcctttgcagtaacatggatcaacctggaagccatcatcctcagcaaactaacacaggaacagaaaaccaaacacagaatgttctcactcatatgtgggagctgaacagtgaaaacacatggacacagggagggaaacaacacacacggggtcctgtcaggagggtggggagagacggcatcaggataaatagctaatgcatgctgagcttaatacttaggtgatga

SEQ ID NO: 26060 - DNA, 240 bp, Homo sapiens
  AL034397.1_1155
  Located on chromosome X
  Distance between a terminus base of telomere on chromosomal short arm and 5'-terminus of this base sequence : 60752698
  Distance between 3'-terminus of neighbour sequence of sequence listing upward to telomere on chrosomal short arm and 5'-terminus of this base sequence : 68094
tatggatccaagcagtcaccattatcaattctgatggtgtcaaattaatcaaaggtgtaaaacagtgtctctcagtcttggctacactttattttttattttattttattttattttattttattttattttattttattttattttttaccaacaggagatgcagtttatttacaaaagcagccatgggggcagagggaatacatagcatttacagagttagctacctgtacagaatga

SEQ ID NO: 26061 - DNA, 177 bp, Homo sapiens
  Z23526.1_192
  Located on chromosome X
  Distance between a terminus base of telomere on chromosomal short arm and 5'-terminus of this base sequence : 60899948
  Distance between 3'-terminus of neighbour sequence of sequence listing upward to telomere on chrosomal short arm and 5'-terminus of this base sequence : 147010
gaaagtatgttgccacagaaaccaaggaaggagagtttcaagaaatagggaataggagagattggtgtgtgtgtgtgtgtgtgtgtgtgtgtgtgtttggtagtggagaatagttcaatgttgtcaggatgtggatcatggtggaggtgaggccagaaaggacagttgagcactcat

SEQ ID NO: 26062 - DNA, 292 bp, Homo sapiens
  AL030998.1_51584
  Located on chromosome X
  Distance between a terminus base of telomere on chromosomal short arm and 5'-terminus of this base sequence : 60899948
  Distance between 3'-terminus of neighbour sequence of sequence listing upward to telomere on chrosomal short arm and 5'-terminus of this base sequence : -177
gaaagtatgttgccacagaaaccaaggaaggagagtttcaagaaatagggaataggagagattggtgtgtgtgtgtgtgtgtgtgtgtgtgtgtgtttggtagtggagaatagttcaatgttgtcaggatgtggatcatggtggaggtgaggccagaaaggacagttgagcactcatcccaaagacagagatattcacgagtagagttaaagtggcatagagaggaaggcagaggtgttgaggatgactcagcagtttcaagttgtgtgaaaccatagtacatagctgatgc

SEQ ID NO: 26063 - DNA, 479 bp, Homo sapiens
  chrX.fa.O7frz.60792072
  Located on chromosome X
  Distance between a terminus base of telomere on chromosomal short arm and 5'-terminus of this base sequence : 61293650
  Distance between 3'-terminus of neighbour sequence of sequence listing upward to telomere on chrosomal short arm and 5'-terminus of this base sequence : 393410
ctcaaatagaggcatgataaatacacaagttctggcctcttacctcctggtaattccagtcacttctcccccattctgtagtggttccctcaataagcccttctacagcctgtgatagttatttcccaatatatcttttcctatgcacacccctaagccttagtggtttcctccgtcctttctcctttggtatgagtgatacctcctaaatcgtcctcctctaagttctgcctagatgttttctctccctcttttctctaggctacatagggtctagagagactaaaaagaagagaacggaaaaggactcaagttctgtctctttcttttgctctgaactgagcaattaagttgtgagtgtgtgtgtgtgtgtgtgtgtgtgtgtgtgtgagagagagagagagattggttatggaatcagccctagtaatgaacatttttaagaaagtaaattagtaaaccaatagcagtctactcag

SEQ ID NO: 26064 - DNA, 155 bp, Homo sapiens
  DISD22_0007444
  Located on chromosome X
  Distance between a terminus base of telomere on chromosomal short arm and 5'-terminus of this base sequence : 61829275
  Distance between 3'-terminus of neighbour sequence of sequence listing upward to telomere on chrosomal short arm and 5'-terminus of this base sequence : 535146
caataataccaattacgaaagactgttaagaaaaatagagatgatgaatgtacttttcctaacttgtgtgtgtgtgtgtttgtgtgtgtgtgtgtgtgtgtgtgtgtgtgtgtgttggggtgggggaggatggttggtaaggattaaattacatg

SEQ ID NO: 26065 - DNA, 376 bp, Homo sapiens
  chrX.fa.O7frz.60285545
  Located on chromosome X
  Distance between a terminus base of telomere on chromosomal short arm and 5'-terminus of this base sequence : 62033762
  Distance between 3'-terminus of neighbour sequence of sequence listing upward to telomere on chrosomal short arm and 5'-terminus of this base sequence : 204332
atccagtaaggtccatacctactgttagcagatatgtctcctaagtcttttttgacacacagctattcatttttttccttccttaaaatgtatttgttgaagaaatgggtgattttttttttggcttttgtttttgtgtttgtctgtctgtcctgtagcctttcccccaagcctgagctctgaggattgcatcgctgttgtaatttattattattattattattattattattattattattattattatagtttaagttctggaatacatttgcagaacgtgcaggtttgttagataggtatacatgtgccatggtggtttgcagcacccatcaacctgtcatctacattagatagttctcctaatgctatccat

SEQ ID NO: 26066 - DNA, 266 bp, Homo sapiens
  AL049564.10_60364
  Located on chromosome X
  Distance between a terminus base of telomere on chromosomal short arm and 5'-terminus of this base sequence : 62245918
  Distance between 3'-terminus of neighbour sequence of sequence listing upward to telomere on chrosomal short arm and 5'-terminus of this base sequence : 211780
tccttggttaggtatattcctaagtattgtattttactgtattgtattgtattgtattgtattgtattgtattgtattgtattgtattgtattgtattgtattttttgcagctattgtaacaggagttgagttattgatttaattctcggtttggtcgctgttggtgtataggatagctactgatagtgaaataaaattggaaatccactccaaaaagaactttcaaaactatgcacatacatggaaattaaataacctacgcctg

SEQ ID NO: 26067 - DNA, 205 bp, Homo sapiens
  AL049564.10_17697
  Located on chromosome X
  Distance between a terminus base of telomere on chromosomal short arm and 5'-terminus of this base sequence : 62288594
  Distance between 3'-terminus of neighbour sequence of sequence listing upward to telomere on chrosomal short arm and 5'-terminus of this base sequence : 42410
atcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatg

SEQ ID NO: 26068 - DNA, 326 bp, Homo sapiens
  G08110
  Located on chromosome X
  Distance between a terminus base of telomere on chromosomal short arm and 5'-terminus of this base sequence : 62569466
  Distance between 3'-terminus of neighbour sequence of sequence listing upward to telomere on chrosomal short arm and 5'-terminus of this base sequence : 280667
gaatggtcaactggtgaaggagaaaatggataaaattgactatgccattttctaaatctgtgaccttagctgtgtcacttaacctttctggatcttactttcctcatatgatagatgatagatagatagatagatagatagatagatagatagatagattccctatacttcctgaatctatgaccttagctatgccacttaacttttctggatcttactttcctcatatgacagatagggaagggggatttggcaacaacaacaaaaacctctaagtggttttctaactgtagtctacagatctctgaagccagcacacttcactt

SEQ ID NO: 26069 - DNA, 274 bp, Homo sapiens
  chrX.fa.O7frz.61982446
  Located on chromosome X
  Distance between a terminus base of telomere on chromosomal short arm and 5'-terminus of this base sequence : 62643441
  Distance between 3'-terminus of neighbour sequence of sequence listing upward to telomere on chrosomal short arm and 5'-terminus of this base sequence : 73649
caggttattgcactcttaatagactacagtatagtgtaaacattacttttatatatactgggaaaccaaaaaattcatgtgacttgacttattgcaatatttgctttattgtggtagtctggaaccaaacctgcaatatctctaaaataggagatatatatatatatgtgtgtgtgtgtgtgtgtgtgtgtcctcttctctggttctctggaaaactggctaacacagaaaagggaaagcactatttttggtgttagacacaactgaggtcaaa

SEQ ID NO: 26070 - DNA, 290 bp, Homo sapiens
  chrX.fa.O7frz.61920541
  Located on chromosome X
  Distance between a terminus base of telomere on chromosomal short arm and 5'-terminus of this base sequence : 62705207
  Distance between 3'-terminus of neighbour sequence of sequence listing upward to telomere on chrosomal short arm and 5'-terminus of this base sequence : 61492
tttagcttaaccttatcatttcagaaattaaatgtgaagtagagtcttggcttaattagattctctctctttacacatactgacgcccaccccccaccaagtgtgtgtgtctgtgtgtgtgtgtgtgtgtgtgtgtgtgtgtgtaggtaggtagatatagagatacattctaaaatacaaatgtataaaatataaatctatacagtaaaatctataaagtataactatatatttacatttacttatattttaaaatatctatctatctatcttattccagaaatcagttg

SEQ ID NO: 26071 - DNA, 251 bp, Homo sapiens
  chrX.fa.O7frz.61814891
  Located on chromosome X
  Distance between a terminus base of telomere on chromosomal short arm and 5'-terminus of this base sequence : 62820995
  Distance between 3'-terminus of neighbour sequence of sequence listing upward to telomere on chrosomal short arm and 5'-terminus of this base sequence : 115498
agatcagcttttatcttaaggaacccccatgtgtgtatctgtgtgtgtgagtgtgtgtgagtgtgtgtgtgtgtgtgtgtgtgtgtgtgtgtttgtaaaagatcaggttcttccaggtaagtaaactatttttttcagtgtgttaaatttatcttgtcattttcaggagtgagagaaggtttggagggcagaaaaagagagattaactgcttaaagatatttgagtagtacatagaatgtgagtatcggtt

SEQ ID NO: 26072 - DNA, 335 bp, Homo sapiens
  chrX.fa.O7frz.61687622
  Located on chromosome X
  Distance between a terminus base of telomere on chromosomal short arm and 5'-terminus of this base sequence : 62948076
  Distance between 3'-terminus of neighbour sequence of sequence listing upward to telomere on chrosomal short arm and 5'-terminus of this base sequence : 126830
agctagcctcattcaaatttacagagaaaggaaccgaaacactaaaacttcaagttcacattctagcccctgttaagccatagtatatataacggtggccataaaatgcatgcaaaaataaataaatacttatttttttaaaaaaaggccaggcgtggtggttcatgcctgtaatcttagtacaggcaggaagatcaccttaggccaggagtttgagaccagcctgggatacatagtgagacccccatctctacaaataataataataataataataatagaatgcatgcaaatgtcatataatgtaataatattcatccaataagattagtggt

SEQ ID NO: 26073 - DNA, 475 bp, Homo sapiens
  chrX.fa.O7frz.64686441
  Located on chromosome X
  Distance between a terminus base of telomere on chromosomal short arm and 5'-terminus of this base sequence : 63071473
  Distance between 3'-terminus of neighbour sequence of sequence listing upward to telomere on chrosomal short arm and 5'-terminus of this base sequence : 123062
gcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcactttaact

SEQ ID NO: 26074 - DNA, 350 bp, Homo sapiens
  chrX.fa.O7frz.64798980
  Located on chromosome X
  Distance between a terminus base of telomere on chromosomal short arm and 5'-terminus of this base sequence : 63183999
  Distance between 3'-terminus of neighbour sequence of sequence listing upward to telomere on chrosomal short arm and 5'-terminus of this base sequence : 112051
gaattgccagtaggacaataggcagtgggagtgagcagagctgcacctggccagagactgtggccatcatccctttgctccaggcgatgcctgttcctatctttccatcatgaccaagattagtaaggatgggggagaagacatgggtcccagacagattgagctcccccagcctttggctgggagctgcggggagtggtgactaagacatgtgtgggcttgctgtgtgtgtgtgtatgtgtgtgtgtgtgtgtgtgtgtgtgtgtgtgtgtgtgtgtgcgcgcgcgcgcgcgcacgtgtgtatgggtataggagaggtagtagcagcggtcatgaaggaatctttgttg

SEQ ID NO: 26075 - DNA, 129 bp, Homo sapiens
  DXS8040
  Located on chromosome X
  Distance between a terminus base of telomere on chromosomal short arm and 5'-terminus of this base sequence : 63372560
  Distance between 3'-terminus of neighbour sequence of sequence listing upward to telomere on chrosomal short arm and 5'-terminus of this base sequence : 188211
cactggcttggagatctgtaggctgatttgacacctgcagaggaaggagaatacgagtggttttgtgtgtgtgtgtgtgtgtgtgtgtgtgtgtgtgtgtgtgtttgtgtaagtgactgggggtcatgg

SEQ ID NO: 26076 - DNA, 415 bp, Homo sapiens
  chrX.fa.O7frz.64998248
  Located on chromosome X
  Distance between a terminus base of telomere on chromosomal short arm and 5'-terminus of this base sequence : 63383160
  Distance between 3'-terminus of neighbour sequence of sequence listing upward to telomere on chrosomal short arm and 5'-terminus of this base sequence : 10471
tctgtttagatcaactgctcagttctggtttgggcctctgagggctgatggggtttggcaggtaagaatttctgaggccacccatctctgccttttacagggctatgggctcagctcccaccagcccctgcaggagcaggaaggcagcctgatctactgccttactaacctctttctttactttcctctctctttcttttttctctttttcttctctttttttctctctctttctttccttctttctttcttctttctctctttctttctttcctttctttctctactccctaccccaactctctcttgctccctctcccctctgtctctcacatctctctctctctctctctctcgctcgctcactcactcgctcgctctcgctctcagtttgttcctgtctcttactgactcc

SEQ ID NO: 26077 - DNA, 459 bp, Homo sapiens
  chrX.fa.O7frz.64541776
  Located on chromosome X
  Distance between a terminus base of telomere on chromosomal short arm and 5'-terminus of this base sequence : 63462095
  Distance between 3'-terminus of neighbour sequence of sequence listing upward to telomere on chrosomal short arm and 5'-terminus of this base sequence : 78520
ctttccaacataactgaattgatggggtgcaggtcaaggagcagagagggtggtgctgccatctgagcagtgaagactactaaagtgccttgggattgcaaggtttttcctcagctagagagccccctactccccctagtctgcaactggcactgtcctatccccggtacccaaggtttgctcagaaagaaagaggcacatatctccctaccgctaacacacacacacacacacacacacacacacacactcaaacacattcacatactcacacaccctattagagtctttggaaggcatgtcctaggccgcctctcacaccttgccctggagcccgggatgagtcacctcctcaccatggacatgcaggcacaggtcttcatgagagccgtgggagcaagcaaacttcaaggcttcaggggccgccaacccccaggcctgagctacacttctagcagg

SEQ ID NO: 26078 - DNA, 246 bp, Homo sapiens
  DXS1216
  Located on chromosome X
  Distance between a terminus base of telomere on chromosomal short arm and 5'-terminus of this base sequence : 63490722
  Distance between 3'-terminus of neighbour sequence of sequence listing upward to telomere on chrosomal short arm and 5'-terminus of this base sequence : 28168
tgccaacagtgctaaggatcaatgctaaagaacaggtttggggagatggtgaccaaggagattagattctctttcagtgacccctcctctctctctctctctcacacacacacacacacacacacacacacacgcacacacatgcacaaacatcctcctcattcctctctctctctttcccccctcactccccatttctcttttttcttgcaataaattctaaacagatgggcaagtcttctaccc

SEQ ID NO: 26079 - DNA, 356 bp, Homo sapiens
  HUMUT6044
  Located on chromosome X
  Distance between a terminus base of telomere on chromosomal short arm and 5'-terminus of this base sequence : 63607632
  Distance between 3'-terminus of neighbour sequence of sequence listing upward to telomere on chrosomal short arm and 5'-terminus of this base sequence : 116664
aggctgaggcaggagaatcactggaacctgggagacagaggttgcagtgagccgagatctcaccactgcactccagcctgggcgacagagtaagactccatctcaaaaaaaaaaaaaaaaaagaaagaaagaaagaaaagaaagaaagaaagaaagaaagaaagaaaggaaggaaggaaggaaggaaggaaggaaggaaggaagaaagaaagaaagaaagaaagaaagaaagaaagaaagaaagaaagaaagaaagaaaaagaaagaaagaaaagaaaagcacttggaacagtgcatggtttataataaacactcaataaatggtacctgttattatcattgcttctgggggttgt

SEQ ID NO: 26080 - DNA, 165 bp, Homo sapiens
  DXS8111
  Located on chromosome X
  Distance between a terminus base of telomere on chromosomal short arm and 5'-terminus of this base sequence : 63619648
  Distance between 3'-terminus of neighbour sequence of sequence listing upward to telomere on chrosomal short arm and 5'-terminus of this base sequence : 11660
gtaggaacaataagttatgccttgcttttacacacacacacacacacacacacacacacacatctatatatctattctctcttgtatgcttgctgatagcaatctctgcctcctgttataataaatattgattggcactgttaggaaacgccagggctttaatct

SEQ ID NO: 26081 - DNA, 265 bp, Homo sapiens
  DXS8031
  Located on chromosome X
  Distance between a terminus base of telomere on chromosomal short arm and 5'-terminus of this base sequence : 63663309
  Distance between 3'-terminus of neighbour sequence of sequence listing upward to telomere on chrosomal short arm and 5'-terminus of this base sequence : 43496
ggttttctgctataaccacagcatctagaatagtaccctagcacacttgtgcacatacacacacacacacacacacacacacacacacacacattaagtgaataaataaccaaactcagagcaaattttttttcttccagaaaaaaaaatctagcccatacataaagaacttaaccccaggcctgaactggaggagtactgggctatttcattcattcaataaatatttatttataaccaggcatcattctaggcactggagaca

SEQ ID NO: 26082 - DNA, 453 bp, Homo sapiens
  chrX.fa.O7frz.63978635
  Located on chromosome X
  Distance between a terminus base of telomere on chromosomal short arm and 5'-terminus of this base sequence : 63819175
  Distance between 3'-terminus of neighbour sequence of sequence listing upward to telomere on chrosomal short arm and 5'-terminus of this base sequence : 155601
taaatattagtttcatctgccaacccctatcttactttcctcaacatcataaaggaaatattgaaaaacccatagctaacatcatactcaatggtaaaagtttggaagcttttcctttaagatcaggaataaggaagaaatgcccacttttaccacttctatttaacataatattggaagttctggccagagcaattaggcaaaaataaataaataaataaataaataaaaggcatcctcattggaaaggaaggattaaaattatctctttcacagacaacatgatcctgtatgtagaaaacactaaagattccagaaaagaaaactgttagaactaataaataaattcagccaagttgcagaacacaaaatcaacacacaaaatattagttgcattttgtcaactaggaaggaacaatccaaaaaggatattaagaagtaattccaactgga

SEQ ID NO: 26083 - DNA, 465 bp, Homo sapiens
  chrX.fa.O7frz.63798103
  Located on chromosome X
  Distance between a terminus base of telomere on chromosomal short arm and 5'-terminus of this base sequence : 63949193
  Distance between 3'-terminus of neighbour sequence of sequence listing upward to telomere on chrosomal short arm and 5'-terminus of this base sequence : 129565
tgttctttagtaccagcatgattgaatgagttaaattatatcatctaagaacccaatctcagatcttgaattaaaactggtggctcccaactcctagtccaatgctttttttaaaacaaaacaaaacaaaacaaattagtgtgtgtgtgtgtgtgtgtgtctgtgtgtgtgtatgaattgtgtgtttcacacctttcccagctgcctaatggtgtgagttgttgctggagagaaggtgaagagaaagggggcaactaccaaagggttgaagttactccctgccatatgttgctcttccacactatataagagatgccaggatgccaggtatcatcaagttaatcaatgaatggcagagcaaaactggaagctgataagtactgccaaagaatggagaaaactatcaatgaaaaaactcaggcttgtttttgatttctggacctgtactggttttcagtcatacat

SEQ ID NO: 26084 - DNA, 132 bp, Homo sapiens
  chrX.fa.O7frz.63291114
  Located on chromosome X
  Distance between a terminus base of telomere on chromosomal short arm and 5'-terminus of this base sequence : 64445444
  Distance between 3'-terminus of neighbour sequence of sequence listing upward to telomere on chrosomal short arm and 5'-terminus of this base sequence : 495786
atacatgaaacttcacatgtgataaaagtgcatagaactacacacacacacacacacacacacacatatacagatgaggtcatataaaacatgaagtctgactaagctctgtagactgtatcaatgtcggtg

SEQ ID NO: 26085 - DNA, 244 bp, Homo sapiens
  chrX.fa.O7frz.63120314
  Located on chromosome X
  Distance between a terminus base of telomere on chromosomal short arm and 5'-terminus of this base sequence : 64541444
  Distance between 3'-terminus of neighbour sequence of sequence listing upward to telomere on chrosomal short arm and 5'-terminus of this base sequence : 95868
tccaacagtaatgaaattagtgtcttgaagaaatatctgcacccccatgttcactgcagtattattagtaatagccaagacgtgggatcgacctaagtgtccactggcagatgaatgaataaagaaagtgtcacacacacacacacacacacacgaatattattcagccataaaaaggagatcctgccatttgcaataacatggatgaaccaggaggatactatgctaagtgaaataagctaga

SEQ ID NO: 26086 - DNA, 179 bp, Homo sapiens
  DXS983
  Located on chromosome X
  Distance between a terminus base of telomere on chromosomal short arm and 5'-terminus of this base sequence : 64574335
  Distance between 3'-terminus of neighbour sequence of sequence listing upward to telomere on chrosomal short arm and 5'-terminus of this base sequence : 32647
cacactgcattaaatcctcgatctttgctgcccctaccttggctagttatacacacacacacacacacacacacacacacacacacacacaccctacagcatgaattcatccaattgttttgcacaaaaacatgtttaaaatgaaaaggcagaaagccagaggcaggtagggtaacttg

SEQ ID NO: 26087 - DNA, 169 bp, Homo sapiens
  DXS8107
  Located on chromosome X
  Distance between a terminus base of telomere on chromosomal short arm and 5'-terminus of this base sequence : 64847491
  Distance between 3'-terminus of neighbour sequence of sequence listing upward to telomere on chrosomal short arm and 5'-terminus of this base sequence : 272977
caagttgtctgttggggtgtctgtctgtctgtctgtgtgtgtgtgtgtgtgtgtgtgtgtgtaaggtcagttcctgaaacattgggaaggtttctatgtaatacgttcttcaccttttgaagtacagtgacatatatatacataaatatatgcaaggcagtgccgaatc

SEQ ID NO: 26088 - DNA, 107 bp, Homo sapiens
  DXS8052
  Located on chromosome X
  Distance between a terminus base of telomere on chromosomal short arm and 5'-terminus of this base sequence : 64939125
  Distance between 3'-terminus of neighbour sequence of sequence listing upward to telomere on chrosomal short arm and 5'-terminus of this base sequence : 91465
ttggaacaggctgtggggcaatttatgcacaagagcattttaacacacacacacacacacacacacacacacacacacacacgcacacgcacacacacagtaatcac

SEQ ID NO: 26089 - DNA, 379 bp, Homo sapiens
  chrX.fa.O7frz.65968085
  Located on chromosome X
  Distance between a terminus base of telomere on chromosomal short arm and 5'-terminus of this base sequence : 65669184
  Distance between 3'-terminus of neighbour sequence of sequence listing upward to telomere on chrosomal short arm and 5'-terminus of this base sequence : 729952
tacctgccattggtcatacctttcaaagcatgatgggtctacccttggccaacacatttttagcaaaagtggaaagctagagagggtctggagaagagcataaataatgccacgggactaggtgctgtgtgtgtgtgcatgcgtgtgtgtgtgtgtgtgtgtgtgtgtgtgagatctagaaaggaaaaagctgatgaggtaacattcaatggttgtagggcacctaccatgtgaaaagtgtgctatacccatcttcaaaatttaactcctaaataaggacagagctgatgacctgttctccgtttcttttgagaatgatagaggggaaaatgagatcaagtgaaatacaaggaataactttgctatgaataggaaatga

SEQ ID NO: 26090 - DNA, 239 bp, Homo sapiens
  DXS8030
  Located on chromosome X
  Distance between a terminus base of telomere on chromosomal short arm and 5'-terminus of this base sequence : 65889901
  Distance between 3'-terminus of neighbour sequence of sequence listing upward to telomere on chrosomal short arm and 5'-terminus of this base sequence : 220338
cctttgaaatccctgaatgatttgtgtgtgtgtgtgtgtgtgtgtgtgtgtgtgtgtgtgtgtatatttatatttgtgtgtggctatttgtctcgtagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaa

SEQ ID NO: 26091 - DNA, 275 bp, Homo sapiens
  DXS8101
  Located on chromosome X
  Distance between a terminus base of telomere on chromosomal short arm and 5'-terminus of this base sequence : 66040255
  Distance between 3'-terminus of neighbour sequence of sequence listing upward to telomere on chrosomal short arm and 5'-terminus of this base sequence : 150115
ctgcccgatagtgaaatgaagtcagagtttctaaatatgcctgacagcctaagggtaggtttgctcataggtagtcatttgctaaatatgtttttttccactctggaaaattttcggtccttgatacagaagtgattcatcataaccttgaataacatagttggacaaatatttgagatgtgtgtgtgtgtgtgtgtgtgtgtgtgtgtgtatatatatatatatatatatatatatttccttttttttttgagacaagagtctctgtcgcccag

SEQ ID NO: 26092 - DNA, 424 bp, Homo sapiens
  chrX.fa.O7frz.65499793
  Located on chromosome X
  Distance between a terminus base of telomere on chromosomal short arm and 5'-terminus of this base sequence : 66144349
  Distance between 3'-terminus of neighbour sequence of sequence listing upward to telomere on chrosomal short arm and 5'-terminus of this base sequence : 103819
ccacctcataaagatatcttcactcccatgtccattgcagcattattcacaatagccaagatatggaaacaacctaagttgattttctttatctattttcacacacacacacacacacacacaaacacacacacacacgaatattattcagccttaaaaaaggagatcctgccatttgccacatcatggatagacctggagtacattatactaagtgaagtaaaccagacacagaaataaaaatatagcatgagctcacttacatgtagaatcttaaaaaaggtcaaatatatatatagagagaatacaatagtagttaccaggggtagggtagggagaaagggaggaaatgggggaatgtaggcaaaagattttaaagtagcagttacataagatgaacaagtctagaggcctaaggtacaac

SEQ ID NO: 26093 - DNA, 270 bp, Homo sapiens
  chrX.fa.O7frz.65425385
  Located on chromosome X
  Distance between a terminus base of telomere on chromosomal short arm and 5'-terminus of this base sequence : 66209144
  Distance between 3'-terminus of neighbour sequence of sequence listing upward to telomere on chrosomal short arm and 5'-terminus of this base sequence : 64371
ccttctaggtgttagacttgaacaacacctcttgtgaaagggtagatcccagccctgctttagcgaattcgatccttcatggatccttcaccactgcttccactccatgaatcagtccattctcgctcaagggacagcacccacgattaatttgattcccaagcaggtgctagcaggggcatgctcacgcgtgcacatgtgcgcgcgcgcgcgcgcgcacacacacacacacacacacacacacacacgctaaccttgaatggtatctgc

SEQ ID NO: 26094 - DNA, 443 bp, Homo sapiens
  chrX.fa.O7frz.66306614
  Located on chromosome X
  Distance between a terminus base of telomere on chromosomal short arm and 5'-terminus of this base sequence : 66416962
  Distance between 3'-terminus of neighbour sequence of sequence listing upward to telomere on chrosomal short arm and 5'-terminus of this base sequence : 207548
ggtcagcctataaacttacagagtggtctccagaaacatatactcaatacgtgtgtagaaaaaactttaaaagcacaagtttttattcaagaatatttacagcagaattgttgataatagtggaaaatgaaaaggaacctaaatgtctatggtaagggtgtgtcccttggtaccttgacacacacacacacacacacacacacacacacacaatcctgactttgaaaactcttattcataggaaaatattcataacaaaatatgaaataaaaaatgctgggtacaaagttgcataaatatgatgccaagctgcaaagggcacaaagggaacaaaattaaatactcactatgtttccaatcatgtatgaatatgtacagaaagcgacagtctggaaaataccaaaatgataacagtgccagtagagtggtaggattatgagtga

SEQ ID NO: 26095 - DNA, 265 bp, Homo sapiens
  AL133500.3_77613
  Located on chromosome X
  Distance between a terminus base of telomere on chromosomal short arm and 5'-terminus of this base sequence : 66495224
  Distance between 3'-terminus of neighbour sequence of sequence listing upward to telomere on chrosomal short arm and 5'-terminus of this base sequence : 77819
atggatctggaatctagaggaccacaaaggcctcctaactggcctttctagttctcttggtatctctctgtaatcctttgtctatacaaatgccacagtgattacacacacacacacacacacacacacacacacacacacacacacacactgctatggaatgaattgtgtgtcttcctaccccaattcacacgttgaagccctaacccctaatgtggctgcatttggagcaaggaagtaattaaggttaaataaggtcatggtg

SEQ ID NO: 26096 - DNA, 199 bp, Homo sapiens
  AL133500.3_156195
  Located on chromosome X
  Distance between a terminus base of telomere on chromosomal short arm and 5'-terminus of this base sequence : 66573796
  Distance between 3'-terminus of neighbour sequence of sequence listing upward to telomere on chrosomal short arm and 5'-terminus of this base sequence : 78307
tgtagctataaaggcgtagcatgagggaaccttgtggtgatggtactgatctgtatcttgattgtggttgtagttatgcaaggctacatgtgtgataaaattgcatagagctacacacacacacacacacacacacacacacacacgtgcatatatagctggtgaaatctaaataagctctatggcttgtaccaatgtc

SEQ ID NO: 26097 - DNA, 341 bp, Homo sapiens
  chrX.fa.O7frz.66547286
  Located on chromosome X
  Distance between a terminus base of telomere on chromosomal short arm and 5'-terminus of this base sequence : 66657610
  Distance between 3'-terminus of neighbour sequence of sequence listing upward to telomere on chrosomal short arm and 5'-terminus of this base sequence : 83615
tgctaatgaactgaccacttatagcagtcccagctcaaagaacccactcctttaaataccagaatctaaccccatccatctgttcagtcattttgtctctcatggatcgtcaggtatatcagttagcaattcaatgcaaatctgtcagaaagtaaaattacaaatcttataaaaagatgctggaaatcttgaagtcagcgcacacacacacacacacacacacacacacacacaaaactgatgaggatctggtagaacagtccacaattgaagaggagaaaaataaatatgaataatgattttaaaagtggttcaaaacagaatgatttgaataccaagtg

SEQ ID NO: 26098 - DNA, 414 bp, Homo sapiens
  chrX.fa.O7frz.66714908
  Located on chromosome X
  Distance between a terminus base of telomere on chromosomal short arm and 5'-terminus of this base sequence : 66825376
  Distance between 3'-terminus of neighbour sequence of sequence listing upward to telomere on chrosomal short arm and 5'-terminus of this base sequence : 167425
taggcataaatttggcttaatattttcctaaatggttagccagttatgctaacaccatttatttatttatttatttatttatttatttatttatttatttattttttgagacggagtctcgctctgtcacccaggctggagtgcagtggcgcgatctcagctcactgcaagctccgcctcccgggttcacgccattctcctgcctcagtctcccgaatagctgggactacaggcaccggacaccacgcccggctattttttgtatttttagtggagacggggtttcactgtgttagccaggatggtctcaatctcctgacctcgcgatccgcccgcctcggcctcccaaagtgctgggattacaggcctgagccaccgtgcccggccgctaacaccatttattgagtaattctt

SEQ ID NO: 26099 - DNA, 375 bp, Homo sapiens
  chrX.fa.O7frz.66836359
  Located on chromosome X
  Distance between a terminus base of telomere on chromosomal short arm and 5'-terminus of this base sequence : 66965715
  Distance between 3'-terminus of neighbour sequence of sequence listing upward to telomere on chrosomal short arm and 5'-terminus of this base sequence : 139925
tttagtaccagatctaatagcgacagcaaaattgggcttctttgggttgttccggattttaaaaggaatgctgccagcatttccatattaatattgtttccttgtgttttccttaacttttcgtttccttttctttgctttcctttcccttcccttcccttcccttcccttcccttcccttcctttcctttccgttctttcctttcctccttccttccttcctttcttcttcctctctccctacaccacaccacctccacccccgaatgtcttaggccttttgtccttctgcataaattagcatgcaatttcaagtttcccaaaaactcggttgtaacagatttggactgcattttcactgaatctatggatcag

SEQ ID NO: 26100 - DNA, 274 bp, Homo sapiens
  chrX.fa.O7frz.67154843
  Located on chromosome X
  Distance between a terminus base of telomere on chromosomal short arm and 5'-terminus of this base sequence : 67163540
  Distance between 3'-terminus of neighbour sequence of sequence listing upward to telomere on chrosomal short arm and 5'-terminus of this base sequence : 197450
tcagaaatgattactggtgactttaattttcttctggtaacttgtctgctttgtgatttttttttcttgcaatgacgctgaattacttttctgacaacagggaaaaggacaggaagagggcacaggggaatggggtcataagcagtgtttgtttccagcaaaactaccgaggacagcgaaacaccctttgtagcccgccaagctggccaagacacacacacacacacacacacacacacgcacgcacacacacgatcaattacagtgaccagga

SEQ ID NO: 26101 - DNA, 432 bp, Homo sapiens
  chrX.fa.O7frz.67555727
  Located on chromosome X
  Distance between a terminus base of telomere on chromosomal short arm and 5'-terminus of this base sequence : 67382585
  Distance between 3'-terminus of neighbour sequence of sequence listing upward to telomere on chrosomal short arm and 5'-terminus of this base sequence : 218771
cctgagttacttcaataagaacaatgatctccaattccatccaggttgccattattttattctttttcatggctgagtagtattccaaggcatgcatatatatatatatatatatatatatatatatacatatatatatcacatcattttctttatccactcattgattgatgggcattttgggttagttctaagttttttaaattttgaattctcctgttataaaaatgtgtgtgcagatatctttttgttataatgacttattttcctctggatagatacccaggagtgggattgctggatcaaatgatacatctacttttagttctttaaagaatctccacactgtttttcatagtggttgtactagtttacattcccaccaacagtgtaaaagtgttttcttttcactgcatctacaccaacatctat

SEQ ID NO: 26102 - DNA, 168 bp, Homo sapiens
  chrX.fa.O7frz.67408264
  Located on chromosome X
  Distance between a terminus base of telomere on chromosomal short arm and 5'-terminus of this base sequence : 67530070
  Distance between 3'-terminus of neighbour sequence of sequence listing upward to telomere on chrosomal short arm and 5'-terminus of this base sequence : 147053
ttctagaaacatacaacctaccacgactgaataaaaagaaaagcctaaacagaagaaaaagaaatgagattacattagtaataaaaaaactctcaacaacaacaacaacaacaacaaaaagctcaggaccagatggccctaaaagtgaattctaccaaacatttaaag

SEQ ID NO: 26103 - DNA, 273 bp, Homo sapiens
  DXS8070
  Located on chromosome X
  Distance between a terminus base of telomere on chromosomal short arm and 5'-terminus of this base sequence : 67654967
  Distance between 3'-terminus of neighbour sequence of sequence listing upward to telomere on chrosomal short arm and 5'-terminus of this base sequence : 124729
gtccaaaatagaaatagcaaccctgtgtgtgtgtgtgtgtgtgcttatatataagagaagtgaattacagctataatagaaatttcagaaagaaagaatagaaaatattttgttattataatgtacctgtaccagctgtgaagcagtataatattatttaaaaatgaacttggattagttgtaaatttatattgcaaactaaagagacacctaaataaagtagaaaaaaatacataattgatgttttagtctgttctcgtgctgctagtaaag

SEQ ID NO: 26104 - DNA, 205 bp, Homo sapiens
  DISO7_11725110
  Located on chromosome X
  Distance between a terminus base of telomere on chromosomal short arm and 5'-terminus of this base sequence : 67782126
  Distance between 3'-terminus of neighbour sequence of sequence listing upward to telomere on chrosomal short arm and 5'-terminus of this base sequence : 126886
accatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatc

SEQ ID NO: 26105 - DNA, 220 bp, Homo sapiens
  DISO7_10004667
  Located on chromosome X
  Distance between a terminus base of telomere on chromosomal short arm and 5'-terminus of this base sequence : 67935862
  Distance between 3'-terminus of neighbour sequence of sequence listing upward to telomere on chrosomal short arm and 5'-terminus of this base sequence : 153531
catgggttcagtgatactcagattcattcattctctctagatagagatagatagatagatagatagatagatagatagatagatagatgatagatagatgatagattatatagagagagatagattatatatagagagatagatagattatatatagatacatagattatatatatatatattttcccatgagcaaaggggaaaccacctcttatctcct

SEQ ID NO: 26106 - DNA, 209 bp, Homo sapiens
  U80459.1_1043
  Located on chromosome X
  Distance between a terminus base of telomere on chromosomal short arm and 5'-terminus of this base sequence : 68107566
  Distance between 3'-terminus of neighbour sequence of sequence listing upward to telomere on chrosomal short arm and 5'-terminus of this base sequence : 171484
tcaaagagatacctgcactcacatgtttattgcagcacattatcacaatattatttctttcaaaccaggagcatggaacgtctttttatttgtgtatgtgtgtgtgtgtgtgtgtgtgtgtgtgtgtactcttcaatttctttcatcagggttttgtagtttttattgtaaagttctttcacctccttggttgaatttattcctagcta

SEQ ID NO: 26107 - DNA, 260 bp, Homo sapiens
  Z67111
  Located on chromosome X
  Distance between a terminus base of telomere on chromosomal short arm and 5'-terminus of this base sequence : 68261283
  Distance between 3'-terminus of neighbour sequence of sequence listing upward to telomere on chrosomal short arm and 5'-terminus of this base sequence : 153508
gggttggacacttaggcattaggctgtcctccaggataaagaggtatcccataaaaggtacattgtaaacatccaggacaacctcccctggagtcttgtcagcgcagagcaaggatttgtggccactctccagagagagaccccaagaccaaattttatatatatatgtgtgtgtgtgtgtgtgtgtgtgtgtgtatgtgtgtgtatatatatatacgtgtatatatatagcaattgatgcatcaagcagagtggtcatg

SEQ ID NO: 26108 - DNA, 137 bp, Homo sapiens
  DXS8066
  Located on chromosome X
  Distance between a terminus base of telomere on chromosomal short arm and 5'-terminus of this base sequence : 68450083
  Distance between 3'-terminus of neighbour sequence of sequence listing upward to telomere on chrosomal short arm and 5'-terminus of this base sequence : 188540
acacagccatgtcctagcatagggatgaaactagaaaacaagaatagaaatgcaaaacacgcgcgcatgcgcacacacacacacacacacacacacacacacacacacacaccaaatcaggtcactaacaagtttgg

SEQ ID NO: 26109 - DNA, 137 bp, Homo sapiens
  DXS8060
  Located on chromosome X
  Distance between a terminus base of telomere on chromosomal short arm and 5'-terminus of this base sequence : 68450084
  Distance between 3'-terminus of neighbour sequence of sequence listing upward to telomere on chrosomal short arm and 5'-terminus of this base sequence : -136
cacagccatgtcctagcatagggatgaaactagaaaacaagaatagaaatgcaaaacacgcgcgcatgcgcacacacacacacacacacacacacacacacacacacacaccaaatcaggtcactaacaagtttggt

SEQ ID NO: 26110 - DNA, 416 bp, Homo sapiens
  chrX.fa.O7frz.68972009
  Located on chromosome X
  Distance between a terminus base of telomere on chromosomal short arm and 5'-terminus of this base sequence : 68695496
  Distance between 3'-terminus of neighbour sequence of sequence listing upward to telomere on chrosomal short arm and 5'-terminus of this base sequence : 245275
cctagacagttgtcagctaaatagccctacatttgcctattaaaggaaacaactcttaggtgaaaaatcagcaaaatttacatctcaaggtaccaagagagaaagtctggtgtgctagagggaaattaaaacagatttaatttgccaattaaacatgaaattatagaagtctattataaaggtcacacacatacacacacacacacacacacacacacacacacacacacgcaaagatcctatggcttttacttcagaactttagccatgagataaatacaaattcactggcttgcaaaaaaaaaaatagttagatccaagtagtggttgttatctcagtagaaaggtaacagcagatttaaagcaggcagaaaagaaaatagagaaaaagagaacttaggaactttagagtttgc

SEQ ID NO: 26111 - DNA, 338 bp, Homo sapiens
  chrX.fa.O7frz.69272899
  Located on chromosome X
  Distance between a terminus base of telomere on chromosomal short arm and 5'-terminus of this base sequence : 68992322
  Distance between 3'-terminus of neighbour sequence of sequence listing upward to telomere on chrosomal short arm and 5'-terminus of this base sequence : 296410
ctattactattctgaatccagcacattcccccacacacaatcaccacacacctagccaaatgagcacatgacattcctaaactaaggacactctttaacctagcctccacttacaaactcaaaaaggcacatattgactaaatgattctgacaggagaaggggaaaatatgtagaatttagaggccaaagagaagtagataactgaaaacaaggttgtacacacacacacacacacacacgtgagcacatgtgcatgtgcgtgtgtgcacacacacacacacacccctatcactagtccctcccatgccctaaattacatcaactgttttcagttagg

SEQ ID NO: 26112 - DNA, 275 bp, Homo sapiens
  DXS8092
  Located on chromosome X
  Distance between a terminus base of telomere on chromosomal short arm and 5'-terminus of this base sequence : 69108854
  Distance between 3'-terminus of neighbour sequence of sequence listing upward to telomere on chrosomal short arm and 5'-terminus of this base sequence : 116194
caccctatggcctagcaaatacacgttcactgaggcttcactgcctatttctaaacgttaatcaactgcagaaatcattaagaagaaaatcatttggcaggggaaaaggtttctttatagaggaatttgttcaattatttcaattcaaaaccttgaacattcccagtcctggagtcctcactgattctcaggcatacacacacacacacacacacacacacacacacacacacacacacacacacacacacacacagacctgagcaagtttgggt

SEQ ID NO: 26113 - DNA, 155 bp, Homo sapiens
  DXS1221
  Located on chromosome X
  Distance between a terminus base of telomere on chromosomal short arm and 5'-terminus of this base sequence : 69252730
  Distance between 3'-terminus of neighbour sequence of sequence listing upward to telomere on chrosomal short arm and 5'-terminus of this base sequence : 143601
cttgtgaatttatttcagttattgtaccttttcaactccagaatttccatttgtagacacacacacacacacacacacacacacacacacacacaaattctctttgttgacaaatcttttgcctgctacaaaagtcatctgggccacttctaagg

SEQ ID NO: 26114 - DNA, 244 bp, Homo sapiens
  Z24232.1_79
  Located on chromosome X
  Distance between a terminus base of telomere on chromosomal short arm and 5'-terminus of this base sequence : 69252766
  Distance between 3'-terminus of neighbour sequence of sequence listing upward to telomere on chrosomal short arm and 5'-terminus of this base sequence : -119
tccagaatttccatttgtagacacacacacacacacacacacacacacacacacacacaaattctctttgttgacaaatcttttgcctgctacaaaagtcatctgggccacttctaaggcagtgttttatcacctgctttttccccgtgtatgggtcacactttcctgtttctttccatgtcttgtaattttttcttgtaaattagacattttagatagtatcttacagcaatcctggatattg

SEQ ID NO: 26115 - DNA, 296 bp, Homo sapiens
  AL137013.4_55070
  Located on chromosome X
  Distance between a terminus base of telomere on chromosomal short arm and 5'-terminus of this base sequence : 69580228
  Distance between 3'-terminus of neighbour sequence of sequence listing upward to telomere on chrosomal short arm and 5'-terminus of this base sequence : 327218
taccatatgacttagccatcctactccttggtacttacccaagcacaggttcacacaaagtcttggtcacaaatgtttatagcagctttatgtgtatgagcaaaaaactagaaacacttctgatatccattaatagatggaaaagtaaattttagtgtgtgtgtgtgtgtgtgtgtgtgtgtgtatatatatataatatatgtatatatccagtggaatactactcatcaataaaaagaaatcaattatccttacacacagcaacaaaggtgaatctcaattatgttgagtggaag

SEQ ID NO: 26116 - DNA, 470 bp, Homo sapiens
  chrX.fa.O7frz.70069095
  Located on chromosome X
  Distance between a terminus base of telomere on chromosomal short arm and 5'-terminus of this base sequence : 69654598
  Distance between 3'-terminus of neighbour sequence of sequence listing upward to telomere on chrosomal short arm and 5'-terminus of this base sequence : 74074
ttagcattcgaatctagactgtgtaaagcagactgtcctccccaatgcaggtgggcctcatccaatcctttgaggacctgaacagaacaaaaatgtggaggatgagaaaatttgctgttgttgcctgactgcatgagctgagacatcagttttctgccattagactggggcttacaccatcagcactactggttctcaaaccgtttaactcagactataattacattaccagctttcctgattctccagcttgcagatggcagaccgtgggacttctcaggttccataatcatttgctgattcctcataatctctctctctctctatacacacacacacacacacacacacacacacacacacacacacacacacacacaattctattggctctatttatctggagaacgctgactaacacacatggctaaatccttatcatttaagtcttcaaatagtatttcctcaga

SEQ ID NO: 26117 - DNA, 445 bp, Homo sapiens
  chrX.fa.O7frz.70191227
  Located on chromosome X
  Distance between a terminus base of telomere on chromosomal short arm and 5'-terminus of this base sequence : 69776772
  Distance between 3'-terminus of neighbour sequence of sequence listing upward to telomere on chrosomal short arm and 5'-terminus of this base sequence : 121704
ttcacttactagccatgttaagagttttgaatgggctgcagtggctttttaaggtagtgaagaagaaccacgtacctgaagtttaggctactctttttatgacatagaacactctttgaacattgggactagctgctagtagttagttgaataagcatgttatgtgagaagtttccaagattatccccgtgttttgtgatttgctagaaagacacacagggctctgcatatagtcttttataaatctttttattatttaaaaaaagtggggacatagtgtgtatttatatatatatatatatatatatatgcacacacacacacatatatgtatgcatgtatatggtacatgagatgttttgatacaggcatgcaatgtgaagtaagcacatcatggagaatgggctatccatttactcaagcatttgtcgtttgaattacaaac

SEQ ID NO: 26118 - DNA, 359 bp, Homo sapiens
  chrX.fa.O7frz.70296539
  Located on chromosome X
  Distance between a terminus base of telomere on chromosomal short arm and 5'-terminus of this base sequence : 69865972
  Distance between 3'-terminus of neighbour sequence of sequence listing upward to telomere on chrosomal short arm and 5'-terminus of this base sequence : 88755
cttgtcagatgcatagtttgtcaatattttctcccattctgtaggttgtctggtttttattgattttctttctttctttctttctttctttctttctttctttctttctttctttctttctttctttctttttaactgttcggaagctcttttatttatttaggccctacttgtcaatttgtttctattgcaattgcttttgggaacttggccataaattcttcgccaaagccaacgttaagaagggtattccctaggtttgcttctggaattttttgtttgagatcttacatttaaatatttaatccatcttcagttaatttttgtatatggtgaaaggtaaggatctactttcattc

SEQ ID NO: 26119 - DNA, 318 bp, Homo sapiens
  chrX.fa.O7frz.70415670
  Located on chromosome X
  Distance between a terminus base of telomere on chromosomal short arm and 5'-terminus of this base sequence : 69966311
  Distance between 3'-terminus of neighbour sequence of sequence listing upward to telomere on chrosomal short arm and 5'-terminus of this base sequence : 99980
tgaatcaaacttgtacctcaatcaaaccatcaaggtcatgaataaaagaaaagaaaagaaaagaaaagaaaagaaaagaaacccagccaaaggtcagcaacctcaaagattgtaggtacataaacccacaaatatgagaaagaatcagtgcaagaacacaaaaaactcaaaaagccagagtgccttctttcctacaaatgaccatatcacctgtccagcaagggttcacaaccaggctgaggctgagatggctgaaatgacagaagtagatttcagaacatgaacaggaatgaagttcattgagctacaagagtacat

SEQ ID NO: 26120 - DNA, 273 bp, Homo sapiens
  chrX.fa.O7frz.70600508
  Located on chromosome X
  Distance between a terminus base of telomere on chromosomal short arm and 5'-terminus of this base sequence : 70462324
  Distance between 3'-terminus of neighbour sequence of sequence listing upward to telomere on chrosomal short arm and 5'-terminus of this base sequence : 495695
aaagtagatctgccatttgatctagcaattccactactgagcatctacctagaggaaaagaagtcattgtatgaaaaagatacttgcaaacatatgtttatagcagcacaatttgcaatttcaaaaacatggaaccagcccattaatcaacaagtggataaagaaattgtgatatatatatatatatatatatatatatatatatatatacacacatatccccaaaaaccccatccaagggtcagcagcctcaaagattgaaactagacaaac

SEQ ID NO: 26121 - DNA, 280 bp, Homo sapiens
  AC004677.1_110573
  Located on chromosome X
  Distance between a terminus base of telomere on chromosomal short arm and 5'-terminus of this base sequence : 70540314
  Distance between 3'-terminus of neighbour sequence of sequence listing upward to telomere on chrosomal short arm and 5'-terminus of this base sequence : 77717
gtagatgtatggatttgttctgagttctctattttgtttcatttgtctatgtgtctgtttttatgccagtactctactgttttgatgacaatcgctgtgtagtttaaagtcttgtaatgtgattgcttccattttggtttgttgttgttgttgttgttgttgttgttgctcaattttgggtcttttgtagtttcatataaatttaaatttttttttaatttttgtgaagaatgttgttggtatattgacagagattgtattgaatatgtagatcgctttg

SEQ ID NO: 26122 - DNA, 260 bp, Homo sapiens
  chrX.fa.O7frz.71716321
  Located on chromosome X
  Distance between a terminus base of telomere on chromosomal short arm and 5'-terminus of this base sequence : 70803390
  Distance between 3'-terminus of neighbour sequence of sequence listing upward to telomere on chrosomal short arm and 5'-terminus of this base sequence : 262796
gcctacttgatagtggtacattagctttttaatgtgctgctggattcggtttgctagtattttgttgagtattttagcatccatgtttatcaagggtattggcctctaatttgtgtgttgtgtgtgtgtgtgtgtgtgtgtgtgtgtgtgtggtgtgtctgccaggttttgatatcaggatgatgctggcctcatagaatgagttggaaaggagtctcccttcctcgattttttgacttagtttccgtaggaatagtacc

SEQ ID NO: 26123 - DNA, 237 bp, Homo sapiens
  chrX.fa.O7frz.71572910
  Located on chromosome X
  Distance between a terminus base of telomere on chromosomal short arm and 5'-terminus of this base sequence : 70889076
  Distance between 3'-terminus of neighbour sequence of sequence listing upward to telomere on chrosomal short arm and 5'-terminus of this base sequence : 85426
tagtttatttcactcggcataatatcctccaggtttacgtatattgtagcaaatgatggaatttccttcttttttaaggctgtgtagtattccattatatgtatgtgcatatatatatatatatatatatatatatacttgcacatatttatatacacatatacatgtctatagattacatttttaaaatcattcttctgttgatggaaacttaagttgcttccatttcttagctat

SEQ ID NO: 26124 - DNA, 452 bp, Homo sapiens
  Z84470.1_74257
  Located on chromosome X
  Distance between a terminus base of telomere on chromosomal short arm and 5'-terminus of this base sequence : 71303543
  Distance between 3'-terminus of neighbour sequence of sequence listing upward to telomere on chrosomal short arm and 5'-terminus of this base sequence : 414230
cacagaggtatcactaccgaataattcttattaaataaatctctaggagcattattggatataaatgcgtaaatttttctaagagacctataattcttcatttgaaagggttttcagaagtcacactatccatttcctacctccaagcagagctgcatccaactttgatgactgcaatcatgtgtagtatcactgatctaagattatatatatagagagtatagtatcactgatatatagtattgtatcactgatctaagattatatatatatatatatatatatatagagagagagagagagagagagagagagaaagagagagagagagatttaatccacaccataattctaacagatagatgttattatctctactttatagatgaggaaaataaggggtagggagattaactgacatccataattaaaaaggtagtgagttgctgagc

SEQ ID NO: 26125 - DNA, 416 bp, Homo sapiens
  AL139192.7_83599
  Located on chromosome X
  Distance between a terminus base of telomere on chromosomal short arm and 5'-terminus of this base sequence : 71389249
  Distance between 3'-terminus of neighbour sequence of sequence listing upward to telomere on chrosomal short arm and 5'-terminus of this base sequence : 85254
tgatttgcatatgttgaatcagtcttggatcacagggatagcctagttgattatgatggattaccttttagatgcgttgatggattcagcctgctattactttgttgaggatttttgcacatacattcatcagagatattggccagaatttttctctctgtgtgtgtgtgtgtgtgtgtgtgtgtgtgtgtgtgtgtgtgtgtgtgtgtctgtgtctgctaggttttagtatcaggatgatgctggcctcacagaatgagttaggaatgaatccctcctcttccattattttgaatagttttgatagaaattctacaagctcttctttataaatctggtagaattcagctgtgaatctctctagcattgggctttttctggttggtaagctactttatactgattcaatttcggaa

SEQ ID NO: 26126 - DNA, 448 bp, Homo sapiens
  chrX.fa.O7frz.74343211
  Located on chromosome X
  Distance between a terminus base of telomere on chromosomal short arm and 5'-terminus of this base sequence : 71611912
  Distance between 3'-terminus of neighbour sequence of sequence listing upward to telomere on chrosomal short arm and 5'-terminus of this base sequence : 222247
taggtgttgaggtgatctgtacagcaaaccaccatggcacacgtttacccatgtaaatctgcacatcttgcacatgtgcccccgaacttaaaagctgaaggataaaaaaggaaatgtgtgtatacacacacaaacacacacacacacacacacacacacacacacacacaccatggaatactactcagacataaaaataaatgaaatcatgtcttttgccacaacattgatggaactagagaggccattatcttaaggaaataactcagaaatacaaagtcaaatactacatattctcacttataagtgggggctaaacaatgtgcacacagggacaaacagaatggaataatagacactagagactccaaaaggtgggagggtaggagggagatgagggataagaaattacgtattgtgtacaattaacactattcaggtgatggtt

SEQ ID NO: 26127 - DNA, 320 bp, Homo sapiens
  chrX.fa.O7frz.74221943
  Located on chromosome X
  Distance between a terminus base of telomere on chromosomal short arm and 5'-terminus of this base sequence : 71733259
  Distance between 3'-terminus of neighbour sequence of sequence listing upward to telomere on chrosomal short arm and 5'-terminus of this base sequence : 120899
cacttattgttagcagtttaccacatttgctttttttctttctctctctacacacacacacacacacacacacacacacacacacacacacaggcagacacaacttttcttacactgaaccatgtgatattaagcgcggatgacactttacccctaagcataaggatactgccctacataactaaataccattatcacatctgaaaaaaaaattactatcatctaatatgaaggcaatatttacaatttcaaattgtcactaaaataattttgtaacatttttctaatttaggagaaaattagagttcacatgttgcact

SEQ ID NO: 26128 - DNA, 410 bp, Homo sapiens
  chrX.fa.O7frz.74106559
  Located on chromosome X
  Distance between a terminus base of telomere on chromosomal short arm and 5'-terminus of this base sequence : 71848506
  Distance between 3'-terminus of neighbour sequence of sequence listing upward to telomere on chrosomal short arm and 5'-terminus of this base sequence : 114927
atggtattgtatcaatgctaatctctcttttattttaagagatgggggtctcactctgtcattcacactagactgcagtggcatgatcatagttcatggcagcctggaacttctaggctcaagtgatcctcctgactctagctttctgagtagctgggactccaggcatgctccacaccggctaatttagtacttttgtttgtttgtttgtttgtttgtttgtttgttttgtagagacagggtctatgttgagaagactggtcttgaattcctggcctcaaacaatcctcccacctcagcctcccaaagtgctgggataacaggtgtgggaggccgcactcagccttaatgctaatttttaattttgctaactatactgggatcatgtaacagactattcctagtttcga

SEQ ID NO: 26129 - DNA, 432 bp, Homo sapiens
  chrX.fa.O7frz.73991576
  Located on chromosome X
  Distance between a terminus base of telomere on chromosomal short arm and 5'-terminus of this base sequence : 71965036
  Distance between 3'-terminus of neighbour sequence of sequence listing upward to telomere on chrosomal short arm and 5'-terminus of this base sequence : 116120
aacataggctttggaactagacagaccagtgtgggatcccagctcagtttcttagagctgtgcttctatgagcaagcccccaaccaccctcttgcttactgtcagttccctcatctatctatctatctatctatctatctatctatctatctatctggggtgggtagagatgagtctggctatgttgttcaggctgggctcaaactcttggcctcaagggatcctcccatcacctcaagggatcctcccacctcagcctcccaaagttctgggattataggcatgagccaccatgcctggccagtcccctcatctttaaagtccccttatctttcgaaggggttaatacttactctgcaatgttaatgtgtgtattatagataatgagtgtaaactatagtgcctggcatgtagaatgcattcgataaatat

SEQ ID NO: 26130 - DNA, 415 bp, Homo sapiens
  chrX.fa.O7frz.73872531
  Located on chromosome X
  Distance between a terminus base of telomere on chromosomal short arm and 5'-terminus of this base sequence : 72083451
  Distance between 3'-terminus of neighbour sequence of sequence listing upward to telomere on chrosomal short arm and 5'-terminus of this base sequence : 117983
tttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactca

SEQ ID NO: 26131 - DNA, 253 bp, Homo sapiens
  chrX.fa.O7frz.73744338
  Located on chromosome X
  Distance between a terminus base of telomere on chromosomal short arm and 5'-terminus of this base sequence : 72162117
  Distance between 3'-terminus of neighbour sequence of sequence listing upward to telomere on chrosomal short arm and 5'-terminus of this base sequence : 78251
gtttcagtgaaccaagatcatgccgtggcactccaacctgggcgacagagtgagactctgtctaaaacagaaaagaaaagaaagaaaagaaaagaaaagaaaagaaaagaaaaaagatatcaaggccaaactctgataggttatgccagttgtttacagagtgtggtctctggaaccagtaacatcaacatcacctgggaaattgatgaaaattcaagttcttgggctgctctccagacaagtgaatctacag

SEQ ID NO: 26132 - DNA, 340 bp, Homo sapiens
  chrX.fa.O7frz.73614678
  Located on chromosome X
  Distance between a terminus base of telomere on chromosomal short arm and 5'-terminus of this base sequence : 72291821
  Distance between 3'-terminus of neighbour sequence of sequence listing upward to telomere on chrosomal short arm and 5'-terminus of this base sequence : 129451
caatgagtggataaagaactgtggtaggtatatatatatatatatatatatatatatatatatatatatgatggaatactactcaaccgtaaaaaggaatgaattagcaccatttgctgtgacctggatgagactggaaactattattctaagtgaaattactcaggaatggaaaaccaaacattgtatgttctcactgttatgtgggaactaagctatgaggatgcaaaggcataagaatgatatgatggactttggggacttgggtggaaagagtgggaagggccaagggataaaagactacaaatatggtgcagtgtatatggcttaggtgatgtac

SEQ ID NO: 26133 - DNA, 232 bp, Homo sapiens
  Z67046
  Located on chromosome X
  Distance between a terminus base of telomere on chromosomal short arm and 5'-terminus of this base sequence : 72466247
  Distance between 3'-terminus of neighbour sequence of sequence listing upward to telomere on chrosomal short arm and 5'-terminus of this base sequence : 174086
ccagggtggatgtctaggatcagaggaaggagcacgtgtgtgtgtgtgtgtgtgtgtgtgtgtgtgtgtgtgtaagtgcaggtgctgttatgcaagaatctaaataatggtgtaaagtgatagtaaaatgtggatatatctagtagggtagaatctatttaaaagaagcctgaaaattcacagagtgcaggggaccatgactcatggatgggcattttacaaatcaccagag

SEQ ID NO: 26134 - DNA, 277 bp, Homo sapiens
  chrX.fa.O7frz.73416567
  Located on chromosome X
  Distance between a terminus base of telomere on chromosomal short arm and 5'-terminus of this base sequence : 72605038
  Distance between 3'-terminus of neighbour sequence of sequence listing upward to telomere on chrosomal short arm and 5'-terminus of this base sequence : 138559
ttctaaaggaagtttcaataacatgtgagatgtgggttcttgcttgctctctttctgtttcttgtgtaaaactggaactgaaaactatccttttgtattaattagccaggattttctctctctctctctctctctctctctctttctctctctctctctctctgtctctctctcttcttaaataaaggtgccaattactttgagagttatcagaatgtttgtgtgagtcttatattgtttaaaggtgacttcttagactctgttgaggaatctagat

SEQ ID NO: 26135 - DNA, 214 bp, Homo sapiens
  DISO7_10019387
  Located on chromosome X
  Distance between a terminus base of telomere on chromosomal short arm and 5'-terminus of this base sequence : 72753835
  Distance between 3'-terminus of neighbour sequence of sequence listing upward to telomere on chrosomal short arm and 5'-terminus of this base sequence : 148520
ggtgatattgtaatgtgcatcagaaattaaaagttgggtcacaattgaataatttaaaaaaattgttcactttcagaaaattatgtgggtaaaatatttccttccttccttccttccttccttccttccttccttccttccttccttcctttctctctctctctctctttctttctttctttctagaaaatttacttggtgagctcttgaaaca

SEQ ID NO: 26136 - DNA, 307 bp, Homo sapiens
  Z84816.1_89890
  Located on chromosome X
  Distance between a terminus base of telomere on chromosomal short arm and 5'-terminus of this base sequence : 73028799
  Distance between 3'-terminus of neighbour sequence of sequence listing upward to telomere on chrosomal short arm and 5'-terminus of this base sequence : 274750
cctagtcaggcctagctaaaagaacaatagctgtacttcttaaatatcagcaatttctcctagctgtaatacagtaatgagatttaaaaagatttttttaaaggagctcaatggttaaaagttagcttaattaaaagcttacatccaagatgtgtgtgtgtgtgtgtgtgtgtgtgtgtgtgtgtgtgtgtatgtttgtgtgtgtttgtatttaaaagggcttcctatttttcttttgttttttccttaggaccttgtctttttttgagcaaatgtttttttcttcttggttgactgaattctgttt

SEQ ID NO: 26137 - DNA, 451 bp, Homo sapiens
  chrX.fa.O7frz.76055150
  Located on chromosome X
  Distance between a terminus base of telomere on chromosomal short arm and 5'-terminus of this base sequence : 73152872
  Distance between 3'-terminus of neighbour sequence of sequence listing upward to telomere on chrosomal short arm and 5'-terminus of this base sequence : 123766
agatcatgtcactgcacctccagcctgggcgatagagcaagacttcgactcaaaacaacaacaacaacaacaacaacaacaacaacaacaacaacaaaaccttcacaccagttgtacagtggtcaagatatacactttccttttcaacattaactttttcatattaaataaaccaggatcacaagttgagttttgcaattgcatacctgattctattatctttgtacaattgaatttttaaaaagtgaaaatttcaacaagctaaaggactaagaaaatcatattgcatactttttgggtgaccaaattttatgcatagtttggtatgcataatatttcaattttattaatttcaggaatattgtgactatagaaagactgtacatagttttagtaaataaaattataataaaatatatgtttttaaactgtttagctgagataatcaaat

SEQ ID NO: 26138 - DNA, 293 bp, Homo sapiens
  AL031313.1_61099
  Located on chromosome X
  Distance between a terminus base of telomere on chromosomal short arm and 5'-terminus of this base sequence : 73532908
  Distance between 3'-terminus of neighbour sequence of sequence listing upward to telomere on chrosomal short arm and 5'-terminus of this base sequence : 379585
caatggccaagtcacatagtcatcagatttcccaagttcaaaatgaaagaaaaagaaaatgttcaaagcagctagagagaagtggcaggccacctacaaagggaacccaatcaggctaacagcagacctttcagcagaaacatgtaatgcaaaagaaaatgagcccctctattcaacattattttattttattttattttattttattttattttattttattttattttatttttgagatggagtctcgctctgtcgcccaggctggagtgcagtgtcatgatctcggctta

SEQ ID NO: 26139 - DNA, 101 bp, Homo sapiens
  DISO7_10004677
  Located on chromosome X
  Distance between a terminus base of telomere on chromosomal short arm and 5'-terminus of this base sequence : 73664545
  Distance between 3'-terminus of neighbour sequence of sequence listing upward to telomere on chrosomal short arm and 5'-terminus of this base sequence : 131344
tttattgctgacaatggccattaccatggagtgtgtgtgtgtgtgtgtgtgtgtgtgtgtgtgtgtgtttgtgtgtggtggaggtgggaggaagctgttat

SEQ ID NO: 26140 - DNA, 370 bp, Homo sapiens
  chrX.fa.O7frz.77010321
  Located on chromosome X
  Distance between a terminus base of telomere on chromosomal short arm and 5'-terminus of this base sequence : 74015221
  Distance between 3'-terminus of neighbour sequence of sequence listing upward to telomere on chrosomal short arm and 5'-terminus of this base sequence : 350575
ttggtagtttgatagaaatagcactggaactgtcaattgtgtttggcagaatggccattttaacagtacagatttttcctatcagttagcatggactttttgtctcatcttcattttatttcagcagtgttccataattctcattgtagagatttttcacctccctgattagctgtactcctaggtattgtgtgtgtgtgtgtgtgtgtgtgtgtgtgtgtgtggctactgtgaatggaactgtgtcttgatttggcttttggcttgtatgttgtggtgtaaagaaatgctacagatttttgtaccttgattttgtatctgaacctttgccaaagttgtttatcatatctaggaaccttgtagtggagtc

SEQ ID NO: 26141 - DNA, 374 bp, Homo sapiens
  AL022308.1_67569
  Located on chromosome X
  Distance between a terminus base of telomere on chromosomal short arm and 5'-terminus of this base sequence : 74180121
  Distance between 3'-terminus of neighbour sequence of sequence listing upward to telomere on chrosomal short arm and 5'-terminus of this base sequence : 164530
gccagataagatcaataaattttagtgcttcataactttgtgagcttactatagttagcaatttattgttttgttattttttaagagttgttttgttttgttcatatagctagaagccaggcactgtgactcatgcctataatcccagcactttggaaggccattatgggaggattgcttgaggcagagagtttgaaaccagcctgggcaacatagcaagagcctatatctatgaataataataataataataataataataataataaataattgctgggcattgtggcacacacatgttctcctagctactcgggaggctgagacaggagaattacttgttgagaccaggatttcaaggctacagtgacata

SEQ ID NO: 26142 - DNA, 303 bp, Homo sapiens
  chrX.fa.O7frz.77339989
  Located on chromosome X
  Distance between a terminus base of telomere on chromosomal short arm and 5'-terminus of this base sequence : 74334983
  Distance between 3'-terminus of neighbour sequence of sequence listing upward to telomere on chrosomal short arm and 5'-terminus of this base sequence : 154488
gactcatcttacatgcaatgacactcattggctcaaaataaagaaatggaggaaaatcaacaaagcaaactgaaaacagaaaaaacaggggttgcaatcccaatttcagacaaaactgactttaaaacaaaaaagatccaaaaagtcaaaaatgagcattacataaagagttcaagaagacctaactcttctaaatatatatgcacccaacataggagaacctggatttattttatttatttatttatttatttatttatttatttatttatttttgcagttgcaagatttaatagagtgaaa

SEQ ID NO: 26143 - DNA, 359 bp, Homo sapiens
  chrX.fa.O7frz.77425217
  Located on chromosome X
  Distance between a terminus base of telomere on chromosomal short arm and 5'-terminus of this base sequence : 74416539
  Distance between 3'-terminus of neighbour sequence of sequence listing upward to telomere on chrosomal short arm and 5'-terminus of this base sequence : 81253
agcagtttctgactcatagtaaacactcaaaatactgattgcccgtgatagaaaaaaaaaaaaaaaatatatatatatatatatatatatatatatatatatatctggaccaaagttgtcctgcattctgtactcctcaaaataaatctgtaaattgtcatccattttgaagaggaatattgacccactggacaccatgcagaaaaaaatccatgggatcttgaaagatctggaaatgctctcatataaggaattgggagacattagaaggtaagaaaggcatgattaaatttgcttaagtgtagaaatgctgacacatgaaacaaataaaattggttctgtatggtcctatgtggaac

SEQ ID NO: 26144 - DNA, 199 bp, Homo sapiens
  DXS995
  Located on chromosome X
  Distance between a terminus base of telomere on chromosomal short arm and 5'-terminus of this base sequence : 74575022
  Distance between 3'-terminus of neighbour sequence of sequence listing upward to telomere on chrosomal short arm and 5'-terminus of this base sequence : 158124
aatgcgttccccaaatgtccttgcaaattggacttttccccaaactctctctctctctctctctctgtgtgtgtgtgtgtgtgtgtgtgtgtgtgtgtgtgtgtatacattttgttgggtggggggccacaatccccccatacatacacacacatacacacacactacacattattttcataatcatcagcagcccctt

SEQ ID NO: 26145 - DNA, 101 bp, Homo sapiens
  DXS8076
  Located on chromosome X
  Distance between a terminus base of telomere on chromosomal short arm and 5'-terminus of this base sequence : 74597246
  Distance between 3'-terminus of neighbour sequence of sequence listing upward to telomere on chrosomal short arm and 5'-terminus of this base sequence : 22025
agtgctacctccacaaacaggtatatcacccctctgtgtgtgtgtgtgtgtgtgtgtgtgtgtgtgtgtgtgtgtggtcacataatggggtatcctaagtt

SEQ ID NO: 26146 - DNA, 461 bp, Homo sapiens
  chrX.fa.O7frz.78825738
  Located on chromosome X
  Distance between a terminus base of telomere on chromosomal short arm and 5'-terminus of this base sequence : 74986380
  Distance between 3'-terminus of neighbour sequence of sequence listing upward to telomere on chrosomal short arm and 5'-terminus of this base sequence : 389033
atggtgatgtaatttacagcatgttgagtatagttaatactgtattgtacacttgaaattttcttagagaattgatcttgtgtcttcaccacacacacacacacacacacacacacacacacacataaatggtaactatgaggtagtggatgtatttattggcttgactgtggtgatcatttcacaatgtatacgtacacataaccatcaattcatacactttaaatatatgaaattttatctgtcaataatacctcaatggccatactgcccaaggtaatttatagattcagtgccatccccatcaagctaccaatgactttcttcacagaattggaagaaactactttaaagttcatatggaaccaaaaaagggtgttatcttttatttcctctcacatgaaaattacactcattttcttcccagcacatcatagatgtctaatttaatcatggcattg

SEQ ID NO: 26147 - DNA, 380 bp, Homo sapiens
  chrX.fa.O7frz.78724440
  Located on chromosome X
  Distance between a terminus base of telomere on chromosomal short arm and 5'-terminus of this base sequence : 75087530
  Distance between 3'-terminus of neighbour sequence of sequence listing upward to telomere on chrosomal short arm and 5'-terminus of this base sequence : 100689
attgtatgtgcttgcaaataagtcgatgtgcaactggaagggccagggtaataattgcccagaaaattgctctaaatgaggaggcagtgatatagcctaacccagcttctaggtttgctttcctgttgttgccataaatctggcctagattcatatatatatacgtatatatatatatatatgtatgtatatatatatacatatatatacgtatatatatatatacacgtatatatatatatatatacacgtatatatatatatatatatatattttaccttcatgggacaagacttcctagaaatgagccctcatagtgatgtgggacctgaacttataggaatgagactacctggttacatgagacctgaacttctag

SEQ ID NO: 26148 - DNA, 368 bp, Homo sapiens
  chrX.fa.O7frz.78600334
  Located on chromosome X
  Distance between a terminus base of telomere on chromosomal short arm and 5'-terminus of this base sequence : 75211522
  Distance between 3'-terminus of neighbour sequence of sequence listing upward to telomere on chrosomal short arm and 5'-terminus of this base sequence : 123612
aactgacagctttacaataatcagccattcattctaccacattttcttgaataaggaaaatagagcacagcttaagagttctgtttgtttacctgtgtatttgtgtgtgtgtgtgtgtgtgtgtgtgtgtgtgtgtgtgtgtacattctgaggaagggaaatttgggtaggtatctttccctttaaaatacaaatgacatacattataaaattctttaaaacatacaaaaatgtatttaaaaagtctttttctaaggtataaaaacatgtcctcattttggattaacaattttttgtacacacaagtgaagtataaccaacaaacatctaattattaataagctgtctacagaagtaaccattgaatc

SEQ ID NO: 26149 - DNA, 292 bp, Homo sapiens
  AL035552.9_17867
  Located on chromosome X
  Distance between a terminus base of telomere on chromosomal short arm and 5'-terminus of this base sequence : 75323106
  Distance between 3'-terminus of neighbour sequence of sequence listing upward to telomere on chrosomal short arm and 5'-terminus of this base sequence : 111216
gtcactggatacttctgtcagaggacatcctgtctgcttgtttctcattgctttagtcattccagcaagatgtgactttccctgaaagttggaaattgcagttccttctataactgacgtttttgtcaggtggatttgtataaccaagtctttcactgtcttgattcaggcagagtgacaacaacaacaacaacaacaacaacaacaacaacaaaagcggccaaggggaatggacataccaacaaatagactgagagactatgaagaagtattatctgttaccatttcacca

SEQ ID NO: 26150 - DNA, 221 bp, Homo sapiens
  G09606
  Located on chromosome X
  Distance between a terminus base of telomere on chromosomal short arm and 5'-terminus of this base sequence : 75423718
  Distance between 3'-terminus of neighbour sequence of sequence listing upward to telomere on chrosomal short arm and 5'-terminus of this base sequence : 100320
gtatttttcccctgcattcctgtggggtatttttaaatatttagaattccatttatatttatgtatagaacttttctgtatccctttgtatgactttttagtgattgatccaggctatctatctatctatctatctatctatctatctatctatctatcatctatctatcttatgacagtcacaagagggtaaattccaggttgtccactggacttccatt

SEQ ID NO: 26151 - DNA, 276 bp, Homo sapiens
  AL022160.1_16722
  Located on chromosome X
  Distance between a terminus base of telomere on chromosomal short arm and 5'-terminus of this base sequence : 75622819
  Distance between 3'-terminus of neighbour sequence of sequence listing upward to telomere on chrosomal short arm and 5'-terminus of this base sequence : 198880
tcagtacgttttgtaccttcagataattgttattattattattattattattattattattattattattatttgagatggagtcttgctctgttgccaggctggagtgcagtggagcgatcttagctcactgcaacctccgcctcctgggttcaagcaattcccctgcctcagcctcccaagtagctgggactacaggtgtgtgccaccactcccagtgcgtgccaccactcccagctaatttttttgtattttagtaggacgagatttcaccat

SEQ ID NO: 26152 - DNA, 302 bp, Homo sapiens
  chrX.fa.O7frz.79120204
  Located on chromosome X
  Distance between a terminus base of telomere on chromosomal short arm and 5'-terminus of this base sequence : 75748690
  Distance between 3'-terminus of neighbour sequence of sequence listing upward to telomere on chrosomal short arm and 5'-terminus of this base sequence : 125595
tctagacatactatcgtgccacctataaacagagcaggttgacttattttccagtttgaattccttttatttctttcttttgccttatagctctggctagaacttccagaactatattgaatagaagtggtgaaactgggcattcttgtgtattccataacttagaagataagctttgaacttttccctgttctctatgatattatctgtgtgtgtcttttatggttgtttatgtgtgtgtgtgtgtgtgtgtgtgtgtgtgtgtgtgtgtgtgtgtgtgtattgaggtacatgccttctat

SEQ ID NO: 26153 - DNA, 476 bp, Homo sapiens
  Z83820.1_83720
  Located on chromosome X
  Distance between a terminus base of telomere on chromosomal short arm and 5'-terminus of this base sequence : 76081081
  Distance between 3'-terminus of neighbour sequence of sequence listing upward to telomere on chrosomal short arm and 5'-terminus of this base sequence : 332089
tgaacttacctgtcattgaaagtttgtgccctttggccaacctcccaacctctcgcctttcctttacctttgcctgtgggaaccagcattctattctctagttcagtgagttcaacttctcaaaattccacgtacaaataaaatcaggcagtttgtctttctctgtctgacttacttcactcagcataatacccttgagggttatccatgttgttgtaaatgacaggatttctttcttttttttatggttgaatgataacccgttgtgtgtgtgtgtgtgtgtgtgtgtgtgtgtgtgtgtgtataccacagtttcttcatccgttgatctgttggcagacacttcgattagacacttaggttgttttcatgttttggctgttgtgaataatactgcagtgaatatgggagtgcagatatctttgcaattgctgatttcatttgctttggttgtacacctactttggctattcaga

SEQ ID NO: 26154 - DNA, 438 bp, Homo sapiens
  chrX.fa.O7frz.79605825
  Located on chromosome X
  Distance between a terminus base of telomere on chromosomal short arm and 5'-terminus of this base sequence : 76198085
  Distance between 3'-terminus of neighbour sequence of sequence listing upward to telomere on chrosomal short arm and 5'-terminus of this base sequence : 116528
gtacaataagtaccatgaagaggaaccacaggatggtatgagagagtataacaaagatatctaattgatttttgttttagttttaacgtggaaatgtgggtaccttccttgggaagtgacaattacactgagtagtactgggccaggcaaaatgtgcaatcaaaagcaaaaagaacactgtattgctttaatcttaagtatgtccttttttttcttccacttgaaggtaaaaacacataggaaagtgtgtgtgtgtgtgtgtgtgtgtgtgtaagagacagagaagaatgatagaattgtccattgccttatgtaaatggtgtaaatggtagatacaacttataaactctgaacacatgagaacatatctcaagtcaatctatgatgagcccataggaatttgcttaaacaaacatctacagcaccatactattcact

SEQ ID NO: 26155 - DNA, 451 bp, Homo sapiens
  AC003001.1_79239
  Located on chromosome X
  Distance between a terminus base of telomere on chromosomal short arm and 5'-terminus of this base sequence : 76326273
  Distance between 3'-terminus of neighbour sequence of sequence listing upward to telomere on chrosomal short arm and 5'-terminus of this base sequence : 127750
gcaatagagcaaaggagtacatacagtccatgtaccctttacttaccttcctgtgatggtggcatcttacataactgtagtataatacaaaaaccaggaaattgacattcacacattactgttaactagactacagacctaattcagttttcaccatttttaacatatattcgtgtgtgtgtatgtgaatgtatatattctatgcagttttatcccacatatagatttgtgtaaataccaccacaatgaagatgcagagctgttctatcactatatatatgctatccctgtgtgttcacagacacacacacacacacacacacacacacacacacacagacacccttggcaaccaataatctgttctccatctctatagttttattgttttgagataatataaattactccatttatacattatacagtatcataacctttggtgattgtc

SEQ ID NO: 26156 - DNA, 316 bp, Homo sapiens
  AL024493.1_2978
  Located on chromosome X
  Distance between a terminus base of telomere on chromosomal short arm and 5'-terminus of this base sequence : 76823243
  Distance between 3'-terminus of neighbour sequence of sequence listing upward to telomere on chrosomal short arm and 5'-terminus of this base sequence : 496519
agaagcctggtcctagatctacagagcagcccagaagtgttgaactgagccttggttgactgaaatcctccagaaagccaaaagaagaaacccagctcataccacagtaaaagcatcaaggacacaaagaatataaaagcaaaaatccccagccagagagcaactacacacacacacacacacacacacacacacacacacacaaatcaactcacacagatgagatagaactagcacaaaaactctggcaactctaaaagccaacatgtcttcttacataaaaataaccacactagattcctagcaatggttctta

SEQ ID NO: 26157 - DNA, 265 bp, Homo sapiens
  chrX.fa.O7frz.83818220
  Located on chromosome X
  Distance between a terminus base of telomere on chromosomal short arm and 5'-terminus of this base sequence : 76920128
  Distance between 3'-terminus of neighbour sequence of sequence listing upward to telomere on chrosomal short arm and 5'-terminus of this base sequence : 96569
agtactcagcaaaatgagcttaattcgtgtgtgtgtgtgtgtgtgtgtgtgtaaagataattaaatctggtcatttacatttaattttaaaagtaaagagtagccaagagcttgattataagacagattttctgaagattttttatttttgaaatacccgattccctttgtttataaggtttcttgtaggtacatagtatcacatttacatcactgtacttggtatactgttttgcacagtcagtggttgagtgtcattaagttg

SEQ ID NO: 26158 - DNA, 411 bp, Homo sapiens
  AL035246.13_78373
  Located on chromosome X
  Distance between a terminus base of telomere on chromosomal short arm and 5'-terminus of this base sequence : 76972652
  Distance between 3'-terminus of neighbour sequence of sequence listing upward to telomere on chrosomal short arm and 5'-terminus of this base sequence : 52259
agagtaggctttcgaggtgtacagtaggcctatttatacaatgcataaagaatatttttatattgggccccaatttttaatgactacagctagtatatattcatatctatacataggtagtagtatatatctagagagtatgttaatgtatgattaaactaaatttgaagaataaaattatcctagttttagaagtttcaatagcagtttagacttaataataatcgtgtgtgtgtgtgtgtgtgtgtgtgtgtgtgtgtgtgtgtgtgtgtattaccttggaatttctgacttgggaagtgtggctcctggaatttgtatttttaataaggatcccctaggtaattcctatagttgaaaaactttgggaagtcttgagctaagcaattgtcacaaatgaatccaagtagc

SEQ ID NO: 26159 - DNA, 161 bp, Homo sapiens
  DXS1050
  Located on chromosome X
  Distance between a terminus base of telomere on chromosomal short arm and 5'-terminus of this base sequence : 76972833
  Distance between 3'-terminus of neighbour sequence of sequence listing upward to telomere on chrosomal short arm and 5'-terminus of this base sequence : -230
cctagttttagaagtttcaatagcagtttagacttaataataatcgtgtgtgtgtgtgtgtgtgtgtgtgtgtgtgtgtgtgtgtgtgtgtattaccttggaatttctgacttgggaagtgtggctcctggaatttgtatttttaataaggatcccctagg

SEQ ID NO: 26160 - DNA, 412 bp, Homo sapiens
  AL136363.4_84397
  Located on chromosome X
  Distance between a terminus base of telomere on chromosomal short arm and 5'-terminus of this base sequence : 77152629
  Distance between 3'-terminus of neighbour sequence of sequence listing upward to telomere on chrosomal short arm and 5'-terminus of this base sequence : 179635
cttgctaagcaatgttctaccttctctatctcaatttcacaattaaaatcaacttgaagatacaactgttcataagttagactttcacacattaatatggtgcttttttatttgaagaaattttaacttggcgtgtgtgtgtatgtgtgtgtgtgtgtgtgtgtgtgtgtgtttggttgctgtttttttaattggttaaataagataacaaagaataaatatttgagtacttatctgagacctagcttagaaagtttattaacaaaaccagctttatagtcagctagacttagtcaggaagtgccatttgtcaagtcacttagcctctcctggcttgagttgtctgtctgcattatgaagagaaaaatgtctaaataatatattaaaaatgtgcatagcagaatacctcact

SEQ ID NO: 26161 - DNA, 385 bp, Homo sapiens
  AL136363.4_20221
  Located on chromosome X
  Distance between a terminus base of telomere on chromosomal short arm and 5'-terminus of this base sequence : 77216685
  Distance between 3'-terminus of neighbour sequence of sequence listing upward to telomere on chrosomal short arm and 5'-terminus of this base sequence : 63644
tgtttaactgacaacctctgaagaatatttatctcttgatgtttgcagttttcacaatatcaaatatatatgcaatttttttttttttttttttttagacggagtctccctctgtcatccaggctggagtgcagtagcgtgatctcggctcactgcaacctccgcctcctgggttcaagtgattctccctgcctcagcctcccatgtagctgggattacaggcacccgccaccatgcccagctaatatttgtatttgtgtgtgtgtgtgtgtgtgtgtgtgtgtgtgtgtgtattttttttcttttcttttttgagacacagtctcgctctgtcgcccagactggagtgcagtggcatgatctcggctcattgcaaactccacct

SEQ ID NO: 26162 - DNA, 364 bp, Homo sapiens
  Z83818.1_11913
  Located on chromosome X
  Distance between a terminus base of telomere on chromosomal short arm and 5'-terminus of this base sequence : 77294115
  Distance between 3'-terminus of neighbour sequence of sequence listing upward to telomere on chrosomal short arm and 5'-terminus of this base sequence : 77045
ctggcctagtaacttattctcctaactttggactactccattttatacatattgtgtgtgtgtgtgtgtgtgtgtgtgtgtgtcttgagaaaatagaacagatgaagctaagaaaatgcaaacttaccaaacagtgaaaagagtatggagagaaaaaatttgctaccttgtttgatgctgatgaaaaactattaatatgatgacagaaatagagaaaaattgtttgacaacaccatctactgagaaaatctgatattacagagaatgtgacaaaaccagtttctctcaactttttgtatgcatcagcatcacctggattcttggtatgaaataaatatttctgaattaacattcctcacagaac

SEQ ID NO: 26163 - DNA, 367 bp, Homo sapiens
  Z95400.1_92354
  Located on chromosome X
  Distance between a terminus base of telomere on chromosomal short arm and 5'-terminus of this base sequence : 77483914
  Distance between 3'-terminus of neighbour sequence of sequence listing upward to telomere on chrosomal short arm and 5'-terminus of this base sequence : 189435
gtcaggagttcaagaccagactggacaacatggtgaaaacctgtctctacgaaaagcacaaaaattagcttggtgtggtggtgcacacctgtaatctcagctactcaggaggctgagacaggagaattgcctgaaaccaggaggcagaggttgcagtgagatgagatcatgccactgcacttcagcctgggtgacagagagcaggactccatctctccctctctctttctctctctctctgtgtatatatatatatgcatatatacacacacacatatatatacgcatacacacacacacacacacacacacacacagagagagagagagagagagtgcagattagtggtttccagaagttaggaat

SEQ ID NO: 26164 - DNA, 213 bp, Homo sapiens
  DXS1196
  Located on chromosome X
  Distance between a terminus base of telomere on chromosomal short arm and 5'-terminus of this base sequence : 77558139
  Distance between 3'-terminus of neighbour sequence of sequence listing upward to telomere on chrosomal short arm and 5'-terminus of this base sequence : 73858
ctaaattctcctccaccgtgcctttcaggaacacaggtgcacttcttcctgaatcctaacagggaaagaaagacaatcgaatgcccatctatatatttcccccagcaccctttgcaggcacacacacacacacacacacacacacacacacacacacacagtcctttaagaatgttaaaggtgtatgattttactgaaaatctgctctggaaa

SEQ ID NO: 26165 - DNA, 364 bp, Homo sapiens
  HUMUT1595
  Located on chromosome X
  Distance between a terminus base of telomere on chromosomal short arm and 5'-terminus of this base sequence : 77595384
  Distance between 3'-terminus of neighbour sequence of sequence listing upward to telomere on chrosomal short arm and 5'-terminus of this base sequence : 37032
gtcccttatcaggactagcattctaatgacctaattttgtatccatcatccttcttttgttttcattttattctctatttcagatgctgtggtttgttattttaattactctcatgccagtacctaaacctcctctgtcatttgttatatgtacctgaaaaatctctgacccaggtagccaaatgttggtaaaaacacataatggaaaattttctttctttacttttttcttttcttctttctttctttctttctttctttctttctttctttctttctttctttctttctttctttttctttctctctctctctctctttctttctttctttctttttcttcagagtcactctctgtcaccca

SEQ ID NO: 26166 - DNA, 188 bp, Homo sapiens
  Z67841
  Located on chromosome X
  Distance between a terminus base of telomere on chromosomal short arm and 5'-terminus of this base sequence : 77597245
  Distance between 3'-terminus of neighbour sequence of sequence listing upward to telomere on chrosomal short arm and 5'-terminus of this base sequence : 1497
agttgccttgcaccttgggaaaagtatgttgccatgtactaatcaatggtggcaaaaagtaatagaagccttgatgtgattgtgtatgtacatatctaaatctatatctgtgtgtgtgtgtgtgtgtgtgtgtgattgaatgtgtgtgtgtgtgtgatgaatgctaaataaaaactggaaatagcaaa

SEQ ID NO: 26167 - DNA, 192 bp, Homo sapiens
  Z96811.2_17461
  Located on chromosome X
  Distance between a terminus base of telomere on chromosomal short arm and 5'-terminus of this base sequence : 77668850
  Distance between 3'-terminus of neighbour sequence of sequence listing upward to telomere on chrosomal short arm and 5'-terminus of this base sequence : 71417
cgaaacacataatcgttaagatactcttctttttattattattattattattattattattattattattattattattattattattataagttttagggtacgtgtgcacattgtgcaggttagttacatatgtatacatgtgccatgctggtgtgctgcacccactaactcgtcatctagcattaggta

SEQ ID NO: 26168 - DNA, 480 bp, Homo sapiens
  chrX.fa.O7frz.82789139
  Located on chromosome X
  Distance between a terminus base of telomere on chromosomal short arm and 5'-terminus of this base sequence : 77782276
  Distance between 3'-terminus of neighbour sequence of sequence listing upward to telomere on chrosomal short arm and 5'-terminus of this base sequence : 113234
gtcacagtatgactccagtgactccatggaacttgtgtctactttctgtaaacccaccagttagaaatctccatgggaaattggcttgggtaaaatcccagaccccaagaaaggctttgatacacaggtctctctctctctctctctgtctctctctctctctctctccccctctgtctctctctctctctcctctctctctctctcttctctctctctctctctctgtctcttctccctctccccctgctggtagagtgcatgtgtcccagagggccccccttatccctttggctctgcaaggcaggttgcccccttttctctggaatatgaaagtaatacaatgcttctgtttttcatgtgttttattgtgttgcctcttctgagtctcacctggccaacatacccaaacctaatctatttgttaggtatttcctagagtggctatcttggtatcttggtagaaataaactggatgta

SEQ ID NO: 26169 - DNA, 113 bp, Homo sapiens
  DXS6803
  Located on chromosome X
  Distance between a terminus base of telomere on chromosomal short arm and 5'-terminus of this base sequence : 77815687
  Distance between 3'-terminus of neighbour sequence of sequence listing upward to telomere on chrosomal short arm and 5'-terminus of this base sequence : 32931
gaaatgtgctttgacaggaaaaacaatatacacagaatgtctatctatctatctatctatctatctatctatctatctatctatcgagataaagtagcatatgttcctttttg

SEQ ID NO: 26170 - DNA, 213 bp, Homo sapiens
  Z82210.1_69977
  Located on chromosome X
  Distance between a terminus base of telomere on chromosomal short arm and 5'-terminus of this base sequence : 78056359
  Distance between 3'-terminus of neighbour sequence of sequence listing upward to telomere on chrosomal short arm and 5'-terminus of this base sequence : 240559
cctaccttacaagacgtccttaagggagtgaaaaacttggaaacaaaaaaccattaccagccaatgacaaacacctatacacacacacacacacacacacacacacacacacacacacacacacaaagtacatagacagttgacattataaaggaaccacacaatcaaatctacataacaaacagttcacaacatggtaacaaggtcaaatct

SEQ ID NO: 26171 - DNA, 290 bp, Homo sapiens
  AL034406.1_113358
  Located on chromosome X
  Distance between a terminus base of telomere on chromosomal short arm and 5'-terminus of this base sequence : 78365752
  Distance between 3'-terminus of neighbour sequence of sequence listing upward to telomere on chrosomal short arm and 5'-terminus of this base sequence : 309180
tgcaaggtagttcttggttaatagaaaaatacttctccattaaataatttatgccaggttattaatagaggaaagagaaacccacccctaacacacacacacacacacacacacacacacacacacacacacacacacactaagaaggtttttgtatagagatatgggatagttgaatgatttgtaaggtagaatattctttctggtttcctgaattctgtcacagtcctattaacaataaattccaaaagagatacaaaccatttttctgtttggaaccaatatcttga

SEQ ID NO: 26172 - DNA, 472 bp, Homo sapiens
  chrX.fa.O7frz.82066891
  Located on chromosome X
  Distance between a terminus base of telomere on chromosomal short arm and 5'-terminus of this base sequence : 78486441
  Distance between 3'-terminus of neighbour sequence of sequence listing upward to telomere on chrosomal short arm and 5'-terminus of this base sequence : 120399
tcatgagcaattagatgtcataagaagaaaaacttccagagttctgttgtacaacaatgtgaatgttgttaacacaaatgaagtatacacttaaaaatagttaagatggtacactttatgttttgtgtattttacggaaattttaaaataaataaataaataaataaataaataaataaataagatctattttttccctccctcactttgaacttgaagtcaggtaaatttgggtagattcaaatatcacaagtaaatcttaagacaattgattccaggaaactggatacaaactaatacacttaaaaagtaatttttctttctaaattatagtttccaggaggtagcacaatacaacaaaccagaaataaactgtggactcaaaaatgctgcttgaatttacctatgccattgattcactttgtggccccgagaaacttgacctctatgcttcagtttcatctgctatttg

SEQ ID NO: 26173 - DNA, 318 bp, Homo sapiens
  Z95325.2_42101
  Located on chromosome X
  Distance between a terminus base of telomere on chromosomal short arm and 5'-terminus of this base sequence : 78608496
  Distance between 3'-terminus of neighbour sequence of sequence listing upward to telomere on chrosomal short arm and 5'-terminus of this base sequence : 121583
tagaagcttcactcgtaaccagtgttcaatgtcctcacaggttaagttttctttttaaaagtcattgaaaataacagatattctgtgctggcaagaggacgtgtgtgtgtgtgtgtgtgtgtgtgtgtgtgtgtgtgtgtgtgtatgaatgtagcatatttgcaactctgagagtttaaacaaaatcagtttctactgattcccttttctactttaatctcctgtaatattagacagtttggtttctaactcagtggtctttcccatacacatagaatctaagaaaagctgaaagttctgtgttaaacctcaggataa

SEQ ID NO: 26174 - DNA, 266 bp, Homo sapiens
  DXS1002
  Located on chromosome X
  Distance between a terminus base of telomere on chromosomal short arm and 5'-terminus of this base sequence : 78718699
  Distance between 3'-terminus of neighbour sequence of sequence listing upward to telomere on chrosomal short arm and 5'-terminus of this base sequence : 109885
ctgctaccctttagttctctctgaatccaagttaaattttgtcatcttgacattgttctaatttttctcaaaattccctctgttaaaatagtatatttacagcactattcacaatagcaaaggtatgaaataaacctaagcatccatcaacaagtaattaaagaaaatgtgatatacacacacacacacacacacacacacactctcaaaggaatactattcagccattaaaaagaatgaaatcatatgtttcgcagcaacatgga

SEQ ID NO: 26175 - DNA, 271 bp, Homo sapiens
  chrX.fa.O7frz.81687381
  Located on chromosome X
  Distance between a terminus base of telomere on chromosomal short arm and 5'-terminus of this base sequence : 78750592
  Distance between 3'-terminus of neighbour sequence of sequence listing upward to telomere on chrosomal short arm and 5'-terminus of this base sequence : 31627
gtgacagagcaagactatgtctcaaaaagtaataataataataataataataataataataataataataatctgatacaaccaccatggtgatgaatatactttcttcttgcattcaattgcaaaataactttaactcaaataatttgagtttgaggatagccaactttaacattccaaaacgtttcttaggctttcaaaatccagattctacttgctgatccacccaaaacaacaaaactctctggtgtgatgagcgtatgtttacaat

SEQ ID NO: 26176 - DNA, 455 bp, Homo sapiens
  AC040957.2_4975
  Located on chromosome X
  Distance between a terminus base of telomere on chromosomal short arm and 5'-terminus of this base sequence : 78809839
  Distance between 3'-terminus of neighbour sequence of sequence listing upward to telomere on chrosomal short arm and 5'-terminus of this base sequence : 58976
tagacctatgtaacaaaccttcacgttctgcacatgtatcccagaacttaaagtataatttgaaaaatagatagatagatagatagatagatagatagatagacagtcagacatatgacatctaacagggacatagccagttctttaggggtttttttaatcatatgacatgataatgcaccatctatgtttggggaaatgtaataatcatgttagtttgagaaaagtgagataaagcttcatgaggtagcaatggaataagttctaagggactcacccttcacttccacacgctaacttggccctttggaatttggtgcaaccatggaggcaatgttgtcttcactgtagaaatctataaaaaactatcctccacaggaatgcatgtgccaaaaattctccagaacaattttcagaaagtcaaccttggaaagttcaatacgttagactcattg

SEQ ID NO: 26177 - DNA, 173 bp, Homo sapiens
  G10263
  Located on chromosome X
  Distance between a terminus base of telomere on chromosomal short arm and 5'-terminus of this base sequence : 78809864
  Distance between 3'-terminus of neighbour sequence of sequence listing upward to telomere on chrosomal short arm and 5'-terminus of this base sequence : -430
ttctgcacatgtatcccagaacttaaagtataatttgaaaaatagatagatagatagatagatagatagatagatagacagtcagacatatgacatctaacagggacatagccagttctttaggggtttttttaatcatatgacatgataatgcaccatctatgtttggggaa

SEQ ID NO: 26178 - DNA, 394 bp, Homo sapiens
  AL109752.13_62807
  Located on chromosome X
  Distance between a terminus base of telomere on chromosomal short arm and 5'-terminus of this base sequence : 78832442
  Distance between 3'-terminus of neighbour sequence of sequence listing upward to telomere on chrosomal short arm and 5'-terminus of this base sequence : 22405
tatggtccatgaaagaacagaccgttttgttcatttcgttcacagcacctagcacctagaccactgcctggcaccacaaagaatacccttaataagtactggatagacacacacacacacacacacacacacgcacaggctatcataacaaatctaatcatgagcgatcaaaatggttgtgaagaagtttttatttaaattccaataattaaatagatagacatgaattttccaaatgtctacagcttaaagacaatacagcaaaagacatactcactggttgccactgcactcctgcctgggtgacagagccagaccttgtcccaaacaaaaacaaaaacaaaacacacatacacaaaaaaaacccatactcactgacgtctaacttatgtcc

SEQ ID NO: 26179 - DNA, 269 bp, Homo sapiens
  chrX.fa.O7frz.81143436
  Located on chromosome X
  Distance between a terminus base of telomere on chromosomal short arm and 5'-terminus of this base sequence : 78949237
  Distance between 3'-terminus of neighbour sequence of sequence listing upward to telomere on chrosomal short arm and 5'-terminus of this base sequence : 116401
ctattagtggatcatggagtgaattccagcattataaaaatgaggtagaatatatcagaatgcatgtagtaaggatgaatgttgttttttatatatatatgtatatatatatatatatatatatatatatatacacacacaccatatatataacatatatatatatatacataaacacacatacacacatatgtttttggggagggcaggttcaaaaaatttaaagcatagagtatattgatcagctgaatgacatagtgagtaggagt

SEQ ID NO: 26180 - DNA, 413 bp, Homo sapiens
  chrX.fa.O7frz.81235195
  Located on chromosome X
  Distance between a terminus base of telomere on chromosomal short arm and 5'-terminus of this base sequence : 79040827
  Distance between 3'-terminus of neighbour sequence of sequence listing upward to telomere on chrosomal short arm and 5'-terminus of this base sequence : 91321
tattgccgtgtattgtttctactgattcatctcagtgatttgtgtgtgtgtgtgtgtgtgtgcaatgcttttccttagctgagagtttatatttgattgattttaatctggggacccaaattgggagtgcctttcttcagggattatttgtgtttgcttcatcctcacggcactacagaattaggatcattttagttccctttgggggtcgtcacttaataatgcaatacaacctccacatagtgataccattacaagatatatatatatatatatatatatatatatatttaatttcagtgtttattgctcaaagcttttatttcaggttagggtttgtattgtatgtacatggggatcagtgtttcccatggacattccccttccttcagtgtcattggttcaataacaat

SEQ ID NO: 26181 - DNA, 180 bp, Homo sapiens
  AL022401.1_45660
  Located on chromosome X
  Distance between a terminus base of telomere on chromosomal short arm and 5'-terminus of this base sequence : 79122923
  Distance between 3'-terminus of neighbour sequence of sequence listing upward to telomere on chrosomal short arm and 5'-terminus of this base sequence : 81683
gtgcttggcttatttcacttagcataatgtcctccaggttcatttatcttgtcataaatgacaggattcttcaattcaaatttgacaagagagcagattttaagtattcttactacaaacacacacacacacacacacacacacacacacacagtggtaactattagtggtgatggacgt

SEQ ID NO: 26182 - DNA, 101 bp, Homo sapiens
  DISO7_10004685
  Located on chromosome X
  Distance between a terminus base of telomere on chromosomal short arm and 5'-terminus of this base sequence : 79394805
  Distance between 3'-terminus of neighbour sequence of sequence listing upward to telomere on chrosomal short arm and 5'-terminus of this base sequence : 271702
ctatccataaacacatgctcatgcatacccacgcaaacatacttacacacacacacacacacacacacacacacacacacagagtttcgcagttagcagaa

SEQ ID NO: 26183 - DNA, 326 bp, Homo sapiens
  AL031116.1_130529
  Located on chromosome X
  Distance between a terminus base of telomere on chromosomal short arm and 5'-terminus of this base sequence : 79751762
  Distance between 3'-terminus of neighbour sequence of sequence listing upward to telomere on chrosomal short arm and 5'-terminus of this base sequence : 356856
gctaaatgtatcaaaggaaatcacagatgattgcatactctattattctatttaaataatattgttgaagtggctacattttagtgatgaacaacagatcagtagcttccagggattaaggttgtggaaagagtgactattaagggttacaactggggtctttaattgtgatgatggaagagttgtgaatagtggtgatagtaaagtaagtctacacacttgagacctacacacacacacacacacacacacacacacacgattgcatataaacaatagtaatacctaaataaggtctgtacctgaggtaatagtattttgccaaa

SEQ ID NO: 26184 - DNA, 341 bp, Homo sapiens
  chrX.fa.O7frz.84313796
  Located on chromosome X
  Distance between a terminus base of telomere on chromosomal short arm and 5'-terminus of this base sequence : 79906141
  Distance between 3'-terminus of neighbour sequence of sequence listing upward to telomere on chrosomal short arm and 5'-terminus of this base sequence : 154053
catagtgctttctgcttagactatattttctgtccttcttgtatgaaaatgattcattgaaagacggggatcttgacaaagaatttgcaaatcagttccttcagtgaggtccaagcaggataatctagggccttcctagaatttgcaagatacacacaaacacacacacacacacacacacacaccgagagagagagagagagagagagagagagagagagagagagaaaatgatagaaaattagagtgacaaataagtaacattttggttaacataacaccttaccaatgcctagagcctcaagaggtgggcattgctatttccagaatgagtgctataa

SEQ ID NO: 26185 - DNA, 278 bp, Homo sapiens
  Z83827.1_85119
  Located on chromosome X
  Distance between a terminus base of telomere on chromosomal short arm and 5'-terminus of this base sequence : 80285435
  Distance between 3'-terminus of neighbour sequence of sequence listing upward to telomere on chrosomal short arm and 5'-terminus of this base sequence : 378953
atacttggatttaagacctgaaactaggccaggtgagttcactaacacgtgtaaacccaacattttgggaggctgaggtggaaagattgcttgaggccagagatcagccttaacacatagtgagacccccatctctacaaaataaaaataaaataaaataaaataaaataaaataaaataaaaattagctgggcatggtaatgtgcaggtgtagtcctggctacttggaaggttgaagtggagggattgctagagatcagtagttcgaggatgcagtg

SEQ ID NO: 26186 - DNA, 235 bp, Homo sapiens
  DXS1217
  Located on chromosome X
  Distance between a terminus base of telomere on chromosomal short arm and 5'-terminus of this base sequence : 80306374
  Distance between 3'-terminus of neighbour sequence of sequence listing upward to telomere on chrosomal short arm and 5'-terminus of this base sequence : 20661
cccagtaagtttggtctatatgacgttttagccttcagggcataaaagttctttgcatttacattcctcagaagagttgtttcacaaaaactttagcaacttactctcagttattttcgttatttgtactctttcaggaaactacatccactatctttggaggggaaggagtatgcacacacatacacacacacacacacacacacacatacgggattcagatacgatacttcat

SEQ ID NO: 26187 - DNA, 351 bp, Homo sapiens
  chrX.fa.O7frz.85103263
  Located on chromosome X
  Distance between a terminus base of telomere on chromosomal short arm and 5'-terminus of this base sequence : 80538351
  Distance between 3'-terminus of neighbour sequence of sequence listing upward to telomere on chrosomal short arm and 5'-terminus of this base sequence : 231742
aataagtgattcatactgttgctagggagtctccatttcaaaccacatttcagacaatgattaaggctcagagcaccttgggacctagtccctaaattacatgcaagagacaaataaaaacaacaacaaaaaaatacccaaaggaagtatatgaaaaatacctctctctctctcacacacacacacacacacacacacacacacacacacacaaagacacttgacttttattatttttgacactagttatgataactcacttctattaaagcatagaacaaagaaatgtatcagaaaagattgaggatatggcacttttttcatattgtattgatcacctagtcagctaga

SEQ ID NO: 26188 - DNA, 225 bp, Homo sapiens
  AL133512.10_139866
  Located on chromosome X
  Distance between a terminus base of telomere on chromosomal short arm and 5'-terminus of this base sequence : 80772803
  Distance between 3'-terminus of neighbour sequence of sequence listing upward to telomere on chrosomal short arm and 5'-terminus of this base sequence : 234101
cttcctgagtttagaatttagctcaattattttcagtcttgtcccgtcccatctcttctcttctcttctcttctcttctcttctcttctcttcagacagagtctcactctgtcacccaggctggagtgcagtggtacaagctcagctcactgcaacctccatctcccaggttcaagtgattctcctgcctcagcctcctgagtatctggaattaacagcatgtac

SEQ ID NO: 26189 - DNA, 416 bp, Homo sapiens
  chrX.fa.O7frz.85531909
  Located on chromosome X
  Distance between a terminus base of telomere on chromosomal short arm and 5'-terminus of this base sequence : 80952392
  Distance between 3'-terminus of neighbour sequence of sequence listing upward to telomere on chrosomal short arm and 5'-terminus of this base sequence : 179364
tgaggtgctttaacaagaatagatgctggattattcttcaatttgtgtgtgtgtgtatattaaatgtattatgtgatgtttctgtttggtttatttatatggtaaaaaattttgaaagatttttgaatgttaagcaaatcttgtattttttgtgaaatcattcttttatttatttatttatttatttatttatttatttatttatttatttgagacggagtctcactctgtcgcccaggctggagtgcagtggtgtgatctcagctcactgcaagctccgcctcccagattcacgccattctcctgcctcaacctcccgagtagctgggaccataggctcccgccaccacgcccagctaattttttgcatttttagtagagacagggtttcaccgtgttagccagatggtctcaat

SEQ ID NO: 26190 - DNA, 457 bp, Homo sapiens
  chrX.fa.O7frz.85731841
  Located on chromosome X
  Distance between a terminus base of telomere on chromosomal short arm and 5'-terminus of this base sequence : 81245906
  Distance between 3'-terminus of neighbour sequence of sequence listing upward to telomere on chrosomal short arm and 5'-terminus of this base sequence : 293098
agaataaagagtcctaaggttgacctgcaaattattgagttcccaagtgctcttttcctctattttcttttctgcctgctttacatctgctgttacttttctactgagataaaagatactgtttgaatccaagtgttttttgtttttgttttctttgcaagccaaagaatttgtattatgtcatatccaaagttctgaagtaaaagttgtgtttgggtgtgtgtgtgtgtgtgtgtgtatttaaatggccttctttgtttctgtttgttgttgttgttttctctattataaccttattctcctggacaaagtttttcttaaatagtttctaacatcctgggattccttatagaaaacagagaaggtgtcagactcctttttggggagaaactgttaccggtggcaaatatccgagtctcacaggacaaaatatgttactggtaaaaggtatccaagt

SEQ ID NO: 26191 - DNA, 391 bp, Homo sapiens
  chrX.fa.O7frz.85841984
  Located on chromosome X
  Distance between a terminus base of telomere on chromosomal short arm and 5'-terminus of this base sequence : 81356105
  Distance between 3'-terminus of neighbour sequence of sequence listing upward to telomere on chrosomal short arm and 5'-terminus of this base sequence : 109742
gctcgagtgacagagtgagaccttgtctcaaaaagaagaaagaaaaaggaaggaaggaaggaagggaaagagagagagagaaagaaagaaagaaaagaaagaaaggaaaagaaaagagaagaagaaaagaaaaggaaaaggaaaagaaaagaaaagaaagaagaaagaaagaaagaaagaaagaaagaaagaaagaaagaaagaaagaaagaaagaaagaaagaaaatgaacaactaacaagacaccagtgcctttatatgacaataaaatctatggggtaatttttttccctcccctcccctgcctaccccaaatcaaaatttttaaatctgatcaagcctctgggtccaactatccatttacaggaactaaaggacagaggaacataat

SEQ ID NO: 26192 - DNA, 426 bp, Homo sapiens
  chrX.fa.O7frz.115273164
  Located on chromosome X
  Distance between a terminus base of telomere on chromosomal short arm and 5'-terminus of this base sequence : 81442718
  Distance between 3'-terminus of neighbour sequence of sequence listing upward to telomere on chrosomal short arm and 5'-terminus of this base sequence : 86222
aacatcagactccaagatcttcagctttgggacttggactggcttccttgattttcagcttgcagacaacgggtatatttttatgtgtgtgtatgcatatatatacatatatatatatatgtatgtatatatgtactgtccctctagagaaccctgactaatagagattttgctaccaggagtggttctagaagaacagaatattaaagatggagttcatttgctggttttggggttcctgcagtgggctgcttaatattattagatcccaaaatgctaaggactccacttctaattgtatagagatcactgacagtccttggcatgaactgcttagagagttatgcaaaataaatgcatttgacactcctgattcactgctagtgagaggcaatgtgtttagtgactctacacgtaatacctttg

SEQ ID NO: 26193 - DNA, 478 bp, Homo sapiens
  chrX.fa.O7frz.73123354
  Located on chromosome X
  Distance between a terminus base of telomere on chromosomal short arm and 5'-terminus of this base sequence : 81767075
  Distance between 3'-terminus of neighbour sequence of sequence listing upward to telomere on chrosomal short arm and 5'-terminus of this base sequence : 323931
gttaatgttgaattgcctgtagaatattcaggtggtgaatcccagtaggcagttataaatataggtttgaagctcaagtaacagaaattatgggatgtgaatttctttctgttcaaatgttctgaatgtcaataaaatgtccagaaaagaaaaaagtatagagccaagattggatcataaatcacattgagtagaatcttcattcttataggcttcaatttccctaaatatgcttccttttatatgggcaaaacctgatccaacatccaagtttgtaaagtggatattattagttcataatgccaatattttaaagggagaagggatactctgtgttgtgtgtgtgtgtgtgtgtgtgcatgtgttcagaatcctctttaaaattttaacagttgtttttagttatatctgatgaaagtaaggaaaaaagaatattgattccttttatttgtctagttcttaatgatactcaaatgcc

SEQ ID NO: 26194 - DNA, 200 bp, Homo sapiens
  DXS1225
  Located on chromosome X
  Distance between a terminus base of telomere on chromosomal short arm and 5'-terminus of this base sequence : 81874771
  Distance between 3'-terminus of neighbour sequence of sequence listing upward to telomere on chrosomal short arm and 5'-terminus of this base sequence : 107218
attggcaacacaaagggagcaaactgcccacaagtaggcaacaatagagccagactcatagatagaggaagagaaagacacacacacacacacacacacacacacacagagagagagagagagagagagagagagagagggatggggtgagggaacagagagaaggaatatactctgattttagtccttccatccaggat

SEQ ID NO: 26195 - DNA, 225 bp, Homo sapiens
  DXS8082
  Located on chromosome X
  Distance between a terminus base of telomere on chromosomal short arm and 5'-terminus of this base sequence : 82036593
  Distance between 3'-terminus of neighbour sequence of sequence listing upward to telomere on chrosomal short arm and 5'-terminus of this base sequence : 161622
acctccttggttaaatgtattcctaggtatttgtgtgtgtgtgtgtgtgtgtgtgtgtgtgtgtgtgtgtgtgtgtctatagtgaatgggattgagttcttgatttgattctcagcttgagtgttattggtgcatggaaatgctactgatttttgtatgttaattttgtgtcctgaaactttacaaaaatgtgtttatgaagtctaggagcctttggaggtgtca

SEQ ID NO: 26196 - DNA, 138 bp, Homo sapiens
  chrX.fa.O7frz.72717891
  Located on chromosome X
  Distance between a terminus base of telomere on chromosomal short arm and 5'-terminus of this base sequence : 82177378
  Distance between 3'-terminus of neighbour sequence of sequence listing upward to telomere on chrosomal short arm and 5'-terminus of this base sequence : 140560
cacttgtcaattggcctaggaatttcaggtagagccatgacaaaaaagtatgaacacacacacacacacacacacacacacacataaaaacacatataatcatttatgagggatttgtgtacatccactacacaaacc

SEQ ID NO: 26197 - DNA, 194 bp, Homo sapiens
  DXS6800
  Located on chromosome X
  Distance between a terminus base of telomere on chromosomal short arm and 5'-terminus of this base sequence : 82342403
  Distance between 3'-terminus of neighbour sequence of sequence listing upward to telomere on chrosomal short arm and 5'-terminus of this base sequence : 164887
ctggctgacacttagggaaaatagaaaagaacctacgttgaaatattgggggctggttcccctgatatctatctatcgatctatctatctacctatctatctatctatcatctatctgtctatctatctatctatctagatataaaggagaatttattaaggagtattaaactcacacaatcacaaggtcccac

SEQ ID NO: 26198 - DNA, 133 bp, Homo sapiens
  DISO7_10004671
  Located on chromosome X
  Distance between a terminus base of telomere on chromosomal short arm and 5'-terminus of this base sequence : 82492149
  Distance between 3'-terminus of neighbour sequence of sequence listing upward to telomere on chrosomal short arm and 5'-terminus of this base sequence : 149552
ttacttcctgtaatcacaacccctccaacacacacacacacacacacacacacacacacacacacacacttcagctttataaagtgtaaacaaagctacttaaaattctccaagtaagataaacttgccatat

SEQ ID NO: 26199 - DNA, 465 bp, Homo sapiens
  chrX.fa.O7frz.72272701
  Located on chromosome X
  Distance between a terminus base of telomere on chromosomal short arm and 5'-terminus of this base sequence : 82634000
  Distance between 3'-terminus of neighbour sequence of sequence listing upward to telomere on chrosomal short arm and 5'-terminus of this base sequence : 141718
gagctatctgatgtgagtattgagaagtgacaggaaggaagaaattagatcaaggaggatagttaattatatcattctagagatatttaatgaaaatttaaattagccctacacatttggcccctaaagtcatatatatatatatatatatatatatatatatatatatatatatatgcccttctagaaagtgtatgatgcaagagattatgtattcatcagttcttctctctactttagtgagataaactaccagttcatcagggtataagtaatgcaagaaatctctttaagaggatagctgcagaaacaagaggctagttaatctaaggcgagagaagtgaccccatatagaagagccatgaatagaaagggagaaaagaggtctagatctgtatggtggtggacattgcaagcagttcttacctagtgctctgtgttctgatttgagtcttgtactagcat

SEQ ID NO: 26200 - DNA, 302 bp, Homo sapiens
  chrX.fa.O7frz.72382631
  Located on chromosome X
  Distance between a terminus base of telomere on chromosomal short arm and 5'-terminus of this base sequence : 82744291
  Distance between 3'-terminus of neighbour sequence of sequence listing upward to telomere on chrosomal short arm and 5'-terminus of this base sequence : 109826
tgaaagattccatactcatgagatagagggttcagatttggtcaaatccaaaaggggaaagtaccaaaacacacacacacacacacacacacacacacacacacacacacacacacaccaacaaggcaggaacaaacagcaaaacagttaagcaaaactaacaattatcacacaaattatatgatttctgagtgctctaagtgtaagcaggaattaccacaagctggttgttaatgctaattttagtcatttaaaagaactttcaagacagaatcccaaaccagtttcttacctagtaatgg

SEQ ID NO: 26201 - DNA, 246 bp, Homo sapiens
  DXS1197
  Located on chromosome X
  Distance between a terminus base of telomere on chromosomal short arm and 5'-terminus of this base sequence : 82838814
  Distance between 3'-terminus of neighbour sequence of sequence listing upward to telomere on chrosomal short arm and 5'-terminus of this base sequence : 94221
tccaactccatctagtttgctaagaatgccattattttgtttctttctatggctgagtagtattccatggtgtgtgtgtgtgtgtgtgagtgtgtgtgtatatatatatatatatatatatatatgtgatatatatatttggatatatatatatatatcacattttctttatctactcattggttgatgaaaatttacactggtctcatatttttgcaattgcaaattctgctgatataaacatgc

SEQ ID NO: 26202 - DNA, 209 bp, Homo sapiens
  D12S396
  Located on chromosome X
  Distance between a terminus base of telomere on chromosomal short arm and 5'-terminus of this base sequence : 82937722
  Distance between 3'-terminus of neighbour sequence of sequence listing upward to telomere on chrosomal short arm and 5'-terminus of this base sequence : 98662
ttgtgtattttagctaagagcatgcaataaataaaatatagatagatagagatagattagatagatagatagatagatagatagatgatacatatagatagatagacagatagatagatagatcttctgagtaagaggaaatgaacaaacactctccccccactttaatgggtgcgaaaagaaacgaatgctcagatcacatgcagatg

SEQ ID NO: 26203 - DNA, 309 bp, Homo sapiens
  AL021307.1_85320
  Located on chromosome X
  Distance between a terminus base of telomere on chromosomal short arm and 5'-terminus of this base sequence : 83043009
  Distance between 3'-terminus of neighbour sequence of sequence listing upward to telomere on chrosomal short arm and 5'-terminus of this base sequence : 105078
taatcacctatagctcaatccaagttgctgaaaatgatattacttcatttttatggccatggtatgtatgtatgtgtgtgtgtgtgtgtgtgtgtgtgtgtgtatatatatatatatatatatatatatatcacattttctttatctgcttgtgggatgatgagcacttaggttggttccatatttttacaattgcaaattgtgctgctagaaacctgtgtgtgcatgtgtctttttcataaaatgacttcttctcttttgtgtagatacacagaagtgggaatactggattgaatggtagttctacat

SEQ ID NO: 26204 - DNA, 161 bp, Homo sapiens
  DXS986
  Located on chromosome X
  Distance between a terminus base of telomere on chromosomal short arm and 5'-terminus of this base sequence : 83043020
  Distance between 3'-terminus of neighbour sequence of sequence listing upward to telomere on chrosomal short arm and 5'-terminus of this base sequence : -298
agctcaatccaagttgctgaaaatgatattacttcatttttatggccatggtatgtatgtatgtgtgtgtgtgtgtgtgtgtgtgtgtgtgtatatatatatatatatatatatatatatcacattttctttatctgcttgtgggatgatgagcacttagg

SEQ ID NO: 26205 - DNA, 364 bp, Homo sapiens
  AL021307.1_67782
  Located on chromosome X
  Distance between a terminus base of telomere on chromosomal short arm and 5'-terminus of this base sequence : 83060492
  Distance between 3'-terminus of neighbour sequence of sequence listing upward to telomere on chrosomal short arm and 5'-terminus of this base sequence : 17311
acttgattacattccaactgtaaactttgttttgcctgcagtagacaacagctccattctctgctcagttctttaattcttgggttgaaagttatttaaaatctgcctggtgtgttgtgtgtgtgtgtgtgtgtgtgtgtgtgtgtgtgtgtgtgtgtctgtgtatttctctgtgtttttttctttcaggttttccccttaactccccagtggccatgatttcttcaagactgatttcctgcttaatttggcaggaaaaatttcaggcttgctatcagagtttcagctgtgctgtgactaaaaccagcttatgcaaaaactacaaaaatgggagactcactggtctgtcacttcaaccaaattt

SEQ ID NO: 26206 - DNA, 348 bp, Homo sapiens
  AL021307.1_44910
  Located on chromosome X
  Distance between a terminus base of telomere on chromosomal short arm and 5'-terminus of this base sequence : 83083241
  Distance between 3'-terminus of neighbour sequence of sequence listing upward to telomere on chrosomal short arm and 5'-terminus of this base sequence : 22385
caaccactcaattggaaattatagttagtgacttgttataaaaaaaagtagagtataagtagggggaatacaataacttcacattaaaaatgtggtgacactacatcagtaaaatgatcaaagttaacatcatcaattgtaagtcagtaaccctgatagcatgtatccatgaatgatgcaataagaatggacttgtattagttaggattcttaagataaacagaatcaataggctgtgtgtgtgtgtgtgtgtgtgtgtgtgtgtgtgtgtgtgtgtgtgtacatgtgcttgtatgtgtaatttattataaggacctggctctcatgattatggagactgacaagtct

SEQ ID NO: 26207 - DNA, 407 bp, Homo sapiens
  chrX.fa.O7frz.74614167
  Located on chromosome X
  Distance between a terminus base of telomere on chromosomal short arm and 5'-terminus of this base sequence : 83201793
  Distance between 3'-terminus of neighbour sequence of sequence listing upward to telomere on chrosomal short arm and 5'-terminus of this base sequence : 118204
tgacttgtactaataggattgctctcgttgctatgctgagaacagactgtagatgttaccaaactgcttttccaaagtggatgtgccaatttgaattctaattactactcattagcagggtgtgagaatttgggcaactaagtgtgttcagccagatctctctccatttctgctgtaaattttggttaagtttttatgactaatgttatatatatatatatatatatatatatatatatatatatgaatgtctccagcacctggcacaatacctgaaacaggagaaggtgctcagtgaatgtcaggtgaatgagctgagaggcacttcagatatcatcatatccaactcctacattttacagttatgaaaactgaggcccggggtagtcagtatctgagtcaaggtc

SEQ ID NO: 26208 - DNA, 188 bp, Homo sapiens
  chrX.fa.O7frz.75179614
  Located on chromosome X
  Distance between a terminus base of telomere on chromosomal short arm and 5'-terminus of this base sequence : 83283562
  Distance between 3'-terminus of neighbour sequence of sequence listing upward to telomere on chrosomal short arm and 5'-terminus of this base sequence : 81362
ggtctcacttgtactgttcattagtatttcatggtatgttaagaaaagttgacagtattgacagtgtcattatttataatattaaatagatctctctagtggtgagtttgagagagagaaagagagaagacagggagtgtgtgtgtgtgtgtgtgtgtgtgtgtgtgttccatatggacttattccac

SEQ ID NO: 26209 - DNA, 419 bp, Homo sapiens
  chrX.fa.O7frz.75461002
  Located on chromosome X
  Distance between a terminus base of telomere on chromosomal short arm and 5'-terminus of this base sequence : 83613955
  Distance between 3'-terminus of neighbour sequence of sequence listing upward to telomere on chrosomal short arm and 5'-terminus of this base sequence : 330205
gaggttaagtaacttgcttatgaacctatctatgtaactatccataacataaatacacacacacacacacacacacacacacacacacacacacacacaaatataaataaaacggagaaataaactaggaattaaactctggtctttataattctaaaccctgtagtaaagaatgctatagtgttttctctcccattgagcactgtactctaaaatatacaataggtattaaaatacacacactcaaacagagactcagagataactactcacttaatggaaaaagattctccagtcattttgcctgaaattgggtccagaaatgcaagcttcaagcagcacagtgtgggtgggccaacctcatatttgattcctacaatcttaacaaactcttgctcctattcatgagaataccaata

SEQ ID NO: 26210 - DNA, 413 bp, Homo sapiens
  chrX.fa.O7frz.80700410
  Located on chromosome X
  Distance between a terminus base of telomere on chromosomal short arm and 5'-terminus of this base sequence : 83900894
  Distance between 3'-terminus of neighbour sequence of sequence listing upward to telomere on chrosomal short arm and 5'-terminus of this base sequence : 286520
caattgcattgaatctaaagatcaatttgggaaaattgacatcttaccaccagtattgagtctcccaatataaacttggtaaagctgtcctttcatttatatcttcttagatttctttcaagtcttttgtagttttcaatatatatatattatacaacaagcatgtgtgtgtgtgtatatatatgtttgtgtatgtgtgtgtatatatatgtttgtgtatgtatatatatatatttgtgtatgtgtacatatatatatatatatatatatatatatatatatatgcacacatacacattcttcacacacgtttaaaaggtttactcccaagtagttcatttttggataattctctattgcactgtacttaatgaaagaaactggatttaaaaggctaaattctgtatgatcct

SEQ ID NO: 26211 - DNA, 354 bp, Homo sapiens
  chrX.fa.O7frz.80554649
  Located on chromosome X
  Distance between a terminus base of telomere on chromosomal short arm and 5'-terminus of this base sequence : 84046706
  Distance between 3'-terminus of neighbour sequence of sequence listing upward to telomere on chrosomal short arm and 5'-terminus of this base sequence : 145399
tttgacttgccagtctgtatagtcacataagccaattcctaataataaatttcttactatacacacacacacacacacacacacacacacacatctttatataaatacatgtctttctgtgtatacacatatttcattggttcgatttctctgaagaaacctaagaaatacagaagccaacagcctccttttttacttgggtttttagaatattggtacttaaacttatgcatctagacaagaatttggatgattccttcctagggaaactcagtagctaatgagaaaaggctcataaaatgaccaaattcctacagaatttctcagggtgtcattagttgataagcttcactc

SEQ ID NO: 26212 - DNA, 348 bp, Homo sapiens
  chrX.fa.O7frz.80251061
  Located on chromosome X
  Distance between a terminus base of telomere on chromosomal short arm and 5'-terminus of this base sequence : 84188293
  Distance between 3'-terminus of neighbour sequence of sequence listing upward to telomere on chrosomal short arm and 5'-terminus of this base sequence : 141233
ttgtcacctgctaattgtaaagccccagggttttgagcgaacaggcagtagccagggggtgattacagcagggctcgggtgagacacagtgctatgtttgcttcaggtctgacccagtgcagtcatagtggtggtggccacaggggtacttgtgtcactctgttcctacctttgggtagtgcagaacagagagagagagagagagagagagagagagagagggagagagagactccattgcttgggagaaggtaagggaagagaacaagagtctctgcctggtaattcagagaattctcctggaactagcccagcaccatcaaggtgatacctctatgagtatgcaac

SEQ ID NO: 26213 - DNA, 375 bp, Homo sapiens
  chrX.fa.O7frz.80156946
  Located on chromosome X
  Distance between a terminus base of telomere on chromosomal short arm and 5'-terminus of this base sequence : 84375756
  Distance between 3'-terminus of neighbour sequence of sequence listing upward to telomere on chrosomal short arm and 5'-terminus of this base sequence : 187115
cttcactttctgtttgagtatgttccatggggttttatatggtaagacttttatttgtggttagccacacaacctttgaaaacttcattgttatacaaatttgggttatctcctttccttcctcttccccttgctctcatttttctacataaatatgctcctcccttaaaatataacctctattaagccctataaatttctaggtccagtgtgttttttcctccacaggtacaaatttctatggtaatgttctacactgttttttcatttttgttagtgtgtgtgtgtgtgtgtgtgtgtgtgtgtgtgtgtgtcttttttttctgagcctaatgctatcacctattatcttcctagcatatttcaggttgacag

SEQ ID NO: 26214 - DNA, 426 bp, Homo sapiens
  chrX.fa.O7frz.80446286
  Located on chromosome X
  Distance between a terminus base of telomere on chromosomal short arm and 5'-terminus of this base sequence : 84395977
  Distance between 3'-terminus of neighbour sequence of sequence listing upward to telomere on chrosomal short arm and 5'-terminus of this base sequence : 19846
gcgtgacttgaatacatttaatttattaatagtttgtttatagcttatagcttataatataatgtatcttgataattgttccctgtgccctcttaaagaaagtgtattttgcttttgttggatgaagtagcttatatatgtcaattcgatcaagttcactcatagtgctactccagtcttctctatttttatttatttatttatttatttatttagagacggattctcgctctgtcgcccaggctgcagtgcagtggcgcgatctcggctcactgcaagctccacctcccgagttcacgccattctcttgcttcagtttccctagtagctgggactacaggagcccgccaccatgcccggctaatatttttttgtattattagtaaagacgggttttcaccgtgttagacagaatggtctccatct

SEQ ID NO: 26215 - DNA, 343 bp, Homo sapiens
  AL121873.15_132391
  Located on chromosome X
  Distance between a terminus base of telomere on chromosomal short arm and 5'-terminus of this base sequence : 84736178
  Distance between 3'-terminus of neighbour sequence of sequence listing upward to telomere on chrosomal short arm and 5'-terminus of this base sequence : 339775
catagtactgaaagcttgccagagcacttaggcaagaaaaaaaaggcattcctatgggatagaaagaagtaaaattatcttaaataacagaagatatgatatgatctaatatgtgatctaatgtgtagaaatccctaaatattttacacacacacacacacacacacacacttgttagaacaaataaaaaatcaaacagtttcagaatacaaagtcaacgcccccaaatcagatgcatttctatgcactaacagcaaacaatctgaaaaggaaattctacttacaataatctttaaaaagtattagaaatatgtttaaccagtgaggtgaaatatttgagcac

SEQ ID NO: 26216 - DNA, 174 bp, Homo sapiens
  DISO7_10000385
  Located on chromosome X
  Distance between a terminus base of telomere on chromosomal short arm and 5'-terminus of this base sequence : 84899470
  Distance between 3'-terminus of neighbour sequence of sequence listing upward to telomere on chrosomal short arm and 5'-terminus of this base sequence : 162949
tcctgtggctttagctccattttctgctttgagtttgttttcatttttttccttgtctacagactttttatttctttaaacgcagttatatatttttgaatacttacatattgaacatacattttatatatatatatataatatatataattgctatgcgtttatatcatgtga

SEQ ID NO: 26217 - DNA, 347 bp, Homo sapiens
  chrX.fa.O7frz.77857558
  Located on chromosome X
  Distance between a terminus base of telomere on chromosomal short arm and 5'-terminus of this base sequence : 85353039
  Distance between 3'-terminus of neighbour sequence of sequence listing upward to telomere on chrosomal short arm and 5'-terminus of this base sequence : 453395
atgtcaaattgtaatttccagtgttggaggcacgaatggattaacatctccctttcagtgctactcttgtgatagtgagtgagtgttgagtgagtgagtgagtgagtgagtgacttattggacgatctggtaatttaaaatcatgtagtccctcctccctccctctctttctcctgcttcagccatgagaagtgctggcttccccttcacttgtcaccatgattgtaagttccctgaggctttcctagaagattatgctgccatgattttatacagcttgcagaaccatgagtcaattaaacctcttttctttataaattacccagtctcaggtatttctttatggc

SEQ ID NO: 26218 - DNA, 437 bp, Homo sapiens
  chrX.fa.O7frz.87528200
  Located on chromosome X
  Distance between a terminus base of telomere on chromosomal short arm and 5'-terminus of this base sequence : 85569004
  Distance between 3'-terminus of neighbour sequence of sequence listing upward to telomere on chrosomal short arm and 5'-terminus of this base sequence : 215618
tattgcaccgtcagataattagttattgttctttaatattcttttttttctgattgaagtactcctttctgcatttcttgtatgaaaagtctggggttgatgacattagcagcttttgattttctggaaaagttgctattcctcttttggttttgaaggatgttttccctggacatactcttctagggtaaaagttgttttgttttgttttgttttgtttttctcttcagccctttaaatatgtcaaaccagtctctcttggcctctaaggtttccactggaaagtctcctgccagccagacatattggagctccattgcatgttgtttcttttatcttgttgcttttaggatcatttctttatcctttgtctgtgggagtttgattattaaatgccttgaggtagtcttcttgggttaaatctgcttgacgttcta

SEQ ID NO: 26219 - DNA, 266 bp, Homo sapiens
  DISO7_10004694
  Located on chromosome X
  Distance between a terminus base of telomere on chromosomal short arm and 5'-terminus of this base sequence : 85732716
  Distance between 3'-terminus of neighbour sequence of sequence listing upward to telomere on chrosomal short arm and 5'-terminus of this base sequence : 163275
aagtaacaaatgtcagacaggatcatatttgagagagagagagagagagagagagagagagacagagagagagagagggagatggtgagtgagttttaatatggtgactttgagttatctttggaatttaatagttcagaatattttgtaaacaactgaaaatgctactttgaaatcccaagtaaaaagaaccaaagatgaaactctagggaatattaaaaatataattaaaaagagaaacctagggaaactaatctggaggtcct

SEQ ID NO: 26220 - DNA, 174 bp, Homo sapiens
  DID22N_0035346
  Located on chromosome X
  Distance between a terminus base of telomere on chromosomal short arm and 5'-terminus of this base sequence : 86109439
  Distance between 3'-terminus of neighbour sequence of sequence listing upward to telomere on chrosomal short arm and 5'-terminus of this base sequence : 376457
tttcctaccagctaatggatgaatttataatgtttttaaaaagcatatttcattcagtatgtttatttatttccaggacaaaataggtcagaaggttgtgtgtgtgtgtgtgtgtgtgtgtgtgtgtgtgtgtgtttgtatacctctttttttggtggcttctttaatcactca

SEQ ID NO: 26221 - DNA, 424 bp, Homo sapiens
  chrX.fa.O7frz.90932289
  Located on chromosome X
  Distance between a terminus base of telomere on chromosomal short arm and 5'-terminus of this base sequence : 86180132
  Distance between 3'-terminus of neighbour sequence of sequence listing upward to telomere on chrosomal short arm and 5'-terminus of this base sequence : 70519
tttctgaggcattagttgtaatgtctccttttccttccttccttccttccttccttccttcctttcttccttccttcatttctttcttttttctttctttctttcttattttagacagggtctcactttgtcacccaggctggagtgtgtggcacaatctcagctcactttcagcctcaatctctcaggttccagtgatcctcccaccacagactcttgaatagctaggactacaggtatgcaccaccacacccagctaacttttgtaacctttgtagagatgaggttttatcatgttgcccaagctggtctccacctcctgagctcaagcaatctgaccacctcaaatgtctttttttttccaaatctgattttatttatttgaatcttctctcttttttattagttaatgtgcctaaaggtt

SEQ ID NO: 26222 - DNA, 430 bp, Homo sapiens
  chrX.fa.O7frz.91332021
  Located on chromosome X
  Distance between a terminus base of telomere on chromosomal short arm and 5'-terminus of this base sequence : 86537944
  Distance between 3'-terminus of neighbour sequence of sequence listing upward to telomere on chrosomal short arm and 5'-terminus of this base sequence : 357388
ggttgcctttctacttagaaatttcttccaccctactaggtcatcattcttaagttcaaacttctaaaagtctctagggcatggacacaaagtcactttgtgtgtgtgtgtgtctgtgtgtgtgtgtgtgtgtgtgtgtgtgtgtgtgtgtggtgatgttacaaaggtgaactttgctccagttcccaataagtacctctttttcatctgagacctcatccaattggccttcactatatcataatatggtagtctatattactatttgcattttggttgtaaccacttaaccagtctctaagaagtttcaaactttctctcatctttctctcttcttctgagatctttaaattcttccaacctctgcctgttacccagtttcaaagccactttctcattgtaagttacctttatagcaatttccaagtcc

SEQ ID NO: 26223 - DNA, 228 bp, Homo sapiens
  DISO7_10017899
  Located on chromosome X
  Distance between a terminus base of telomere on chromosomal short arm and 5'-terminus of this base sequence : 86740546
  Distance between 3'-terminus of neighbour sequence of sequence listing upward to telomere on chrosomal short arm and 5'-terminus of this base sequence : 202172
ccggagtaaggagtaatgtttcatatatatatatacgtgtatatatatatatatatatatatacacgtatatatatatatatgtgtatatatatatgtgtgtgtgtatatatgtgtgtgtgtatatatatacgtatatatatgtatatatatgtgtgtatatatatatatatatatatatatatatatatatatatatataaaattcccatctattctacttacgctg

SEQ ID NO: 26224 - DNA, 178 bp, Homo sapiens
  AC004388.1_111427
  Located on chromosome X
  Distance between a terminus base of telomere on chromosomal short arm and 5'-terminus of this base sequence : 87207329
  Distance between 3'-terminus of neighbour sequence of sequence listing upward to telomere on chrosomal short arm and 5'-terminus of this base sequence : 466555
tcatggaatagtgactaatggaagtactacttatccttatatataaaactcaaaataggcttttcaacaaatacccagtgaagacacaaatatatatattacacacacacacacacacacacacacacacccacaattatatatatatgaagaaaccacatttgttaacaaatgacta

SEQ ID NO: 26225 - DNA, 285 bp, Homo sapiens
  AC004478.1_100312
  Located on chromosome X
  Distance between a terminus base of telomere on chromosomal short arm and 5'-terminus of this base sequence : 87308949
  Distance between 3'-terminus of neighbour sequence of sequence listing upward to telomere on chrosomal short arm and 5'-terminus of this base sequence : 101442
tgtagccactcctatggttagttttaatagattagatttctaactatgtaagatttaaaagcacctgtaatcttagagggaatatttcaaaacactgtccaggaaagggagctgaggtgaactttgttttgggaaattcattacagatagttttgttttttcatttttcttttctttttcaataagctttagtggtgtgtgtgtgtgtgtgtgtgtgtgtgtgtgtcgtgtgcgtgtgtgtgtatatgatcattaattttgaaataactgccaacactagttgac

SEQ ID NO: 26226 - DNA, 355 bp, Homo sapiens
  chrX.fa.O7frz.88656519
  Located on chromosome X
  Distance between a terminus base of telomere on chromosomal short arm and 5'-terminus of this base sequence : 87710538
  Distance between 3'-terminus of neighbour sequence of sequence listing upward to telomere on chrosomal short arm and 5'-terminus of this base sequence : 401304
cctgttgatactcactttcagttaataaaaaattaaatcagtaacaattattggctttaatttacaaatatgttctcacaatttctaaagataaatgacaacttatccttaccatatgcttttacaaaatattgtgtttattaacaggcaacgaattgggtaatttgaccaatcaatcttgaaatgtagttactaaaacagcagcagcagcagcagcagcaatagcagcagcagcagcagcagtgcagggaactggttggaaatacacattctcaggccctacccagacctactgaatccaaaacttcaggaataagcctcaaaaatggatgtttcagtagactgctagcttatc

SEQ ID NO: 26227 - DNA, 195 bp, Homo sapiens
  DISO7_10000387
  Located on chromosome X
  Distance between a terminus base of telomere on chromosomal short arm and 5'-terminus of this base sequence : 88039294
  Distance between 3'-terminus of neighbour sequence of sequence listing upward to telomere on chrosomal short arm and 5'-terminus of this base sequence : 328401
gtgtggtaatggtgtcttgtgtgtctttatcttaggagatacatgttgaatatatatatatatataattttaagatatctgaaacataatttcaaatgatttatctcccctcacaaatgtgtccgtgtgtgtgtgtgtgtgtgtgtgtatgagtgtgtacatagataaaaattataggaagcgctctcactctag

SEQ ID NO: 26228 - DNA, 175 bp, Homo sapiens
  DISO7_10000389
  Located on chromosome X
  Distance between a terminus base of telomere on chromosomal short arm and 5'-terminus of this base sequence : 88390459
  Distance between 3'-terminus of neighbour sequence of sequence listing upward to telomere on chrosomal short arm and 5'-terminus of this base sequence : 350970
tgactgacatgtagtacatcttcagtaaatctaaataaattaataaaagaaacaaagagagtgaaagaagtaatacacacacacacacacacacacataaaaagagaaagagaattctgtaagtgttcttgtatttgtgtaacatatttaatattgattgtccctgtcctaggat

SEQ ID NO: 26229 - DNA, 98 bp, Homo sapiens
  DISO7_10000388
  Located on chromosome X
  Distance between a terminus base of telomere on chromosomal short arm and 5'-terminus of this base sequence : 88489588
  Distance between 3'-terminus of neighbour sequence of sequence listing upward to telomere on chrosomal short arm and 5'-terminus of this base sequence : 98954
acaggcaaggtatactggaagaaatctttgttgttgttgttgttgttgttgttgatgatgtagtgcaggctgcaatctagtagatctgcaatccggta

SEQ ID NO: 26230 - DNA, 130 bp, Homo sapiens
  DXS6801
  Located on chromosome X
  Distance between a terminus base of telomere on chromosomal short arm and 5'-terminus of this base sequence : 88633396
  Distance between 3'-terminus of neighbour sequence of sequence listing upward to telomere on chrosomal short arm and 5'-terminus of this base sequence : 143710
tccagagagtcagaatcagtaggatatctctctctagatagatagttgatagatagatagatagatagatagatagatagatagatgaaaagagagatatgtgaaaggagacttgttagaggaaatgact

SEQ ID NO: 26231 - DNA, 212 bp, Homo sapiens
  DXS1203
  Located on chromosome X
  Distance between a terminus base of telomere on chromosomal short arm and 5'-terminus of this base sequence : 88890280
  Distance between 3'-terminus of neighbour sequence of sequence listing upward to telomere on chrosomal short arm and 5'-terminus of this base sequence : 256754
cctgaatttccccagccccactttccctctaatatgtgcacttatgtgctctctctctcttctcgtcttctcactctgtttacccatttatttctgtctctctgactatctctgtatctttttctcttgacacacacacacacacacacacacacacaaccatggctaccgctactaccattaccactactgatcagagttggcaagtggga

SEQ ID NO: 26232 - DNA, 361 bp, Homo sapiens
  AL023280.1_13562
  Located on chromosome X
  Distance between a terminus base of telomere on chromosomal short arm and 5'-terminus of this base sequence : 88898718
  Distance between 3'-terminus of neighbour sequence of sequence listing upward to telomere on chrosomal short arm and 5'-terminus of this base sequence : 8226
gttcagtacagatgcaaccatcctttcttttttagaattttttttttaactgcagctggttgaatccacagatggggaaaccacggatatgaagggccaactctgtgtgtgtgtgtgtgtgtgtgtgtgtgtgtgtgtagagagagagagagagaagcataatataaataattgatgaatctgggtaaaggatatatgagagtttcttatactatgcttgcaagttttctgtaaagattattttccaacaaaacaaatgtttaaaacaaacaaaaaatacctcatgaaagatccttgggattccgtcttgggggtttgaatagttttcagcatcagtgttatgaaggcattgaatctagaa

SEQ ID NO: 26233 - DNA, 382 bp, Homo sapiens
  chrX.fa.O7frz.90130122
  Located on chromosome X
  Distance between a terminus base of telomere on chromosomal short arm and 5'-terminus of this base sequence : 88977727
  Distance between 3'-terminus of neighbour sequence of sequence listing upward to telomere on chrosomal short arm and 5'-terminus of this base sequence : 78648
gcaaagatttcttagatatgacaccaaaagcaaaatctataaaagtaatggatacactggatttcatcaatatttgaacttttttcctgtatcgaggtaaaaataataaataaataaataaataaacaaacagaaaaacaaataagtaaaagattttaaaacttccactctttgaaacagaatgaaaagataatacagactaagatagcaaatttgaagaacgcataactgataaatgactgatacctaaaatagataaaggaatttaaaaattaaaaaaagtataaaatataaaggtgaatgaaaagtgggcaaaatatttgaacagatacttcagcaaagaagataaataaacatcaaataagcacattgctttactttg

SEQ ID NO: 26234 - DNA, 174 bp, Homo sapiens
  DXS990
  Located on chromosome X
  Distance between a terminus base of telomere on chromosomal short arm and 5'-terminus of this base sequence : 89122870
  Distance between 3'-terminus of neighbour sequence of sequence listing upward to telomere on chrosomal short arm and 5'-terminus of this base sequence : 144761
gacagaagggacatcaactcctgatgtttctttaatgtgtaggcaatcatgattctggatgattcactcatgctatatggacagagagttaggtaggagaaggaaaacaaattgtgtgtgtgtgtgtgtgtgtgtgtgtgtgtgtgtgtgtatgtttgtactggtcatatagct

SEQ ID NO: 26235 - DNA, 393 bp, Homo sapiens
  Z94722.1_72419
  Located on chromosome X
  Distance between a terminus base of telomere on chromosomal short arm and 5'-terminus of this base sequence : 89177572
  Distance between 3'-terminus of neighbour sequence of sequence listing upward to telomere on chrosomal short arm and 5'-terminus of this base sequence : 54528
gaggaaatagtgcaagaaagttttgtatactgggattttaccaaaataagtattgcaggatcctgtgcctaaccagaatgacaatctaaatgtaaaaatccatagcttggtgctttctccccagagaataactccgccgtcccttggtagatacgcggccaatgctgcagtttccctattgaattgtgggattattaagtgggcatgtggccaagtcaaggcaagaaactcatttggcaaagggcagaagagaggcctcttctgtttaatagaatgcttggggtttttttgttttgttttgttttgttttgttttgttttgttttgttgcttctcctttcccagaggtagctactacagctgtggatttttgactcatttgctacagtttcaa

SEQ ID NO: 26236 - DNA, 222 bp, Homo sapiens
  chrX.fa.O7frz.90451534
  Located on chromosome X
  Distance between a terminus base of telomere on chromosomal short arm and 5'-terminus of this base sequence : 89294382
  Distance between 3'-terminus of neighbour sequence of sequence listing upward to telomere on chrosomal short arm and 5'-terminus of this base sequence : 116417
tttccagtgataatctgagtttagcaatctgtcaaaaacaacaacaaaaatacacacacacacacacacacacacacgaaagagagagagagagagagagaaacaagcaaaaaacaaagttcttactttttagcaagagtacctgccatttctgttgatttagtaagagtggtaattgtgtattagtatagagttatgctgttgtaaagcactctttgaaca

SEQ ID NO: 26237 - DNA, 357 bp, Homo sapiens
  chrX.fa.O7frz.90706878
  Located on chromosome X
  Distance between a terminus base of telomere on chromosomal short arm and 5'-terminus of this base sequence : 89549196
  Distance between 3'-terminus of neighbour sequence of sequence listing upward to telomere on chrosomal short arm and 5'-terminus of this base sequence : 254592
ctgaagctattatgaagtgcactatagcaattttgttatatgaaaaagttatttgagatttgttgtaaacatttaaaattaggtatatatatgtgtgtgtatatatatgtgtgtgtgtatatatatatatatatatatatgttatatggaaaaataaattacctttcttttacagcactgaaacttgaaaggcaatttaaaaaggtaattatacaatttatcacaaacaccaaacaggccaatgattttggtaattatcaagacaacacaatttttgctttacaatgcaaaacttgtttgctgaactggagattatcaaaattacttacaatatactcattatcaaagcatgagaaa

SEQ ID NO: 26238 - DNA, 396 bp, Homo sapiens
  chrX.fa.O7frz.94406429
  Located on chromosome X
  Distance between a terminus base of telomere on chromosomal short arm and 5'-terminus of this base sequence : 90317077
  Distance between 3'-terminus of neighbour sequence of sequence listing upward to telomere on chrosomal short arm and 5'-terminus of this base sequence : 767524
aagtatttatcctcatggtcctctctcctgcagttgacactgttgatatctttattaattattgttcttccttgatttctctgaccccccccaccaactcatctgatttttctcatacttctttgaccactagttttcttcttctatttttaaaaataagctcctcttcttctagtccttaaaggttagttcacagatatacatatatatacatatatatatatatatatatatatatatatatatgccatattatgttactctagatgatgggcctctaactcaagggatttcacaatgtttcattattctctgtttaactgaatgcctctttcataagcctatgagatccttctgtggatgtctgtgtgtgactcctgcatagtatctagcaaa

SEQ ID NO: 26239 - DNA, 259 bp, Homo sapiens
  DXS6809
  Located on chromosome X
  Distance between a terminus base of telomere on chromosomal short arm and 5'-terminus of this base sequence : 90526123
  Distance between 3'-terminus of neighbour sequence of sequence listing upward to telomere on chrosomal short arm and 5'-terminus of this base sequence : 208650
tctggagaatccaattttgctttaggctgatgtgaggaagagatagaggatagatagatagatagatagatagatagatagatagatagatagatagatagatgatagataatagatagatagatagatagatgatagatagataatagatgatagatagatagatatagatagatagatagatagatagatagatagatagcccaaattcctacataatctagtcatgccctcagtattcctgagctaggaaggttca

SEQ ID NO: 26240 - DNA, 350 bp, Homo sapiens
  chrX.fa.O7frz.94069334
  Located on chromosome X
  Distance between a terminus base of telomere on chromosomal short arm and 5'-terminus of this base sequence : 90605844
  Distance between 3'-terminus of neighbour sequence of sequence listing upward to telomere on chrosomal short arm and 5'-terminus of this base sequence : 79462
ccagaggtaattaggatgagatgaggtcatgacagtagagccccctagtgcccttataagaagagacaccagaactcgctctttcactctgtttctctctctctctctctctctctctgtcttctctctgtttctgcacatgcacaaagaaaggggtcatgtgagcacacaacctacaaaccaagaggcctcaggatgtaatctgttttgttggcaccctgaccttggacattccagcctccagaactacgagaaataaatttctgttgtttaagcctcccagtctgttacggcagcctgaggtgactaaaacctatcaaaataaagtgtaatgcaattcatgataatta

SEQ ID NO: 26241 - DNA, 247 bp, Homo sapiens
  chrX.fa.O7frz.93270716
  Located on chromosome X
  Distance between a terminus base of telomere on chromosomal short arm and 5'-terminus of this base sequence : 91281487
  Distance between 3'-terminus of neighbour sequence of sequence listing upward to telomere on chrosomal short arm and 5'-terminus of this base sequence : 675293
caaggtatcattcaaagcatacacacacacacacacacacacacacacacacacacacacacacacagattcaaacatatatacatgtgtttcaaagtatattctatattttcagctacacttttgtcatcatatactgccagaaggaccctctcttatttaatcttcaccttcctcctgaattactccatggttccattcttcttctttcctttcttcccaccacttatccttctgaccaaatagc

SEQ ID NO: 26242 - DNA, 185 bp, Homo sapiens
  chrX.fa.O7frz.94637383
  Located on chromosome X
  Distance between a terminus base of telomere on chromosomal short arm and 5'-terminus of this base sequence : 91469519
  Distance between 3'-terminus of neighbour sequence of sequence listing upward to telomere on chrosomal short arm and 5'-terminus of this base sequence : 187785
gcgtatttcatttaacttaatgacctccaattccatcaatgttgctgcaaatgacattattttattcatctttatgctcaaataatatttaattgtgtgcgtgtatatatatatatatatatatatcacattttctttattcattcatcccttggtgaacacttagtttgattctacaactttgc

SEQ ID NO: 26243 - DNA, 187 bp, Homo sapiens
  chrX.fa.O7frz.94527151
  Located on chromosome X
  Distance between a terminus base of telomere on chromosomal short arm and 5'-terminus of this base sequence : 91536510
  Distance between 3'-terminus of neighbour sequence of sequence listing upward to telomere on chrosomal short arm and 5'-terminus of this base sequence : 66806
gtttcactatttctaggacctgtaagtggacagaactatctcagatatacaaccatgtctctttttgttttatatacaaaacaaatatatatatatatatatatatatatatatatatatatataccttatctataaaatattctgcttctagctatatacatatctaaccagaactaaaggtagcc

SEQ ID NO: 26244 - DNA, 260 bp, Homo sapiens
  DXS6799
  Located on chromosome X
  Distance between a terminus base of telomere on chromosomal short arm and 5'-terminus of this base sequence : 91881892
  Distance between 3'-terminus of neighbour sequence of sequence listing upward to telomere on chrosomal short arm and 5'-terminus of this base sequence : 345195
gaaccaacctgcttttctgagataactacttgcacatgggatggatggatagatgatagatagatagatagatagatagatagatagatagatagatagatggatagataatgttttatataaaacacattactaaattcagtttgctagttatttgttgtgcatttttgtgtctttatttataagggacattaggctatagatttcttaactataatgttttcatctggtttttggtatgaggataattctgaattcat

SEQ ID NO: 26245 - DNA, 140 bp, Homo sapiens
  HUMUT7254
  Located on chromosome X
  Distance between a terminus base of telomere on chromosomal short arm and 5'-terminus of this base sequence : 91881915
  Distance between 3'-terminus of neighbour sequence of sequence listing upward to telomere on chrosomal short arm and 5'-terminus of this base sequence : -237
aactacttgcacatgggatggatggatagatgatagatagatagatagatagatagatagatagatagatagatagatggatagataatgttttatataaaacacattactaaattcagtttgctagttatttgttgtgc

SEQ ID NO: 26246 - DNA, 368 bp, Homo sapiens
  chrX.fa.O7frz.99776863
  Located on chromosome X
  Distance between a terminus base of telomere on chromosomal short arm and 5'-terminus of this base sequence : 92091229
  Distance between 3'-terminus of neighbour sequence of sequence listing upward to telomere on chrosomal short arm and 5'-terminus of this base sequence : 209174
agagactgagttcctaaccaatacatgacaattatttttagagcatatagctaaataagtggcactgtcagtaaatatttaagaatacagaagaggaagaaaatttttcctctaggctaaaaatgataaatatatatatatatatatatatatatagatgtgaattttcattaatatgtaaagtttagttgtactttggagcaaatgagcttgatatattaaaatggaaacttgaaaatagaaccattagaatataaacatttgcattacaaaggtttatttgctttacaaagaatcatcacagagtgctggcttccacagcacatatactaaaaacaatcatcacaggtttcctttaagtaacagta

SEQ ID NO: 26247 - DNA, 172 bp, Homo sapiens
  DISO7_10000399
  Located on chromosome X
  Distance between a terminus base of telomere on chromosomal short arm and 5'-terminus of this base sequence : 92304727
  Distance between 3'-terminus of neighbour sequence of sequence listing upward to telomere on chrosomal short arm and 5'-terminus of this base sequence : 213130
tggaggtcatggtagattaaagatatatatatatatatatatatatatatatatacacacacacacacacacacacatacataaaagagaagattccccaattatctgtaaaatgaaatggccatcacttaattttcaggtattatttgtacccaacatgcagaaatgaatc

SEQ ID NO: 26248 - DNA, 132 bp, Homo sapiens
  DISO7_10000397
  Located on chromosome X
  Distance between a terminus base of telomere on chromosomal short arm and 5'-terminus of this base sequence : 92370617
  Distance between 3'-terminus of neighbour sequence of sequence listing upward to telomere on chrosomal short arm and 5'-terminus of this base sequence : 65718
aatgcagcatcctgtttggtgtgtgtgcgtgtgtgcgtgtgtgtgtgtgtgtgtgtgtgtgtgtgtgtggtggtggtggtggtggttggggtggggggagtctcatttatttactcaccacagggactctga

SEQ ID NO: 26249 - DNA, 101 bp, Homo sapiens
  DISO7_10000395
  Located on chromosome X
  Distance between a terminus base of telomere on chromosomal short arm and 5'-terminus of this base sequence : 92505224
  Distance between 3'-terminus of neighbour sequence of sequence listing upward to telomere on chrosomal short arm and 5'-terminus of this base sequence : 134475
gaacacatgtcccagcagccctagaatgcacttgcaaggatatatatatatatatatatatatatatatatatatatatctccttgaatggctgttgtgaa

SEQ ID NO: 26250 - DNA, 114 bp, Homo sapiens
  DISO7_10000393
  Located on chromosome X
  Distance between a terminus base of telomere on chromosomal short arm and 5'-terminus of this base sequence : 92603767
  Distance between 3'-terminus of neighbour sequence of sequence listing upward to telomere on chrosomal short arm and 5'-terminus of this base sequence : 98442
ggacattgctacttaagaaattctctggtaattcattttacaaactaaatattaatacatctacacacacacacacacacacacacacacacgatgcaaatgatcattccttat

SEQ ID NO: 26251 - DNA, 478 bp, Homo sapiens
  chrX.fa.O7frz.92005052
  Located on chromosome X
  Distance between a terminus base of telomere on chromosomal short arm and 5'-terminus of this base sequence : 92676084
  Distance between 3'-terminus of neighbour sequence of sequence listing upward to telomere on chrosomal short arm and 5'-terminus of this base sequence : 72203
tcattatacaaaggctttgattagagcccagagaaagcatgtggggtgtgtgtgtgtgtgtgtgtgtgtgtgtgtgtgtgtgtgtgtgtgtctaagaatgcagggagggcagaaaaaatgccaatagatgtgcccagatagactatgagatccacattttagagctactttgtgacaatgtcgagcaaaggcttctaagtgttacacagagttactatgaaaacagcaatggaattagaggtattaactacaagagaaaagttctatgattgagccaaccataagtggagaacccggctcgttccctcacatgtgctctcccttttgtaatgtcctggtgccttggaggacatgttactccctcagaatattgaaagtagtcattggctggtctaaagactttcagacgtagagaaaatctccaacaactgatagaacaggttatatacaccagtgtccagtttagtgaagtttcaaa

SEQ ID NO: 26252 - DNA, 193 bp, Homo sapiens
  DISO7_10000392
  Located on chromosome X
  Distance between a terminus base of telomere on chromosomal short arm and 5'-terminus of this base sequence : 92734092
  Distance between 3'-terminus of neighbour sequence of sequence listing upward to telomere on chrosomal short arm and 5'-terminus of this base sequence : 57530
ttgtgtattgtaccttgccccattcatacaagttttcatagactacagaatggaaatacatattttccatagatatataaaatacagtgtgtatacatatatgtgtatatatgtatgtctgtacgcatgtgtgtgtgtgtgtgtgtgtgtgtgtgtgtgtgcatatatatatagtcattgcaatctcctcaaa

SEQ ID NO: 26253 - DNA, 151 bp, Homo sapiens
  DISO7_10000391
  Located on chromosome X
  Distance between a terminus base of telomere on chromosomal short arm and 5'-terminus of this base sequence : 92766116
  Distance between 3'-terminus of neighbour sequence of sequence listing upward to telomere on chrosomal short arm and 5'-terminus of this base sequence : 31831
ctaggtctttgcctacactacttctaatatttctcaggtagggggtgcatgtgcgtgtgcgtgtgtgtgtgtgagaaagagagagagagaaagagagagagagagagagagagagatttttactagaggttgcagggtgatgatggtacct

SEQ ID NO: 26254 - DNA, 198 bp, Homo sapiens
  DISO7_10004720
  Located on chromosome X
  Distance between a terminus base of telomere on chromosomal short arm and 5'-terminus of this base sequence : 92880478
  Distance between 3'-terminus of neighbour sequence of sequence listing upward to telomere on chrosomal short arm and 5'-terminus of this base sequence : 114211
cctgacccaagatggtaatctaattatttaagttaattagacaactctctgagctttgagagagcagtatttgtgtgtgtgttgtgtgtgtgtgtgtgtgtgtgtgtgtgtgtgtgtgtatcccttcccctcctcacctggaaaatctgatgagcggaatttgggtttcaaaaataacaaccaattcttatctctggc

SEQ ID NO: 26255 - DNA, 250 bp, Homo sapiens
  chrX.fa.O7frz.94967615
  Located on chromosome X
  Distance between a terminus base of telomere on chromosomal short arm and 5'-terminus of this base sequence : 92969673
  Distance between 3'-terminus of neighbour sequence of sequence listing upward to telomere on chrosomal short arm and 5'-terminus of this base sequence : 88997
ggagaaatacctaaggtagatgacgggttgatgggtgcaacaaaccaccatggtacatgtataactatgtaacaaacctgcatgttctgcacatgtatcccagaacttaaagtataaatataaatatatatatatatatatatatatatatttataaactgattcaaagaaaagtacaagttaaaggaatcgggtatggattagcatagagaagagatgcataagggacttctacattatggctttcaaa

SEQ ID NO: 26256 - DNA, 381 bp, Homo sapiens
  chrX.fa.O7frz.95164434
  Located on chromosome X
  Distance between a terminus base of telomere on chromosomal short arm and 5'-terminus of this base sequence : 93198366
  Distance between 3'-terminus of neighbour sequence of sequence listing upward to telomere on chrosomal short arm and 5'-terminus of this base sequence : 228443
caaggtcttgctctgtcacccaggctggagtgctgtggtgtgatcttggctcactgcaacgtctgtcctacaggctcgtgcgatcctcccatctcagccttccaagtaggtgggaccacagacacacaccatttttctctttctttctttctttctttctttctttctttctttctttctttctttctttctttctttctttctttccttctttctttctttctttcttatctttctttctttctttctttctttcttttctttctttctttttctctttctttctctctttcttctttcttttctttgtttttctttctttcctttttctttctttttctttttgtttatttcaagaagttctagctggaggtaaaacag

SEQ ID NO: 26257 - DNA, 225 bp, Homo sapiens
  Z84720.1_67274
  Located on chromosome X
  Distance between a terminus base of telomere on chromosomal short arm and 5'-terminus of this base sequence : 93253632
  Distance between 3'-terminus of neighbour sequence of sequence listing upward to telomere on chrosomal short arm and 5'-terminus of this base sequence : 54885
ttgtaaagctagttgaatccaaaggcctctggttaacatataattgagaggcaacattcctagaaaaataaataaatactctctgtgtgtgtgtgtgtgtgtgtgtgtgtgtacctgttaccactagaccaattttatgatttcatctataatttataaatatgctttcatttggaccctttatgctttattaatctgagagtgaggatgacattaagacctatc

SEQ ID NO: 26258 - DNA, 294 bp, Homo sapiens
  Z84720.1_5050
  Located on chromosome X
  Distance between a terminus base of telomere on chromosomal short arm and 5'-terminus of this base sequence : 93315759
  Distance between 3'-terminus of neighbour sequence of sequence listing upward to telomere on chrosomal short arm and 5'-terminus of this base sequence : 61902
tctgtcagatctaggctcaaatcccatcttatcagaaagactatcaatgcccccatctgtaataaaatagaactctccctccactagcactggcgctctctaaaccccttactttgctttatttttcctttttaagcatttttcaccactgggcataatgtatctgtgtgtgtgtgtgtgtgtgtgtgtgtgtgtgtgtgtgtgtgtgtctatgtatttatctacttacatatttactttttttaagtccttatcccctagagtgtaagttttatgaggacaggaactttgagt

SEQ ID NO: 26259 - DNA, 382 bp, Homo sapiens
  chrX.fa.O7frz.95449556
  Located on chromosome X
  Distance between a terminus base of telomere on chromosomal short arm and 5'-terminus of this base sequence : 93437821
  Distance between 3'-terminus of neighbour sequence of sequence listing upward to telomere on chrosomal short arm and 5'-terminus of this base sequence : 121768
gaagcggttacaaaagactaacctttgcccattttccccaaagaattggggtcttggaatcttgagggaggaaatgttacagtaggtagctagtcagacatgagcagagcagaagagggcttacacacacacacacacacacacacacacacaccccacacacaaagaatcctgggcaaccatcaggcgattgtaaggtggttgttaactgtgtctctaaaataacgattggtcacaaccagtgcaatggaaaggcagtctctcaataaacagaaacacctggagctgatgatcagcagcttcctgatcaggtctcagaagtttggcaagctggcctacacatgcgcactaagaggcaaaatggcacagtttaactggtata

SEQ ID NO: 26260 - DNA, 345 bp, Homo sapiens
  chrX.fa.O7frz.95571307
  Located on chromosome X
  Distance between a terminus base of telomere on chromosomal short arm and 5'-terminus of this base sequence : 93582731
  Distance between 3'-terminus of neighbour sequence of sequence listing upward to telomere on chrosomal short arm and 5'-terminus of this base sequence : 144528
gtgcaggatgtatttctaacatcattactcaaaggaaggaaattttgtaactgactaaaatacattccaagtctaccaagtatggtcaaggaatattttgtgtgtgtgtgtgtgtgtgtgtatatatacacacacacacacacacacatatatatatatagtgagtgtgtgtatatatatacacacacacacaataatatatatagtttggctgtgtccccacccaaatctcatctttaattgtaactctcacaattcccacgtgtcatgggagaaacccagtgggaggtgattgaattatgggggtggatcttacctgtgctattctcgtgatagtgaatgagt

SEQ ID NO: 26261 - DNA, 372 bp, Homo sapiens
  chrX.fa.O7frz.95809893
  Located on chromosome X
  Distance between a terminus base of telomere on chromosomal short arm and 5'-terminus of this base sequence : 93824526
  Distance between 3'-terminus of neighbour sequence of sequence listing upward to telomere on chrosomal short arm and 5'-terminus of this base sequence : 241450
gatatacagacgtcaaataagcacataggaagatgttcaacactgttacctgtattattaatggttagggttctttagagaaacagggcaaattagggatgtgtgtgtgtgtgtgtgtgtgtgtgtgtgtgtagagagagagagagggacacagagagaaaagggagaagaagggacaaggaagtgagagagagggagttttaagcctcatgattatggagtttggcaagtccaaagtccaaaattggcagagtgggcactcaggctggaaacccagggaaaagacaatgctgcagttttattttaaaagccatctgctggaataattccttcttgtttggaggaggtcagtctttgttctattaaggcctt

SEQ ID NO: 26262 - DNA, 204 bp, Homo sapiens
  DXS1231
  Located on chromosome X
  Distance between a terminus base of telomere on chromosomal short arm and 5'-terminus of this base sequence : 93960698
  Distance between 3'-terminus of neighbour sequence of sequence listing upward to telomere on chrosomal short arm and 5'-terminus of this base sequence : 135800
aaaagcaccctcataggaaccaaaaatcaggtgagccctcgtagtacctggttttaattatgtattcctgaaagaggcactgaaaacagaaaaaaaaaacagtcttgaattacttatatcaccaccccctccccgcccacacacacacacacacacacacacacacacacacacacacacagtggcatgctggtgcagagagcc

SEQ ID NO: 26263 - DNA, 418 bp, Homo sapiens
  chrX.fa.O7frz.96070732
  Located on chromosome X
  Distance between a terminus base of telomere on chromosomal short arm and 5'-terminus of this base sequence : 94085326
  Distance between 3'-terminus of neighbour sequence of sequence listing upward to telomere on chrosomal short arm and 5'-terminus of this base sequence : 124424
atgcagattactttcaattactcagtctacatccaaataatattttaacacttcctgtataataaaagaatcttaaaacattatatttcccaatcttctttcccaacctgaatactattaatattatacttctattttcacacacacacacacacacacacacacacacacacacacaaacataatacattgctactgtttttgctttaggcagttacattttagagcagttaaagttagaaaaatattattttaccattattttttccatttccagttcactttatttctttttgtacaatgaaatttcggtatggtatcttttctgcctgaagaatttctattaacattttttatagagtaaatctactgcaaatatattccccaaatttttgttggtttgatctttatacctgta

SEQ ID NO: 26264 - DNA, 295 bp, Homo sapiens
  AL137843.4_93280
  Located on chromosome X
  Distance between a terminus base of telomere on chromosomal short arm and 5'-terminus of this base sequence : 94259595
  Distance between 3'-terminus of neighbour sequence of sequence listing upward to telomere on chrosomal short arm and 5'-terminus of this base sequence : 173851
cgagtagaaataaccatctcaaagctatatatgcatgtcacttttgaaatacagtgtgtgtgtgtgtgtgtgtgtgtgtgtgtgtgtttgtatttattttttatggttttgtcgaagacaaatttttaggtaattggtacttataactgctggcatagcattgaaaatccaataatttctcatttttaaatagttaatactatatttaaataaattgtttttatttattttgttttagtttagtatttgtgttgttgttatatcacagcctcgcctctacttccactccaggaaa

SEQ ID NO: 26265 - DNA, 365 bp, Homo sapiens
  AL137843.4_63823
  Located on chromosome X
  Distance between a terminus base of telomere on chromosomal short arm and 5'-terminus of this base sequence : 94288981
  Distance between 3'-terminus of neighbour sequence of sequence listing upward to telomere on chrosomal short arm and 5'-terminus of this base sequence : 29091
accagaatgcatccagtactactggtagagggtggaaggacagatttagaggttttctaaagtagtatttttgcactgaagtagctcttaatgcaagtattcaatgaggaattttatctccagcatgtgagagtgtgtgtgtgtgtgtgtgtgtgtgtttgtatgtgtgtgtgtgtgtgtgattatgcattgtatgttgtgtttgtagataaatagcagcattaatacctgggtgatatataaggctagggagttctatatactcatctgccctttgtgtcccatctccctaaagcacaagccgtcaaaagaatttctctaaaataattagattgtagttaacaacctaacatctggtagaattc

SEQ ID NO: 26266 - DNA, 317 bp, Homo sapiens
  AL137843.4_60206
  Located on chromosome X
  Distance between a terminus base of telomere on chromosomal short arm and 5'-terminus of this base sequence : 94292611
  Distance between 3'-terminus of neighbour sequence of sequence listing upward to telomere on chrosomal short arm and 5'-terminus of this base sequence : 3265
cctagaactgcttgttaatcaaagggcattactcttgtgttggcatatacatcaatgagattttatgcttaaacatacacttggaaaacaagacaacatttaacacttcaaatatatgtgtgtgtgtgtgtgtgtgtgtgtgtgtatgtatatataatatatatatgtgttccaaatttccctttcacatgttttcaattgttcttttcatatcaattgaacacaaatgacatttaccagccttcatcagcctgtatctcaaaatgttggcattatttatatgttcataagggctttcaaagaccattactgacact

SEQ ID NO: 26267 - DNA, 219 bp, Homo sapiens
  chrX.fa.O7frz.96411168
  Located on chromosome X
  Distance between a terminus base of telomere on chromosomal short arm and 5'-terminus of this base sequence : 94374511
  Distance between 3'-terminus of neighbour sequence of sequence listing upward to telomere on chrosomal short arm and 5'-terminus of this base sequence : 81583
aaactctatctgctttaggcagcaccctaagcccagtgacactgtggttcttgcagactcatagaggtactgccttgctggtctttggcaagatccaggagaattctctggatttctaagcagagatgcttgttcacttctcttactttctcccaaacaaatagaatctctctctctctctctctctctctctctctgttctaagatacgtaaagctga

SEQ ID NO: 26268 - DNA, 254 bp, Homo sapiens
  chrX.fa.O7frz.96557399
  Located on chromosome X
  Distance between a terminus base of telomere on chromosomal short arm and 5'-terminus of this base sequence : 94520756
  Distance between 3'-terminus of neighbour sequence of sequence listing upward to telomere on chrosomal short arm and 5'-terminus of this base sequence : 146026
aggttaactcaaaactgtagcacgttttctacttgctcttcctgcattctcaccacattaactctatactatcatgtattctcaaatcatgtcttctctcacatagacgaattaaagaaaactatgtgtgtgtgtgtgtgtgtgtgtgtgtgagagagagagagagagagagagataaattggacatcttcctaaattctgatgtagacgagccttacatatgaatcaatgagtcagcattaagtagcactcat

SEQ ID NO: 26269 - DNA, 219 bp, Homo sapiens
  Z67288
  Located on chromosome X
  Distance between a terminus base of telomere on chromosomal short arm and 5'-terminus of this base sequence : 94834259
  Distance between 3'-terminus of neighbour sequence of sequence listing upward to telomere on chrosomal short arm and 5'-terminus of this base sequence : 313249
cctcaatgctataaacttcttagtcattgtttccttgaattttgttttccccttattctctattctctctgtataatgtcaatcatatatataacatgaatgtgtgtgtataaatttggcatttcatgtgtttttattataaatacacagacacacacacacacacacacacaccttctctatgtctcttaaccttagttttgtttcccatctatgttt

SEQ ID NO: 26270 - DNA, 199 bp, Homo sapiens
  DXS8020
  Located on chromosome X
  Distance between a terminus base of telomere on chromosomal short arm and 5'-terminus of this base sequence : 94910737
  Distance between 3'-terminus of neighbour sequence of sequence listing upward to telomere on chrosomal short arm and 5'-terminus of this base sequence : 76259
ctaatggccctggatgggtcggtgatgagaagggaggtagaaaagggttggaaaggacaagaaagaggggcagatgcagaattatattttaaaacctcctgctggaattcaaagagccctctgctgttaatcacacacacacacacacacacacacacacacacacacacacacacacacaaagtctatacagaattgt

SEQ ID NO: 26271 - DNA, 78 bp, Homo sapiens
  Z66572
  Located on chromosome X
  Distance between a terminus base of telomere on chromosomal short arm and 5'-terminus of this base sequence : 94960847
  Distance between 3'-terminus of neighbour sequence of sequence listing upward to telomere on chrosomal short arm and 5'-terminus of this base sequence : 49911
tttaggtagaatgtgcgtgcgtgtgtgtgtgtgtgtgtgtgtgtgtgtgtgagagagagggagagggagagagaaaga

SEQ ID NO: 26272 - DNA, 277 bp, Homo sapiens
  DXS8034
  Located on chromosome X
  Distance between a terminus base of telomere on chromosomal short arm and 5'-terminus of this base sequence : 94968800
  Distance between 3'-terminus of neighbour sequence of sequence listing upward to telomere on chrosomal short arm and 5'-terminus of this base sequence : 7875
cctggcacaaagtgtttatcaagtgaatgaaggtccttcatggacgagacaaatgactatacacacacacacacacacacacacacacacacacccacacaaaacttaaaaatactaaatatatgataccatggcccatttaataataacatatcaagaaatggaggccaggcacagtggctcacacctgtaatcccagcacactgggatgccaaggcggatggatcacttgaggtcaggagttcaagaccagcccggccagtatggtgaaacctca

SEQ ID NO: 26273 - DNA, 416 bp, Homo sapiens
  chrX.fa.O7frz.97314617
  Located on chromosome X
  Distance between a terminus base of telomere on chromosomal short arm and 5'-terminus of this base sequence : 95239055
  Distance between 3'-terminus of neighbour sequence of sequence listing upward to telomere on chrosomal short arm and 5'-terminus of this base sequence : 269978
tgcttaaaactaggctaaggacataggtggggtttgcttgtgaagaacatggtatgcaatgctaaggaactcagaccgtacactatgccaagagggagccagtgaggggggtctaagaaagaaaaaactctggtagaatgtattactttgcttgttccctctctctctcatattcctctctctctctctctctctctctctctctcacacacacacacacacacacacactctcacatactcaaacacacagacacacacatttaatatattcactattttctcacacacgagtttaaaataaactcctatatctgattttctggccctaccctatttattcagctttgttttctatctttccctgaaacctcttagcagttagcctctccctcctctgacctaaaggtgaactct

SEQ ID NO: 26274 - DNA, 279 bp, Homo sapiens
  Z66987
  Located on chromosome X
  Distance between a terminus base of telomere on chromosomal short arm and 5'-terminus of this base sequence : 95239103
  Distance between 3'-terminus of neighbour sequence of sequence listing upward to telomere on chrosomal short arm and 5'-terminus of this base sequence : -368
atggtatgcaatgctaaggaactcagaccgtacactatgccaagagggagccagtgaggggggtctaagaaagaaaaaactctggtagaatgtattactttgcttgttccctctctctctcatattcctctctctctctctctctctctctctctctcacacacacacacacacacacacactctcacatactcaaacacacagacacacacatttaatatattcactattttctcacacacgagtttaaaataaactcctatatctgattttctggcc

SEQ ID NO: 26275 - DNA, 256 bp, Homo sapiens
  Z73417.1_32499
  Located on chromosome X
  Distance between a terminus base of telomere on chromosomal short arm and 5'-terminus of this base sequence : 95505012
  Distance between 3'-terminus of neighbour sequence of sequence listing upward to telomere on chrosomal short arm and 5'-terminus of this base sequence : 265630
gcttatcctaacaatgatgcattggtaacagataatgtatgtaaatgtgcttttcatattataaagtgctattcagatattattttcatgcatggagtgtgtgtgtgtgtgtgtgtgtgtgtgtgtgtttgaaacggagtctcactctgtagcccaagctggagtgcagtggcatgatctcggctcactgcaacctcctgggctcaagcgattctcatgcctcagcctcccaagtagctgtgagtacaggtgcgtg

SEQ ID NO: 26276 - DNA, 277 bp, Homo sapiens
  Z73417.1_10310
  Located on chromosome X
  Distance between a terminus base of telomere on chromosomal short arm and 5'-terminus of this base sequence : 95527269
  Distance between 3'-terminus of neighbour sequence of sequence listing upward to telomere on chrosomal short arm and 5'-terminus of this base sequence : 22001
aacagagcaagattacgtcttaataataataataataataataataataataataataatgatgattatgtagcagagcctgtgccaatctccttttgctgcaggaagtcagtaaaacaaatctatgtgaggagtggccaagtagcagccaccaaaataatggcctccaggttgtcctgtcattatgttgttttttgtttttttaaggtttccatgattgctgcctcctttccccagggctgattcagggacagattcaacatctaaaggttgtcac

SEQ ID NO: 26277 - DNA, 321 bp, Homo sapiens
  AL109952.15_20093
  Located on chromosome X
  Distance between a terminus base of telomere on chromosomal short arm and 5'-terminus of this base sequence : 95651714
  Distance between 3'-terminus of neighbour sequence of sequence listing upward to telomere on chrosomal short arm and 5'-terminus of this base sequence : 124168
ctggtctctttctgtaatttcaagatgatatataagcttctgttaattattgggaggttgggtctccatgatgaaggctcccatgtgtacatgttaaataaatttgtatgccttttctcctatgaatcagcctcatatcagtgatattttagtgaaccttcaggggccaatgactttggcccccacaacacacacacacacacacacacacacacacacacacacaaacacacacgtgtatgtttcttgttttttaaagagagatttcacttccatcctaaacccttgaggaggtaaatgtttgactcaaattgccactat

SEQ ID NO: 26278 - DNA, 396 bp, Homo sapiens
  chrX.fa.O7frz.92737261
  Located on chromosome X
  Distance between a terminus base of telomere on chromosomal short arm and 5'-terminus of this base sequence : 95956930
  Distance between 3'-terminus of neighbour sequence of sequence listing upward to telomere on chrosomal short arm and 5'-terminus of this base sequence : 304895
ttcactgtaaacatttcaacatagtagtctctcacactcaatatgagctcttacatggctagagactttgctttggtaatatttttgaatccatggtgcctaggaggatgttagaaaatactagatagtcaataaatgtttccgaatgcagattcttctctaaactccaacttttctgggctatagagcaatactcctaaatttaattctatacatatatatatatatatatatatatatatatatgtataactgcgtttatatatgaccccaccacacacacagaggttgactacaaaggccaaacttttccagaacacacatttgctagagttaggtgcaagtgaatgccagaataaagttataatttgtcactcaggaaatgtagcactgtac

SEQ ID NO: 26279 - DNA, 329 bp, Homo sapiens
  AL031053.1_24286
  Located on chromosome X
  Distance between a terminus base of telomere on chromosomal short arm and 5'-terminus of this base sequence : 96093661
  Distance between 3'-terminus of neighbour sequence of sequence listing upward to telomere on chrosomal short arm and 5'-terminus of this base sequence : 136335
ttagatggtgaactgatggataacaatggcagattaatctttgggaaaatactaatttttgttttcataatcactagtgctacatttttcatttaaaggaaatataattttacaaaactcaaagtagacatacgtgtgtgtgtgtgtgtgtgtgtgtgtgtgtgtattcatttgtatgtgggggtggcatcttgctatgttgctcaggctggttttgaactccagggctcaagcgatcaacccatctcaacctcttgagtagctaggactactggcacatgggcaaatattataaatgttttacagaaactcatgtttatggaaatctg

SEQ ID NO: 26280 - DNA, 437 bp, Homo sapiens
  Z86061.1_24255
  Located on chromosome X
  Distance between a terminus base of telomere on chromosomal short arm and 5'-terminus of this base sequence : 96224658
  Distance between 3'-terminus of neighbour sequence of sequence listing upward to telomere on chrosomal short arm and 5'-terminus of this base sequence : 130668
ctaatgtttggtgccattatacattattttatcattaatttagtgagtactttcgttaacaattgcctagttgactgctcatgttatgaagttattagtttctgttcacctaaattattcaagcaaagacctgccactaggtctgagatgctggaaaaggattcttaccttaggtaggagactagtattagtagtagtagtagtagtagtagtagtagtagtagtggtagtagtagcagtatttttgagatggagtgcagtggcggaatctcggctcactgcaacctgcgcctcctgggttcaagtgattctcctgcctcagcctcctgagcagctgggactccaggcgtgcgccaccacgcccagctaatttttgtatttttagtagagtcggggtttcaccatattggccaggctggtctcgaactcctgacctt

SEQ ID NO: 26281 - DNA, 241 bp, Homo sapiens
  chrX.fa.O7frz.93095852
  Located on chromosome X
  Distance between a terminus base of telomere on chromosomal short arm and 5'-terminus of this base sequence : 96318926
  Distance between 3'-terminus of neighbour sequence of sequence listing upward to telomere on chrosomal short arm and 5'-terminus of this base sequence : 93831
gagtttcctagataatgcgaagagaacggggagaaaaaactctcaattttagtcacatctgtataacaaaaaaataacaatcaccatcaatagaagaggcaccaccaaaactgaggaagtatacacacacacacacacacacacacacacacacacacacacacacacacacaagcacacgttgagtaaaataagaatgaacatttagattgggtgtattatcaagtagcatttccacttc

SEQ ID NO: 26282 - DNA, 260 bp, Homo sapiens
  DISO7_11755107
  Located on chromosome X
  Distance between a terminus base of telomere on chromosomal short arm and 5'-terminus of this base sequence : 96544959
  Distance between 3'-terminus of neighbour sequence of sequence listing upward to telomere on chrosomal short arm and 5'-terminus of this base sequence : 225792
gcatcatttgattcagatggtactaattttaatatatatcttgaaataaaaaatatgttgaaagtagaaaaaagtgtatatatatatatacacacttgtgtatgtatacataatatacctatatatacaccagtgtatgtatacatatgtatacatatatacacttgtgtgtgttatatatatatataaatatatataaaatatatataaataaataaatatatatatatatagagagagagagttcctcctggaagatt

SEQ ID NO: 26283 - DNA, 255 bp, Homo sapiens
  Z69838.1_25307
  Located on chromosome X
  Distance between a terminus base of telomere on chromosomal short arm and 5'-terminus of this base sequence : 96665163
  Distance between 3'-terminus of neighbour sequence of sequence listing upward to telomere on chrosomal short arm and 5'-terminus of this base sequence : 119944
agtcaatcgatgaaacagatctgagtataaatgagaatttaacatatggttaagttagctctttaaatttattggggaataatggactattatatgaatggtgctaggatttggagacacacacacacacacacacacacacacacacacacacacacacacacacacatatatatgcaatgacccagaagccatacaagaaaaggttaatgttttgaccacatcataatgtaaaaattctggagttaggtgcca

SEQ ID NO: 26284 - DNA, 351 bp, Homo sapiens
  chrX.fa.O7frz.98343997
  Located on chromosome X
  Distance between a terminus base of telomere on chromosomal short arm and 5'-terminus of this base sequence : 96751077
  Distance between 3'-terminus of neighbour sequence of sequence listing upward to telomere on chrosomal short arm and 5'-terminus of this base sequence : 85659
cactacagtgtcacctttgtaataagttatgttgctatatatgtatgaatctatctcgggactttctattctttcaattggtcttttttttaatccgtgcactggtgttcttgtaccttgtcataattactgtagctttattgtaaaacttgatatttgctaatataaatcctctttattgttattttccaacattattttggttattcttggtatttctacatttatatatagatttaaaaaataagcttgccaaattacacagacatacacacacacacacacacacacacacacacacacactcttgggattttgtttggaactgcactgaatctacagaccaatttg

SEQ ID NO: 26285 - DNA, 174 bp, Homo sapiens
  X65456.1_137
  Located on chromosome X
  Distance between a terminus base of telomere on chromosomal short arm and 5'-terminus of this base sequence : 96787627
  Distance between 3'-terminus of neighbour sequence of sequence listing upward to telomere on chrosomal short arm and 5'-terminus of this base sequence : 36199
agcctttccttctcaaagttataagaaaaacttttgcctatttccttagaaggaatacaaacacagtatcttttttacagttagcttcattgttaacctactagtagtgtgtgtgtgtgtgtgtgtgtgtgtgtgtgtctgtctgtctgtctgtccatacagtttgaggtagat

SEQ ID NO: 26286 - DNA, 253 bp, Homo sapiens
  Z73639.1_4907
  Located on chromosome X
  Distance between a terminus base of telomere on chromosomal short arm and 5'-terminus of this base sequence : 96787661
  Distance between 3'-terminus of neighbour sequence of sequence listing upward to telomere on chrosomal short arm and 5'-terminus of this base sequence : -140
tgcctatttccttagaaggaatacaaacacagtatcttttttacagttagcttcattgttaacctactagtagtgtgtgtgtgtgtgtgtgtgtgtgtgtgtgtctgtctgtctgtctgtccatacagtttgaggtagattttctatcttaattttctctaaatatattattaattatactaatgtcatttattgtagaacacaccgtttatgttttgattgaaatcatattaactttatggatcaaattggc

SEQ ID NO: 26287 - DNA, 459 bp, Homo sapiens
  chrX.fa.O7frz.98621056
  Located on chromosome X
  Distance between a terminus base of telomere on chromosomal short arm and 5'-terminus of this base sequence : 96959422
  Distance between 3'-terminus of neighbour sequence of sequence listing upward to telomere on chrosomal short arm and 5'-terminus of this base sequence : 171508
cttgcagactcttcatggtaccaccgcgatggtcttggacaagatccaggagaattctctggattaccaggcagagagtcttgttttcttcccttatttttcccaaacctataaagtctctctctctctctctctctctctctctctctattttgagccacctaaagctgggggtggagtgacacaacacccatgtgaccaccactgctatgactgtgctcggtcagacctgaaaccagcatagtgctgagtttcacccaatgcctactgtaacccttctctgactactgcttatgctcactcaaggccctggggctccacagttagcaggtggcaaggccagtcaagccaatattcttctcttcagggtagcaaaggcccccaggccctgggtgggtctgcaggtgccatcagggagtcagggagtaggatgaaaaaccttagaagtctatctggtgt

SEQ ID NO: 26288 - DNA, 300 bp, Homo sapiens
  DISO7_00006251
  Located on chromosome X
  Distance between a terminus base of telomere on chromosomal short arm and 5'-terminus of this base sequence : 97043842
  Distance between 3'-terminus of neighbour sequence of sequence listing upward to telomere on chrosomal short arm and 5'-terminus of this base sequence : 83961
catgctgtcttccctaacccacctcaccgccaactcccttagccgcaccttctgccccagtgctttctactcctccacttcactttctaccaacaatagctcctatgagttcaggatcaagacagatacacacacacacacacacacacacactgccaggcatacaaaagtttggccagattcagaaagccctctgtctccacttaaccccctctcaggctctctgctatttggaggccacttggccaccccttaaagttcaattctatgagtaatcatctagtactagccagaatacca

SEQ ID NO: 26289 - DNA, 257 bp, Homo sapiens
  DXS8063
  Located on chromosome X
  Distance between a terminus base of telomere on chromosomal short arm and 5'-terminus of this base sequence : 97128504
  Distance between 3'-terminus of neighbour sequence of sequence listing upward to telomere on chrosomal short arm and 5'-terminus of this base sequence : 84362
aaaatcggtgattaggaaaatacatgaaataaaagaaaatgataaaattattcttttcttctttactaattccataaggtaattcatcctataaccactgaatattgaaaataatgtgataagtctctttctcttccccccccgccgcaaacacacacacacacacacacacacacacacacacacacacacaactttccttgaaaaatgagatactacttatcaaggaacaaattcagtactttggctgctggagg

SEQ ID NO: 26290 - DNA, 168 bp, Homo sapiens
  Z68326.1_21428
  Located on chromosome X
  Distance between a terminus base of telomere on chromosomal short arm and 5'-terminus of this base sequence : 97128581
  Distance between 3'-terminus of neighbour sequence of sequence listing upward to telomere on chrosomal short arm and 5'-terminus of this base sequence : -180
ggtaattcatcctataaccactgaatattgaaaataatgtgataagtctctttctcttccccccccgccgcaaacacacacacacacacacacacacacacacacacacacacacaactttccttgaaaaatgagatactacttatcaaggaacaaattcagtacttt

SEQ ID NO: 26291 - DNA, 387 bp, Homo sapiens
  chrX.fa.O7frz.99073294
  Located on chromosome X
  Distance between a terminus base of telomere on chromosomal short arm and 5'-terminus of this base sequence : 97250467
  Distance between 3'-terminus of neighbour sequence of sequence listing upward to telomere on chrosomal short arm and 5'-terminus of this base sequence : 121718
gctcaacatcttgagtcattataaatacacaatcaaagtcacaatgaaccactttccactcactggcctggagattatatatatgtgtgtatatatatatatatacacacatatatatatacacacacacatatatatatatacacatatatatatacacacacacacacacacacacacacacacacagagccccaaaaaacagaaacaaacaaacaaaaactggaaaagggcaagggttggcaagattgttgaaacattggagcccttgtacgttgctggtgggggtgtaaaatgatgtagctgtttcagaaaaaagtttggtggtttctcaaatagttaagcatataagtagcatatgagtgagcaataccactcctagttatg

SEQ ID NO: 26292 - DNA, 418 bp, Homo sapiens
  Z81367.1_39489
  Located on chromosome X
  Distance between a terminus base of telomere on chromosomal short arm and 5'-terminus of this base sequence : 97600022
  Distance between 3'-terminus of neighbour sequence of sequence listing upward to telomere on chrosomal short arm and 5'-terminus of this base sequence : 349168
gattacagatgaggccatgtacggacatgccagatattctctagtttcttgctactcaaagtgtgatccatgaaatagtagcttcagcattacctggtatattagggatccaccaagaaacagaaccagcaaggggtgtgtgtgtgtgtgtgtgtgtgtgtctcgtttgtgtgtgtgtgtgtgtgcacttttttagaaattggctcccgtgaacctggagcctggaaagcatgcagggaaggctggcaggctggagacccaatgaagagctgcagttcaagtctgaaggcattttgctggcagaattccctcttcctcaaggcaggtaaatctttttactcctgaaggccttcaactgattggataaggccaacccacattgtgcagggtaatctgctttactcaaagtctacagatc

SEQ ID NO: 26293 - DNA, 408 bp, Homo sapiens
  chrX.fa.O7frz.117983579
  Located on chromosome X
  Distance between a terminus base of telomere on chromosomal short arm and 5'-terminus of this base sequence : 98002067
  Distance between 3'-terminus of neighbour sequence of sequence listing upward to telomere on chrosomal short arm and 5'-terminus of this base sequence : 401627
ataaaggacatctacactgatcaggcaaacctcacaattcaaatgaaccaattcaaactgcacatgtgagcttctcaaatgttttgtaggtataggctcaatagagggttgtttgctattaaatattggaaagtttacaaatttgtgttgggcagcattcaaagccatcctgggccacatgaggcctgcgggtcacagattggacaagcttgctttaactcataatttgattttttaatgtttctctgatgcatgtgaaaatattatgagtaaaaagacaatgtttgggctctgctttaaaatactctagaaaacacacacacacacacacacacacaaacacacacacacaaaagggttggagagagttttaaaaatggcagaatgttactagatgttgcaacttgc

SEQ ID NO: 26294 - DNA, 411 bp, Homo sapiens
  Z68871.1_33799
  Located on chromosome X
  Distance between a terminus base of telomere on chromosomal short arm and 5'-terminus of this base sequence : 98107477
  Distance between 3'-terminus of neighbour sequence of sequence listing upward to telomere on chrosomal short arm and 5'-terminus of this base sequence : 105002
ttccatcctatggatgtaacataatcaattttcacaacttcttgttattcagactgtcctgatatttcctattatctacactgtgtggatggcatcttttcagagtctgtgcactgctgaagggcacagttacaggcacaattcctgtggctatttgcgctagtgagttgaatgtgtcttccttgagtccagcaagctgtcttaggagaaatataacacaacatgataaatgtctcagtttgtgtgagtgagtgtgtgtgtgtgtgtgtgtgtgtgtgtatgctgacaaccacatttccctctgcccttttgtgggtttgtgtctcatttggtttctcttcccaaattcaggctcagaagtgacaaaagagaattatcaggatggcagtccttataaccagatgcttatca

SEQ ID NO: 26295 - DNA, 266 bp, Homo sapiens
  chrX.fa.O7frz.118136921
  Located on chromosome X
  Distance between a terminus base of telomere on chromosomal short arm and 5'-terminus of this base sequence : 98183290
  Distance between 3'-terminus of neighbour sequence of sequence listing upward to telomere on chrosomal short arm and 5'-terminus of this base sequence : 75402
aggatgtaaggtacggaagtcggcctaaatctgcttctgaacactgaagctgggtgctcccatcttgcagagacctgaaaaattgcctgctctcagccaccaatgccacagattcagtcacttgtgtgagaactctgtcctgagagataaaataccataaattaccagcagctgtttgacacatcttgcatccatccatccatccatccatccatccatccatccatccatccatccttgcagttaatagacattaaggccaaact

SEQ ID NO: 26296 - DNA, 447 bp, Homo sapiens
  chrX.fa.O7frz.100879549
  Located on chromosome X
  Distance between a terminus base of telomere on chromosomal short arm and 5'-terminus of this base sequence : 98188531
  Distance between 3'-terminus of neighbour sequence of sequence listing upward to telomere on chrosomal short arm and 5'-terminus of this base sequence : 4975
ctgaagaactaaagtaatgcagatttatgtcctagcctattatactggatgaaaacagaactttaaaaatattcatctcaatttgctaaataatacatgtaattgggcctgtttgtgtattatattatatatatatatatatatatatatatatatatataaatgagtgtatttatcatatatatataaatatatatatttggtagatcttattcctgcttctacttaaatatgtgacccgataatagtgagttaccccttgtgaaccttaactggggcatctgcaacatgggcatattgatacatacctggctgaactgttgtgggaagaaaatgtataatgcttaaacctatgtgaagtgtctaacatgtaatgctacaacaaatatatgtattggctttccctgtgttttctcttccacaaaagacgtagtttacatgaacatc

SEQ ID NO: 26297 - DNA, 463 bp, Homo sapiens
  chrX.fa.O7frz.100765431
  Located on chromosome X
  Distance between a terminus base of telomere on chromosomal short arm and 5'-terminus of this base sequence : 98302419
  Distance between 3'-terminus of neighbour sequence of sequence listing upward to telomere on chrosomal short arm and 5'-terminus of this base sequence : 113441
tagtgttcctcaagcacataatttattttgtgttagtttacatagtttcaggttaaaaattatgagacctgggagggcacagtggctcacacctgtaatcccaacactttgggaggccaaggcaggcagatcacctgaggtcaggagttcgagaccagcctggccaacatggtgaaactctgtctctactaaaaatacaaaaattagccaggcatggtggcgggcaactgtaatcccagctacttgggaggctgagacagcagaatcatttgaacccgggaggcagaggctgtagtgagctgagactgtcattgcactccagcctaggcaacaagagtgaaactccatctctctctctctctctctctctctctctctctctctctctctctatatatatatatatatatatatatatatatatatatatatataactactgagaatttgaagagtggacatt

SEQ ID NO: 26298 - DNA, 291 bp, Homo sapiens
  HUMUT7241
  Located on chromosome X
  Distance between a terminus base of telomere on chromosomal short arm and 5'-terminus of this base sequence : 98429616
  Distance between 3'-terminus of neighbour sequence of sequence listing upward to telomere on chrosomal short arm and 5'-terminus of this base sequence : 126734
aaaattagccaggcgtggtggcgggcgcctgtagtcccagctactcgggaggctgaggcaggagaatggcgtgaacccaggaggcggagcttgcactgagctgagatcgtgccactgcattccagccttgacgacagtgggagactccatcttaaaaatagatagatagatagatagatagatagatagatagatagatagatagatagaaagaataaaaaataaaaacaaaaatatttttctcccagtcagtggctttgtcttttcattctctgaatagtgctttgggaa

SEQ ID NO: 26299 - DNA, 383 bp, Homo sapiens
  Z68694.1_28927
  Located on chromosome X
  Distance between a terminus base of telomere on chromosomal short arm and 5'-terminus of this base sequence : 98492745
  Distance between 3'-terminus of neighbour sequence of sequence listing upward to telomere on chrosomal short arm and 5'-terminus of this base sequence : 62838
ccattgaatattcactgaacaccatcccttgatgatgatgatgatgatgatgatgatgatgatgatgctgttgacagcaatgatggtggtagagaggacattttctgtttgacctaagagtcttatgtctgggggctacatgaatggccaggtctctcagaaggtagttatcctccaagaaagaggataaataatttatacaaggtcacataccaataaggagaagagcccaaattggaacccaggtttatccgacactacggccatatacttaaatcacttttttccttcctaaacccaaggatttgaatttcatctttgtcttattgttcaaacaatcctttaggctgtcagaaatttggtaatgtttcctcagatgacag

SEQ ID NO: 26300 - DNA, 160 bp, Homo sapiens
  Z68694.1_21120
  Located on chromosome X
  Distance between a terminus base of telomere on chromosomal short arm and 5'-terminus of this base sequence : 98500556
  Distance between 3'-terminus of neighbour sequence of sequence listing upward to telomere on chrosomal short arm and 5'-terminus of this base sequence : 7428
aacaaaggttaccttgtacctttccgtgtgtgtgtgtgtgtgtgtgtgtgtgtgtgtgtgtgttgggggtggagggtatctaaccaggaagatggtcagatgtgagttgagggtagggagcaaggatcaggctccagctattacgcttctttagtggctc

SEQ ID NO: 26301 - DNA, 425 bp, Homo sapiens
  chrX.fa.O7frz.100488589
  Located on chromosome X
  Distance between a terminus base of telomere on chromosomal short arm and 5'-terminus of this base sequence : 98579475
  Distance between 3'-terminus of neighbour sequence of sequence listing upward to telomere on chrosomal short arm and 5'-terminus of this base sequence : 78759
tcacagatacctagaaacagaaagtataccataacacacagggccacatgaggaagcaccagagtcagtcatgggcagagcaagtgaagaaaaaaaaaaatgagggcaagaggctttattgtttttttgttttgttttgcttttgtgtgtgtgtgtgtgtgtgtgtgtgtgtgtgtgaagaaacaagtgtggcagcataggtaggtttggaattggctaattcgaaccatttcaatggctcagggataaaaggctgtttctagctgtctgttacctggccctattgtgattagtgctgataattagtgtgatattagtgagagcctgataaaggagatatttggtggtatgggttctggattggttggtttgcaaatgaaaggggtgctcacagctgagttgtttgctatagctaggaattagct

SEQ ID NO: 26302 - DNA, 235 bp, Homo sapiens
  DXS8096
  Located on chromosome X
  Distance between a terminus base of telomere on chromosomal short arm and 5'-terminus of this base sequence : 98769944
  Distance between 3'-terminus of neighbour sequence of sequence listing upward to telomere on chrosomal short arm and 5'-terminus of this base sequence : 190044
tcatgtgagccagttcttgaaaattaatctctctctcaccatatacgtgtgtgtgtgtgtgtgtgtgtgtgtgtgtatacacattagattggttctgtttctctggatgtgacatgcaattttttatttgaatacaactgggcattttgtatttttatttgctaaatctggaaaccttaggagaagagcctctaaatatgtaagtttagtgaccatctgagatgaccttcccaat

SEQ ID NO: 26303 - DNA, 328 bp, Homo sapiens
  AL035444.9_19562
  Located on chromosome X
  Distance between a terminus base of telomere on chromosomal short arm and 5'-terminus of this base sequence : 98784128
  Distance between 3'-terminus of neighbour sequence of sequence listing upward to telomere on chrosomal short arm and 5'-terminus of this base sequence : 13949
tatgtttagcacctgcgacagtatcaggcattgaggaaatcacaataaacattagctattattattattattattattattattattattattattatacctgaatagaccattactgtttctatggccatttttgttattatgtggatttatattgattgatatagattgaccttcaaaatatgtttttcataaaaaggcagtttataaagctgtaagtaggatattatctgatttttgttttaagtatagttacatttgcatagtaaaacttctggaaaaatgtttatttctcttagtccattttctgatgctataacagaatacc

SEQ ID NO: 26304 - DNA, 469 bp, Homo sapiens
  chrX.fa.O7frz.101437363
  Located on chromosome X
  Distance between a terminus base of telomere on chromosomal short arm and 5'-terminus of this base sequence : 98894960
  Distance between 3'-terminus of neighbour sequence of sequence listing upward to telomere on chrosomal short arm and 5'-terminus of this base sequence : 110504
ttgacctagtatttggtagcacaatagcatgactctagtcaataataatttgattatacattttaaaataactaaaagagtataattggatagtttctaacacaacagatttaaggcatgcatactgcatttgccgtgatgtgattattatgtattgtgtgactgtatcgaagtatctatacactccatatatatatatatatatatatatatatatatatatatatatatatatatatatacatacctactatgtacccaaatattttttttttgagatggagtcttgctctgttgcccaggctggagtgcagtggcatgatctcagctcactgcaagatccacctccccagttcacgccattctcctgcctcagcctcccaagtagctgggactacaggtgctcgccaccacgcctggctaattttttgtatttttagtagagacggggtttcaccttagccaggat

SEQ ID NO: 26305 - DNA, 327 bp, Homo sapiens
  AL034409.4_11520
  Located on chromosome X
  Distance between a terminus base of telomere on chromosomal short arm and 5'-terminus of this base sequence : 99012238
  Distance between 3'-terminus of neighbour sequence of sequence listing upward to telomere on chrosomal short arm and 5'-terminus of this base sequence : 116809
tgattctagtaaccaggcacagctccagacacacacacacacacacacacacacacacacacacacacacacacagagttaaatgagcaactatagtgtgccaggtaaatgagagcaaagtggccagggataatcatggaagggatgatatgccaatatgtcaactaatagtaagatgcagactgttggaaaatgaaattttctttagagaaatagccaggaatgtaatagaatccccctttaagcactcttttaagggcagtgtggcacactgcaaaaagcaagtcctagttcttgtatggtttctcagctgactagctgatcagt

SEQ ID NO: 26306 - DNA, 359 bp, Homo sapiens
  Z73497.1_23993
  Located on chromosome X
  Distance between a terminus base of telomere on chromosomal short arm and 5'-terminus of this base sequence : 99525405
  Distance between 3'-terminus of neighbour sequence of sequence listing upward to telomere on chrosomal short arm and 5'-terminus of this base sequence : 512840
aggtctgcttgttccattagtaatgtttgccccgtttgatgcttctaaattgttatttacagcagtaaactgtttccctttgtgtgtgtgtgtgtgtgtgtgtgtgtgtgtgtgtgtaatgtgatttaatttataatatttcaggtatgagttttgtaaccaagtttataaatgttctcagatttttgtagtgtgcatccttcaatgggtatcaacatcatgttttattttcttgaaataagttttctctgccaggcacaatagctcatgcctgtaatcccagcagcttgggaggccaaggcaggagaatcactggagtccaggagttgggaccagcctgaggaaacataaagaaacca

SEQ ID NO: 26307 - DNA, 241 bp, Homo sapiens
  DXS1191
  Located on chromosome X
  Distance between a terminus base of telomere on chromosomal short arm and 5'-terminus of this base sequence : 99525433
  Distance between 3'-terminus of neighbour sequence of sequence listing upward to telomere on chrosomal short arm and 5'-terminus of this base sequence : -331
gccccgtttgatgcttctaaattgttatttacagcagtaaactgtttccctttgtgtgtgtgtgtgtgtgtgtgtgtgtgtgtgtgtgtaatgtgatttaatttataatatttcaggtatgagttttgtaaccaagtttataaatgttctcagatttttgtagtgtgcatccttcaatgggtatcaacatcatgttttattttcttgaaataagttttctctgccaggcacaatagctcat

SEQ ID NO: 26308 - DNA, 415 bp, Homo sapiens
  AL135959.1_40728
  Located on chromosome X
  Distance between a terminus base of telomere on chromosomal short arm and 5'-terminus of this base sequence : 99639260
  Distance between 3'-terminus of neighbour sequence of sequence listing upward to telomere on chrosomal short arm and 5'-terminus of this base sequence : 113586
tgaaatatccaccttaaatcaaacttccaattcttaataaattctgcccagacatttccctctgaaacattgccaaagctttgtgcaagttgaggttttccttgccaaaatacgtaagaaattcaagctttgttttatcagcaggttttgttggtgatatttgactcagctaaatacacacacacacacacacacacacacacacacacacacacacacttcgagctcatcaatcacatgaaaaaattataagggttagatcaccagttattgggttaagtccagtatatttctatccaatggtaaacaaaatgataaaagttaattgacaattctcgataccactcagtctctcctgcagccatcagctctctggtaggtaaattatgcatctgaagactttaaggcagattac

SEQ ID NO: 26309 - DNA, 251 bp, Homo sapiens
  chrX.fa.O7frz.102153030
  Located on chromosome X
  Distance between a terminus base of telomere on chromosomal short arm and 5'-terminus of this base sequence : 99825650
  Distance between 3'-terminus of neighbour sequence of sequence listing upward to telomere on chrosomal short arm and 5'-terminus of this base sequence : 185975
acatggtactttaagcgtgatatttttctcaatatatataaatatttacttattaactgatcttttgatttaggactgaccaagcccttttctttgaagatgagcccattgactggtgttttatgatttctctctctttctttctttgtgtgtgtgtgtgtgtgtgtgtgtgcagaaactacacctatagggtatcagctgattttcagggcagtgtctttaaagtagagtgagctcctaaagataattgc

SEQ ID NO: 26310 - DNA, 324 bp, Homo sapiens
  chrX.fa.O7frz.102280102
  Located on chromosome X
  Distance between a terminus base of telomere on chromosomal short arm and 5'-terminus of this base sequence : 99952503
  Distance between 3'-terminus of neighbour sequence of sequence listing upward to telomere on chrosomal short arm and 5'-terminus of this base sequence : 126602
gagtacctgcggcttatttttatgagctcatgaccacatagtgcatgggttagtgacctagtctaactgtgtatggttggttacacagcatttgctcaattttgccgcaactctgcccctgcaaaaggtcttcctcattgtgttaacaaaggttttatatatatatatatatatatatatatatatatatatatatatatatgtatgtatgtatgtatatataagcacaagggtttagttgaagggaaggtggtatggcttttgtgagtgacatcaaaactctcataggttagggatgtcctcctgcttactagattctatcaa

SEQ ID NO: 26311 - DNA, 478 bp, Homo sapiens
  AL133381.6_20873
  Located on chromosome X
  Distance between a terminus base of telomere on chromosomal short arm and 5'-terminus of this base sequence : 100034788
  Distance between 3'-terminus of neighbour sequence of sequence listing upward to telomere on chrosomal short arm and 5'-terminus of this base sequence : 81961
agcaaccagtaagaaatagttcaaaaatataatgaagaactcataaaaggaattaaaatgttgcacagaaaacattacttaatgcaaaagaaagcagtaaagaaggaatagtggaagaaaaagacatgagacatatagaaagcaaaaagtaaaatggcagatgtaaatccaactttacacacacacacacacacacacacacacacacacacatgcacacatacactcacatttttgcttctgtcattttggccctagggaaataggagaacgatgaaagtagaaaaaaaggaggcctaaattgaaaatttgaacttctctatgtcaattttcattgctgatgtatatacattagtctgtgtacgccagtgggtaagtagtatgctatagtggaaaaaccataggcttggaaataaggcagacaagaccataaacaagttacttaatcattctaacttctagtttcctcaactaccaa

SEQ ID NO: 26312 - DNA, 392 bp, Homo sapiens
  chrX.fa.O7frz.102441401
  Located on chromosome X
  Distance between a terminus base of telomere on chromosomal short arm and 5'-terminus of this base sequence : 100114046
  Distance between 3'-terminus of neighbour sequence of sequence listing upward to telomere on chrosomal short arm and 5'-terminus of this base sequence : 78780
catttactagcatttcgttgaggacttctgcatctatgttcctcagggatattggcctgtagtttttgtgtatgtgtgtgtgtgtgtgtgtgtgtctgtgtgtgtgtgtgtgtgtgtctgtgtgtctgtgtgtgtgattatatggttttggtatcagagtaatgctggccttgtggaatgagttagggagtattccttcctctttaattttgttggaatcatttcaggataattggtggttttctttagaagtttggtagaacttggcagtaaagccatctggtcttggatgtttcttttttgggagactttttattactgattcaatctcattacccattattggtctattctcattttctgtttcttcctgattcaatcttggtaagttg

SEQ ID NO: 26313 - DNA, 311 bp, Homo sapiens
  chrX.fa.O7frz.102606003
  Located on chromosome X
  Distance between a terminus base of telomere on chromosomal short arm and 5'-terminus of this base sequence : 100228542
  Distance between 3'-terminus of neighbour sequence of sequence listing upward to telomere on chrosomal short arm and 5'-terminus of this base sequence : 114104
actaactttaaaggcactggagttgcttaccatttaaaataatgttgttttggtggtggtggtaatgttggcgtgagagtgtgtgtgtgtgtgtgtgtgagagagagagaggctctaattgattttgaaaaattataaaatgtatattcaattatcatttcttggattttgaaaaattacaaaatatatatttgattataatttcttggagttcataataaatagggttcacttattgtgacaagggccccactatccttctttgaaattatggctataatttagtttcctagtacaagctttgctcatgt

SEQ ID NO: 26314 - DNA, 267 bp, Homo sapiens
  chrX.fa.O7frz.102702134
  Located on chromosome X
  Distance between a terminus base of telomere on chromosomal short arm and 5'-terminus of this base sequence : 100324561
  Distance between 3'-terminus of neighbour sequence of sequence listing upward to telomere on chrosomal short arm and 5'-terminus of this base sequence : 95708
ccaacgctatgttgaatagtagttttaaaaataaattaatcctttataaaactgttaagaccgtcacagacatttacaatatgtttaaacttttagttttgtcctatatttaaaaaatagtcatcttattttaggacaaaaatttagcatataagttttttatacaaatttttaaaaagatttttatctgtatatatatatatatatatatatatatatatatatatatataacttaaacaatctctctttggtttctttaaatctt

SEQ ID NO: 26315 - DNA, 210 bp, Homo sapiens
  Z67212
  Located on chromosome X
  Distance between a terminus base of telomere on chromosomal short arm and 5'-terminus of this base sequence : 100432659
  Distance between 3'-terminus of neighbour sequence of sequence listing upward to telomere on chrosomal short arm and 5'-terminus of this base sequence : 107831
ttcaccatctgtaaaaacaagaggggccaggtgtggtggctcaggcctgtaatcccagcactttgggaggccaaggcaggtggatcacttgaggtcaggagtttgagaccagcctggccaacatggcaaaaccctgtctctactaagtgtgtgtgtgtgtgtgtgtgtgtgtgtgtgtgttatgccgggcgtggtggcgcatatctcagc

SEQ ID NO: 26316 - DNA, 279 bp, Homo sapiens
  chrX.fa.O7frz.103247503
  Located on chromosome X
  Distance between a terminus base of telomere on chromosomal short arm and 5'-terminus of this base sequence : 100801693
  Distance between 3'-terminus of neighbour sequence of sequence listing upward to telomere on chrosomal short arm and 5'-terminus of this base sequence : 368824
tcaaggttcatctatgctgtagcatgtatcggtattgcatttttattgcaaagtatagatatactatattttattttcccattcaccaattgatggacatttgcattatttacactttagggctcttataaataatattgctgtgaacattcgtgtataagttcttgaataaacatgttttcattttatctctcttggttttatatatatatatatatatatatatatatatatatacacatatgtatatatgtatgtggaaatgctaggtaatatgac

SEQ ID NO: 26317 - DNA, 326 bp, Homo sapiens
  chrX.fa.O7frz.103372176
  Located on chromosome X
  Distance between a terminus base of telomere on chromosomal short arm and 5'-terminus of this base sequence : 100926504
  Distance between 3'-terminus of neighbour sequence of sequence listing upward to telomere on chrosomal short arm and 5'-terminus of this base sequence : 124532
acttaatgaactttgtcaacagagatgtaaataacgaagaccacaactcagtcttaggtccgagtgtgtgtgtgtgtgtgtgtgtgtgtgtgtgtgtggtttactgctctgttagaattatgattgttagtgttgatatgagggttttttcccccagtgagatggattaattaatggcattgctaatttatatctccttatagtttcacagtatactctcatgtccagaatgttctctcccttttctcctaggcttatctcctccatgaaaaactctgatattttctatggatatcttctctctcagaacttctagagcacttcta

SEQ ID NO: 26318 - DNA, 453 bp, Homo sapiens
  chrX.fa.O7frz.103448707
  Located on chromosome X
  Distance between a terminus base of telomere on chromosomal short arm and 5'-terminus of this base sequence : 101002909
  Distance between 3'-terminus of neighbour sequence of sequence listing upward to telomere on chrosomal short arm and 5'-terminus of this base sequence : 76079
tagccattatttgtaagatggtacaattgaatggacctatatttctaggtctctactatttatgtctctatgtgaatcagtgtctctaccaagtaaataatggccagttgtggatcataagtcacaaatgtggcttgctcctcaaagcctacaggataaaaaggacatgcagtatatgtgagagtgtgttgtgtgtgtgtgtgtgtgtgtgtgtgtgtgtgtgtttcctttccgaaatagtttagggattttaatgttgttgttgttttaccaaaagttacccttagggcaactatggtacaatttgtgtgccaaggatatgaaatcaataattgagtcttgccccatgctatgattattgaaacagaattgatttgtgtatttccaaatactgtatatgagatatcgacctttgaatcatttttttaccactaaatacatggcaaattggta

SEQ ID NO: 26319 - DNA, 421 bp, Homo sapiens
  Z99706.1_5664
  Located on chromosome X
  Distance between a terminus base of telomere on chromosomal short arm and 5'-terminus of this base sequence : 101097795
  Distance between 3'-terminus of neighbour sequence of sequence listing upward to telomere on chrosomal short arm and 5'-terminus of this base sequence : 94433
tacgacaattataccaaatttgacattagcatgacaattaaatgttttaaagtatttaggagctttatatttatattaaatatgtattcagtagaagcacaataaataaggttcatttttataagctgaattaaaagtcaataaaaataataataataataataataataataataatagaagcatcagagactgcctaggattttcaaactaccagttcagccaaacatcatgtcctgtcggcaagtgtacatctaagtacataggagttgtcagacaggagctagaatgtgtttctcagcaggaatttttctgtcttctgtcattttcattctgggtgttataaatggtatgtgttgttgtatttcagttattatctttcaattatagagtctgagagtacataggattctttgaggtt

SEQ ID NO: 26320 - DNA, 89 bp, Homo sapiens
  DXS8112
  Located on chromosome X
  Distance between a terminus base of telomere on chromosomal short arm and 5'-terminus of this base sequence : 101140979
  Distance between 3'-terminus of neighbour sequence of sequence listing upward to telomere on chrosomal short arm and 5'-terminus of this base sequence : 42763
ttatgagcctttattttatgcgcgtgcgtgtgtgtgtgtgtgtgtgtgtgtgtgtgtgtgtaatttaagccaccttaacaaagcatctt

SEQ ID NO: 26321 - DNA, 405 bp, Homo sapiens
  Z70274.1_8603
  Located on chromosome X
  Distance between a terminus base of telomere on chromosomal short arm and 5'-terminus of this base sequence : 101319383
  Distance between 3'-terminus of neighbour sequence of sequence listing upward to telomere on chrosomal short arm and 5'-terminus of this base sequence : 178315
taccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtc

SEQ ID NO: 26322 - DNA, 420 bp, Homo sapiens
  Z97356.1_10804
  Located on chromosome X
  Distance between a terminus base of telomere on chromosomal short arm and 5'-terminus of this base sequence : 101338813
  Distance between 3'-terminus of neighbour sequence of sequence listing upward to telomere on chrosomal short arm and 5'-terminus of this base sequence : 19025
agtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttc

SEQ ID NO: 26323 - DNA, 294 bp, Homo sapiens
  Z68339.1_28037
  Located on chromosome X
  Distance between a terminus base of telomere on chromosomal short arm and 5'-terminus of this base sequence : 101382208
  Distance between 3'-terminus of neighbour sequence of sequence listing upward to telomere on chrosomal short arm and 5'-terminus of this base sequence : 42975
taacaaggcatcttactggaatcattaaaaaaagacagaaaaaaggtagaatctgttaagttttattttactgaaatgaatattcagagtttattcatgtattgtttccaggaaaaagtaatatttgtttaagacttagattgaaaataaaacttctgaggcctttgatatttagttttgccaataatatgccatgtgctcttatttaattttctcttgcgtgtgtgtgtgtgtgtgtgtgtgtgtgtgtgtgtgtgtgtgtgtatagttactaattcttgccagttacacctg

SEQ ID NO: 26324 - DNA, 375 bp, Homo sapiens
  Z83850.1_32063
  Located on chromosome X
  Distance between a terminus base of telomere on chromosomal short arm and 5'-terminus of this base sequence : 101417141
  Distance between 3'-terminus of neighbour sequence of sequence listing upward to telomere on chrosomal short arm and 5'-terminus of this base sequence : 34639
gattagtaatcatgctcctttgacctacttgggagcaatgcaaaagaaaatgcaagagtaagctagacccagagagagacagaaagagagagagagagagagagagagagagagagagagaatgcgtagggatggcagaagaaattgcagccaagaaagggctttatagcacaaagtataaatctatcgggtaagacaacatattccataagaaccagaagggctaatcaagagcaagcatatacctatttatactttttaatttaccttttaaaataaccctattgaaataatgtacataccatgaaatacacttgtttaaagtgcacaattcaatgggttttaggaggtctatagagttatgtgacaatcgcc

SEQ ID NO: 26325 - DNA, 197 bp, Homo sapiens
  DISO7_10004727
  Located on chromosome X
  Distance between a terminus base of telomere on chromosomal short arm and 5'-terminus of this base sequence : 101688087
  Distance between 3'-terminus of neighbour sequence of sequence listing upward to telomere on chrosomal short arm and 5'-terminus of this base sequence : 270571
acaccacatacataatgcttacagatttagatagatcgatcgatagatagatgatagatgatagatagatagatagatagatagatagatagatagatagatagatatagatagatacatacatacatacatacacacatagaaatagagatatcctgataaggaaagaataaaaccatgagtctggtaatagccaa

SEQ ID NO: 26326 - DNA, 383 bp, Homo sapiens
  AL139812.11_99074
  Located on chromosome X
  Distance between a terminus base of telomere on chromosomal short arm and 5'-terminus of this base sequence : 101868041
  Distance between 3'-terminus of neighbour sequence of sequence listing upward to telomere on chrosomal short arm and 5'-terminus of this base sequence : 179757
tcttccagaatcaagttgtaaatctctacccaggccccctttcctgccagctaaacacccccagccttttctcctgctcccctggctgggcttcccctctggagcatgctgcaattgctgaccaggtggcgaggctatctccaaggacaaacacagtgttctgggtgttttgctttgttctctactccctccaccccttccacccacccattcagagtgcagctgtttcatctattggcctccctacacacacacacacacacacacacacacacacacacacacacaccccaaacatagagcctgtagtgcccccttatgtctaaaaaaggtcctcagttgtcttgccctcctacctttatctactgctaggccagatcaat

SEQ ID NO: 26327 - DNA, 184 bp, Homo sapiens
  DXS8048
  Located on chromosome X
  Distance between a terminus base of telomere on chromosomal short arm and 5'-terminus of this base sequence : 102168244
  Distance between 3'-terminus of neighbour sequence of sequence listing upward to telomere on chrosomal short arm and 5'-terminus of this base sequence : 299820
cttggggagcctgctaagaaaacacacacacacacacacacacacacacacacacacacagagagagagagagagagagagagagaaattagaagagaaaaaagcaataaaattcattctactaatgccatagcaattaaactcatggatcttaacttactccaggctgaactggttgatagca

SEQ ID NO: 26328 - DNA, 123 bp, Homo sapiens
  DXS8097
  Located on chromosome X
  Distance between a terminus base of telomere on chromosomal short arm and 5'-terminus of this base sequence : 102254228
  Distance between 3'-terminus of neighbour sequence of sequence listing upward to telomere on chrosomal short arm and 5'-terminus of this base sequence : 85800
atacatctatccctacacagttacgtgtgtgtgtgtgtgtgtgtgtgtgtgtgtgtgtgtgtgtgttgaggatacttaagatctactttcttagcaaatttcaagtaaaccatgctgtaaata

SEQ ID NO: 26329 - DNA, 156 bp, Homo sapiens
  DXS6750
  Located on chromosome X
  Distance between a terminus base of telomere on chromosomal short arm and 5'-terminus of this base sequence : 102275238
  Distance between 3'-terminus of neighbour sequence of sequence listing upward to telomere on chrosomal short arm and 5'-terminus of this base sequence : 20887
gggaaagtgttgtgaggctaatctaaagccataataggcagatgggatggacttttgaaaaagaagtagaggagtgtgtgtgtgtgtgtgtgtgtgtgtgtgtgtcagagagagagagagagactggccaaccaatggactaacaccaagttctta

SEQ ID NO: 26330 - DNA, 280 bp, Homo sapiens
  HUMUT1690
  Located on chromosome X
  Distance between a terminus base of telomere on chromosomal short arm and 5'-terminus of this base sequence : 102317484
  Distance between 3'-terminus of neighbour sequence of sequence listing upward to telomere on chrosomal short arm and 5'-terminus of this base sequence : 42090
acacatggctggctagcttgctctatctatctatctatctatctatctatctatctatctatctatctatctattctgtctctctaatcttttctatcatctgtctccatctatctatctaatgttgatatataattcacttaccacaaacgtcacccctttagtggtctctcatatattcacaaagttgtgcaaaccttcaccattatctaattccagaacattttcatcaccctaaaaagaagccccatatccattagcagttactccccatttctcc

SEQ ID NO: 26331 - DNA, 434 bp, Homo sapiens
  chrX.fa.O7frz.105438229
  Located on chromosome X
  Distance between a terminus base of telomere on chromosomal short arm and 5'-terminus of this base sequence : 102416155
  Distance between 3'-terminus of neighbour sequence of sequence listing upward to telomere on chrosomal short arm and 5'-terminus of this base sequence : 98391
agactcttgaaagcctatttaaactggcctctttctccacaccaaaactgataaaaaggagactgattatgagccaggatttacacagagattctctatataaggcataaaggtgagggtgagagagagagagagagagagagagagagagagagagagacgtgagggagggagagaaaagagaacagacagaagataagagaagagaagggtatacagtctggtgctcaatccagtatgtgatttgcctccagcaccgtgtacaggatcccatccacttgttctgagtcatacccgatctcacgaagctccaagtgagggaggacagaagtaaggagatagctgacgtggatacgtagccgcgtaagctttgccaaagccctgtatgaaggagtgagggggcaggagaagagatgacatgaagtcattaacca

SEQ ID NO: 26332 - DNA, 230 bp, Homo sapiens
  chrX.fa.O7frz.105642927
  Located on chromosome X
  Distance between a terminus base of telomere on chromosomal short arm and 5'-terminus of this base sequence : 102626359
  Distance between 3'-terminus of neighbour sequence of sequence listing upward to telomere on chrosomal short arm and 5'-terminus of this base sequence : 209770
tagacaaacctgctaagttcacaagttagttgcctaaattctcgagatttccacccaaaccacacacacacacacacacacacacacacacgacccagtcaataaatatgtttatgagaattaaagtggccagaggatttttcaaccttaatgtgtataaagattgaaagagtcaattagatttgtaggtaacaactatctactgcctttctatggcatagtacttatgc

SEQ ID NO: 26333 - DNA, 399 bp, Homo sapiens
  AL136112.10_26857
  Located on chromosome X
  Distance between a terminus base of telomere on chromosomal short arm and 5'-terminus of this base sequence : 102696672
  Distance between 3'-terminus of neighbour sequence of sequence listing upward to telomere on chrosomal short arm and 5'-terminus of this base sequence : 70083
ttattgttagccatgttcaaactcagagaaatcccttttttatttttgggcattcctattggcaaatggtcagaagttcaatcaagtcctttagtcttactatccagagatctacaatttcttcattaaggtagcattaagcataataataataataataataataataataataatttgtaaatatttgtttcattctatctgaagagatggggtaccttgtggtgggtgcttctataaaccattgtattcctggaggcccaaatttggagggaggaatgatttgtgaattgtcatgtgtggggtgaaatatcaggaaaacctttcattacactcagaattctgtaagactagattctaagcactatggtgtagctgtgctgactacattaccagtgt

SEQ ID NO: 26334 - DNA, 266 bp, Homo sapiens
  AC004081.1_120450
  Located on chromosome X
  Distance between a terminus base of telomere on chromosomal short arm and 5'-terminus of this base sequence : 102850094
  Distance between 3'-terminus of neighbour sequence of sequence listing upward to telomere on chrosomal short arm and 5'-terminus of this base sequence : 153023
ggagctgaaaggattctaagaccctctcacaccagaactcaatctaaattatttcccccaacacacacacacacacacacacacacacacacacacacacacacacacgatggttatctttcccctgaataaaactgaatggtttgattttgaccctgggccctcccacacatattcaggtgtaatcctattaacagagttcatcctgtctcctgcctttttgtagaggaaggcagcaatttgagtgatctgtaaatgtttggatc

SEQ ID NO: 26335 - DNA, 235 bp, Homo sapiens
  AL035088.1_55775
  Located on chromosome X
  Distance between a terminus base of telomere on chromosomal short arm and 5'-terminus of this base sequence : 102934688
  Distance between 3'-terminus of neighbour sequence of sequence listing upward to telomere on chrosomal short arm and 5'-terminus of this base sequence : 84328
ccttgcttctgatccaaacccactgggaaaacagaggaacagatggctagattggtggatgaacacacgtgtgtgtgcgtgcgtgcacgcaagcatacatacacacacacacacacacacacacacacacacacacacacacacacactctgcatagtctgtcaatcagcggcctccagcacttccctgctaaagatttctgttttgatttctgtaaagtcttctgattgcagat

SEQ ID NO: 26336 - DNA, 197 bp, Homo sapiens
  chrX.fa.O7frz.106060317
  Located on chromosome X
  Distance between a terminus base of telomere on chromosomal short arm and 5'-terminus of this base sequence : 103043702
  Distance between 3'-terminus of neighbour sequence of sequence listing upward to telomere on chrosomal short arm and 5'-terminus of this base sequence : 108779
ctgtagttccagaacttaggaaggcacaagtgagaggataacttgagcccaggagttcaagacctgcctgggcaatatagtgagaccctgttctccacaaaaatgaaagagagagagagagagagagagagggagagagagagagagagagagaaccatggctccttgccttcaaaaagcttacctagcttgtagga

SEQ ID NO: 26337 - DNA, 304 bp, Homo sapiens
  chrX.fa.O7frz.106187990
  Located on chromosome X
  Distance between a terminus base of telomere on chromosomal short arm and 5'-terminus of this base sequence : 103239085
  Distance between 3'-terminus of neighbour sequence of sequence listing upward to telomere on chrosomal short arm and 5'-terminus of this base sequence : 195186
gtgcagttaagtctcagcatatactttcaggcacatgtatttgagagagagagagagagagaaagagagagagagagagagagagagagagagagagagagtgtgtgtgcgcgcgcgcgcggtgtttaggaaggggggagggagcgggggagggagggagagagagagaaagagagagagggagagagactgagttgtgtgtgtctgagaggctctgcttgtttgttgtggttgatgctgccttctgtgtggcacatcaccactgttctccccgccgaggctcctttcagctcactaatgcttc

SEQ ID NO: 26338 - DNA, 414 bp, Homo sapiens
  AL109946.12_53798
  Located on chromosome X
  Distance between a terminus base of telomere on chromosomal short arm and 5'-terminus of this base sequence : 103342187
  Distance between 3'-terminus of neighbour sequence of sequence listing upward to telomere on chrosomal short arm and 5'-terminus of this base sequence : 102798
ggaatagaggaatttcctgaaaggaataaacaagcacattttctttttctcattacatttccacaaattcattactacaaataattcttaaatgcagttacatttacatatcagggatcttgttataaaatattacccagcactggagtaagccttttatcatgggaaagtaacacacacacacacacacacacacacacacacactctctctctctctctctctctctctctctctcagcaagactgggacagagaaagctaatgattgccagacaatgagaagggagatatgagacttggaggatgttcaaaggaacgccacaatgagagttaaaaggttggaaaatatagtgctctagaatcttatcacagttgattacttgtccttcttcctattcagtcactctgtcat

SEQ ID NO: 26339 - DNA, 263 bp, Homo sapiens
  AL109946.12_58495
  Located on chromosome X
  Distance between a terminus base of telomere on chromosomal short arm and 5'-terminus of this base sequence : 103346934
  Distance between 3'-terminus of neighbour sequence of sequence listing upward to telomere on chrosomal short arm and 5'-terminus of this base sequence : 4333
tcattaactacattgcacaggagcagagcaaaacacaccaatatttcaaaactgaacaacaacgaagagacatgtttacttttatatagagattttagacacacacatccacacacacacagacacacacacacacacacacacacacaccctctttgtttactcagccagagtacagacaagataattacttggccaaatcaatcaaattattcaaacctagagtggcccagaattttttgttctaaatgactcgtcagtgc

SEQ ID NO: 26340 - DNA, 346 bp, Homo sapiens
  chrX.fa.O7frz.106482353
  Located on chromosome X
  Distance between a terminus base of telomere on chromosomal short arm and 5'-terminus of this base sequence : 103472216
  Distance between 3'-terminus of neighbour sequence of sequence listing upward to telomere on chrosomal short arm and 5'-terminus of this base sequence : 125019
gtcaattatactgcttcaacctacctatacaaaaatggacattctggttatgtccttctgtgtaaaaagcagtcacagtcacctgtcagtgtctctgaagtgtcagcacctacttggatttgaggaggaagagtgagcctcaacattcgtgccaccagccttaacacttaatcagtgcgtatatccatgtctttcctccagtttttatccttcccagacaacaggcactgtagtagtcagtgtgtgtgtgtgtgtgtgtgtgtgtgtgtgtgtgtgtattagtattcattgtcactgtgtggatgtggtttgtaattctaaagtgttatgagcatgtaaggtcatc

SEQ ID NO: 26341 - DNA, 209 bp, Homo sapiens
  chr2.fa.O7frz.87667543
  Located on chromosome X
  Distance between a terminus base of telomere on chromosomal short arm and 5'-terminus of this base sequence : 103633893
  Distance between 3'-terminus of neighbour sequence of sequence listing upward to telomere on chrosomal short arm and 5'-terminus of this base sequence : 161331
acttacaggcatctaaggttaatcatggcatctatgctgtgtatcctctttccttcttagaaaccttcagccattatttgacaaccttccctccctgctttgtctctactctctctctctctctctctctctctcacacacacacacacacacacacacacacacacacacacgcacatgcacacacctgctaggtacaaatatgctca

SEQ ID NO: 26342 - DNA, 382 bp, Homo sapiens
  chrX.fa.O7frz.106572798
  Located on chromosome X
  Distance between a terminus base of telomere on chromosomal short arm and 5'-terminus of this base sequence : 103681812
  Distance between 3'-terminus of neighbour sequence of sequence listing upward to telomere on chrosomal short arm and 5'-terminus of this base sequence : 47710
gtgaactagctcactgtgctagactgaggcctgacagaatgagactcttcagatggatgaagaagggccatagtagtgatgaaccctgcgtagttcatcaagaacagcatgaggatagaggacaggggatggagtgggtaggcatagggtcagggggaagaggttgccagaaaaggatgggttgaaagtcaagggaggagaatgatttcacatgcaagctgcctattcccaggtttccttcatcaggccttgagggaaattccttctttagcccaaagattcaaattgtatactcaaaggtgtgtgtgtgtgtgtgtgtgtgtgtgcgcatgcatatgcacgtgcgtgtgtgtgtttgtgtgttcatgcacatgtttatgtg

SEQ ID NO: 26343 - DNA, 205 bp, Homo sapiens
  AL031177.1_101496
  Located on chromosome X
  Distance between a terminus base of telomere on chromosomal short arm and 5'-terminus of this base sequence : 103771600
  Distance between 3'-terminus of neighbour sequence of sequence listing upward to telomere on chrosomal short arm and 5'-terminus of this base sequence : 89406
atccagtcaagttgacactcagtattaaccatcacacagagggagaccctgtctcaaaaaaaaaaaaaaaatgatgcagcttgtaaagctccactccatgcacatacacacacacacacacacacacacacacaccacccatgggaaaaggtcctggtcagagtcagagaagatgttattattctcaacaccttaactccaaaca

SEQ ID NO: 26344 - DNA, 269 bp, Homo sapiens
  DXS6797
  Located on chromosome X
  Distance between a terminus base of telomere on chromosomal short arm and 5'-terminus of this base sequence : 103861022
  Distance between 3'-terminus of neighbour sequence of sequence listing upward to telomere on chrosomal short arm and 5'-terminus of this base sequence : 89217
ttccctctctccctctgtctctatcatctatctatctatctatctatctatctatctatctatctatctatctatgtatcatttatctatctaaaatctatctctatcatcaatctcgatgtgtctctgttatctatcatctgtctatcttctatctctatgtgtctctatctatctgtcatctacctatcacctctctatatctatctatctatctatctatctatctatctatctatctatctatctatctggttttgggtgtgtgt

SEQ ID NO: 26345 - DNA, 212 bp, Homo sapiens
  DXS1105
  Located on chromosome X
  Distance between a terminus base of telomere on chromosomal short arm and 5'-terminus of this base sequence : 103923850
  Distance between 3'-terminus of neighbour sequence of sequence listing upward to telomere on chrosomal short arm and 5'-terminus of this base sequence : 62559
ggtttcgtgatttaccatttagacttttaatcagatgcagtgatgggtagtcaaacattggcgtgtgtgtgtgtgtgtgtgtgtgtgtgtgtagccgccctaagtagaagtctggtacttatgaaatgtttccattccccacagtgcctgcaccaatatttagcccccagagtactttcttaaatgtttttctagggggcttgaacctcaca

SEQ ID NO: 26346 - DNA, 281 bp, Homo sapiens
  AL109943.18_23480
  Located on chromosome X
  Distance between a terminus base of telomere on chromosomal short arm and 5'-terminus of this base sequence : 103932844
  Distance between 3'-terminus of neighbour sequence of sequence listing upward to telomere on chrosomal short arm and 5'-terminus of this base sequence : 8782
gtttgaaagtttggttgacctatttatagtactactttattttgacagtataagcccttagtcttctttgagtgtgatgagagtgtattcacaatgctagaaatgggaagttctgaactctgtaggatggccattaatcctggaaacacacacacacacacacacacacacacacacacacacacacacacacagatggatcatccctagtccaaaaatccaaaatccaaaatgctccaatgagcatctcctctgagtgtcacatcagtactcaggaaatg

SEQ ID NO: 26347 - DNA, 317 bp, Homo sapiens
  chrX.fa.O7frz.107114517
  Located on chromosome X
  Distance between a terminus base of telomere on chromosomal short arm and 5'-terminus of this base sequence : 104223608
  Distance between 3'-terminus of neighbour sequence of sequence listing upward to telomere on chrosomal short arm and 5'-terminus of this base sequence : 290483
tcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggct

SEQ ID NO: 26348 - DNA, 152 bp, Homo sapiens
  chrX.fa.O7frz.107213006
  Located on chromosome X
  Distance between a terminus base of telomere on chromosomal short arm and 5'-terminus of this base sequence : 104322268
  Distance between 3'-terminus of neighbour sequence of sequence listing upward to telomere on chrosomal short arm and 5'-terminus of this base sequence : 98343
gtgattcagatgttacttaaggaccaaatcctagtattttatagctgtgtatgtgtgtgtgtgtgtgtgtgtgtgtgtgtgtgtgtgtgtgtgtacccacacacacgtgcacatgtatcttcagaaaaattgaggtctacatgaataacttc

SEQ ID NO: 26349 - DNA, 408 bp, Homo sapiens
  chrX.fa.O7frz.108319798
  Located on chromosome X
  Distance between a terminus base of telomere on chromosomal short arm and 5'-terminus of this base sequence : 104514527
  Distance between 3'-terminus of neighbour sequence of sequence listing upward to telomere on chrosomal short arm and 5'-terminus of this base sequence : 192107
gagcatgaagaggttaggtaacttgcccaagataatactgcagcagaactaggactcagtttcaaggtgtctggcttcagaatttgtgctctagagcaatccacaatactgccttatgccaatataatgtgtctccttggaacaaaaaaaaaaaatcaagcttttctttataattgtttgtggtaataatttagagacaaagaaactgttcagtataaaaccactggaccccagaatactccatggatggccagaggcccaggaaaattcaccaaaaggagaaatggtgcacacacacacacacacacaaattaaattttcttaaaagtgatatttgattacttctgatcctggcaaaatggagtaggcttactttccattattccttccgcttaagtacaagtaaaa

SEQ ID NO: 26350 - DNA, 361 bp, Homo sapiens
  AL034403.18_18999
  Located on chromosome X
  Distance between a terminus base of telomere on chromosomal short arm and 5'-terminus of this base sequence : 104643445
  Distance between 3'-terminus of neighbour sequence of sequence listing upward to telomere on chrosomal short arm and 5'-terminus of this base sequence : 128510
gattacaggaaagctgaatgatagacttatatccttatcactgggggcaagagatcaagggagccaagtttaatgttttctaaataaaatagttttaaaatgacagtactagttacaggatcttggggataataaggagtcttgaaaaaaaatctgttctagcacccttgccctcaaatcttcagagagtgtatttatttactctctgttcattgaggatgtatctgctgctttgtgtgtgtgtgtgtgtgtgtgtgtgtgtgtgtgtgtgtgtgtgttacaacagaaccaacatagtttctcagaatgttggccttaatgactctactgctgtgttaagtgtaatggatactggttctgg

SEQ ID NO: 26351 - DNA, 204 bp, Homo sapiens
  DXS1210
  Located on chromosome X
  Distance between a terminus base of telomere on chromosomal short arm and 5'-terminus of this base sequence : 104643614
  Distance between 3'-terminus of neighbour sequence of sequence listing upward to telomere on chrosomal short arm and 5'-terminus of this base sequence : -192
gccctcaaatcttcagagagtgtatttatttactctctgttcattgaggatgtatctgctgctttgtgtgtgtgtgtgtgtgtgtgtgtgtgtgtgtgtgtgtgtgtgttacaacagaaccaacatagtttctcagaatgttggccttaatgactctactgctgtgttaagtgtaatggatactggttctggagtttcacatga

SEQ ID NO: 26352 - DNA, 249 bp, Homo sapiens
  chrX.fa.O7frz.108065511
  Located on chromosome X
  Distance between a terminus base of telomere on chromosomal short arm and 5'-terminus of this base sequence : 104769002
  Distance between 3'-terminus of neighbour sequence of sequence listing upward to telomere on chrosomal short arm and 5'-terminus of this base sequence : 125184
tagtttggtgctaagatgctaagagccttccaaacagaaggaacaacatgcagaaagacccagaggtaaagatagatagatagatagatagatagatagatagatagatagatagatagacagactatatatatatgtgtgtgtgtatatatgtgcgtgtgtatatatatgtgtatatatatatgtgcgtgtatatatgtatgtgtgtgtgtgtatacatatatatatggattcttagaattctaaagc

SEQ ID NO: 26353 - DNA, 368 bp, Homo sapiens
  AL031387.4_519
  Located on chromosome X
  Distance between a terminus base of telomere on chromosomal short arm and 5'-terminus of this base sequence : 104840697
  Distance between 3'-terminus of neighbour sequence of sequence listing upward to telomere on chrosomal short arm and 5'-terminus of this base sequence : 71446
cagctatgtaggtcagtctagctttctagggaagcagtaaaaggtagaaaaatgtattgttggaataatgtgtcagatggaggggtcttaggacacaacataaatctgggattgtggtatatgcattctttagagagagagctttcaaaattttcactatgacccacagtgagaagtatattttacatcacaacccggtatacagatgcacaagtaaacctatatatgtgggtgtatgtgtgtgtgtgtgtgtgtgtgtgtgtgtgtgtataatgtccaaaataaaactcacgtttaccacttgcagtgtggtccttgcattttctatttcattctattattttttttaaatgctggtcataagttgc

SEQ ID NO: 26354 - DNA, 243 bp, Homo sapiens
  Z66807
  Located on chromosome X
  Distance between a terminus base of telomere on chromosomal short arm and 5'-terminus of this base sequence : 105019895
  Distance between 3'-terminus of neighbour sequence of sequence listing upward to telomere on chrosomal short arm and 5'-terminus of this base sequence : 178830
accacagtgctttggagacttagtaaagaaaatgaatgcactctcctgaatcacaatatcacctggaaatgtaaccagaaggtataaaaagtcagggtagtttgttaaattgtgtgtgtgtgtgtgtgtgtgtgtgtgtgtgtgtgtgtgtgtgtgtgtgtgtaatcaacaatttataaggttaccttatctctggggtcagcactttttctgtaaaggtccagagagaaaattggcttcacg

SEQ ID NO: 26355 - DNA, 122 bp, Homo sapiens
  G08113
  Located on chromosome X
  Distance between a terminus base of telomere on chromosomal short arm and 5'-terminus of this base sequence : 105090661
  Distance between 3'-terminus of neighbour sequence of sequence listing upward to telomere on chrosomal short arm and 5'-terminus of this base sequence : 70523
gcttccttagatggcattcaatagatagatagatagatagatagatagatagatagatagatagataaaaataagcatgaacaccgttaaaaataaagtaggagacttctgattcttggaag

SEQ ID NO: 26356 - DNA, 174 bp, Homo sapiens
  chrX.fa.O7frz.107677126
  Located on chromosome X
  Distance between a terminus base of telomere on chromosomal short arm and 5'-terminus of this base sequence : 105164964
  Distance between 3'-terminus of neighbour sequence of sequence listing upward to telomere on chrosomal short arm and 5'-terminus of this base sequence : 74181
cctaggtggcatgtaaatagtattagtacttttgagccatggtctctaaataaaatagcatgtaaaaaaaaaatatatatatatatatatattggccaggcatggtggctcatgcctgtaatcccagcgctttgggaggcagaggcgggcggatgatctgaagtcaagagtttg

SEQ ID NO: 26357 - DNA, 213 bp, Homo sapiens
  DXS6749
  Located on chromosome X
  Distance between a terminus base of telomere on chromosomal short arm and 5'-terminus of this base sequence : 105245674
  Distance between 3'-terminus of neighbour sequence of sequence listing upward to telomere on chrosomal short arm and 5'-terminus of this base sequence : 80536
aaaaagtttgcagatccctggcttagaccactttgggatctggtcccaaaaaagtgattaatgcctcctcctccctgctcttcttctcttcctttccctttcctgcgctgacacatacagacagacccacagacagatacacacacacatgtacacacacacacacacacacacacactactgaaaggaaaccagtactggctggaaacagaa

SEQ ID NO: 26358 - DNA, 205 bp, Homo sapiens
  Z66835
  Located on chromosome X
  Distance between a terminus base of telomere on chromosomal short arm and 5'-terminus of this base sequence : 105409118
  Distance between 3'-terminus of neighbour sequence of sequence listing upward to telomere on chrosomal short arm and 5'-terminus of this base sequence : 163231
tggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacc

SEQ ID NO: 26359 - DNA, 375 bp, Homo sapiens
  chrX.fa.O7frz.109702957
  Located on chromosome X
  Distance between a terminus base of telomere on chromosomal short arm and 5'-terminus of this base sequence : 105509746
  Distance between 3'-terminus of neighbour sequence of sequence listing upward to telomere on chrosomal short arm and 5'-terminus of this base sequence : 100423
tggatcctgtaatcaagtgtaggatatcatagtgccaaactctagaaaaccccactgtaaaatgtggaaaaaccataattcttcctgcaacggaatagaaaatacacacacacacacacacacacacacacacacacacacagtgtgtgttccttatacttttaaaagaaaccacttcctgattaagaaaaacaaacatacctctgattgcctactatattaatggcactactggtattcataacatccatcttcaaatgtcctagatagtagccaggcttagaaatattttcatggatttatcctcagaggttacaaactcagactctacaaactgcttgggtcataacatagttccatagacttggaaagaat

SEQ ID NO: 26360 - DNA, 339 bp, Homo sapiens
  HUMUT2330
  Located on chromosome X
  Distance between a terminus base of telomere on chromosomal short arm and 5'-terminus of this base sequence : 105785213
  Distance between 3'-terminus of neighbour sequence of sequence listing upward to telomere on chrosomal short arm and 5'-terminus of this base sequence : 275092
ttctcttttcaatttggatagctttcatttctcccttttcttttcttctttctttcttgctttctctctttcttgctctttctttctttcttttctctctttctttctttcttttctttctttctttcttttctttctttctttctttctttctttctttctttctttctttctttctttctttctttctttctttcttccttccttccttccttccttccttccttccttccttcctttcttttctttctttctctctctctctctctctctctctttctttctttctttctctctttcttccttgcttaattgctctggctgggactttcaatacta

SEQ ID NO: 26361 - DNA, 384 bp, Homo sapiens
  chrX.fa.O7frz.110028657
  Located on chromosome X
  Distance between a terminus base of telomere on chromosomal short arm and 5'-terminus of this base sequence : 105966708
  Distance between 3'-terminus of neighbour sequence of sequence listing upward to telomere on chrosomal short arm and 5'-terminus of this base sequence : 181156
ctttgccttaggatctagttactagtctccacattatggaatcactgccacctctgggacggagggagcagccgcataacaccttcccccctttaccacacacacacacacacacacacacacacacacacacacacacacacaaactaatgctttgtgacctctcaaccgggatgtactgcttctctcttccaaggagaacgtgtgtgatgtgctggtgagagtcttgtcccaagaaaccctggccataaggcccttgtgtctctttcataagaattgactcctttatgccaggttgtcataaagactgaacattttacattttcccctattggtatcaaaccctcttaggaaagaattctctcacctatagtcatggaatga

SEQ ID NO: 26362 - DNA, 197 bp, Homo sapiens
  Z66652
  Located on chromosome X
  Distance between a terminus base of telomere on chromosomal short arm and 5'-terminus of this base sequence : 106037206
  Distance between 3'-terminus of neighbour sequence of sequence listing upward to telomere on chrosomal short arm and 5'-terminus of this base sequence : 70114
gggcactatgctaactcctttagataccttaattcagttaatcctcacaacagtcctttgagataggaactatcattgtcccatttctccctctctctcattcacacacacacacacacacacacacacacacacatacataccacacaatgtcacccactccaacatacatgctcacccacacgcttacatacact

SEQ ID NO: 26363 - DNA, 298 bp, Homo sapiens
  AL049176.3_101912
  Located on chromosome X
  Distance between a terminus base of telomere on chromosomal short arm and 5'-terminus of this base sequence : 106039593
  Distance between 3'-terminus of neighbour sequence of sequence listing upward to telomere on chrosomal short arm and 5'-terminus of this base sequence : 2190
gcactctacagcttagaaatcaatgcctcaaatgcctacttactaattccaagagcccacttagaggacaaggagcacacctttctctaggttttggtactgctattctttgtgacaaaaagacccaaaaaccaaaaaccaaaaaaaaaaaaatcaaaacaaaacacacacacacacacacacacacacaaaaccaaacatcaagaagaccaaaacaatgcaaacaagtagacaaatataacagtcccccaaattgccatatgcacatacagaatcctatgcttggttgtaatcttgc

SEQ ID NO: 26364 - DNA, 412 bp, Homo sapiens
  chrX.fa.O7frz.110226268
  Located on chromosome X
  Distance between a terminus base of telomere on chromosomal short arm and 5'-terminus of this base sequence : 106107359
  Distance between 3'-terminus of neighbour sequence of sequence listing upward to telomere on chrosomal short arm and 5'-terminus of this base sequence : 67468
gtctttactagtttgtggcagttgtgttgagctatgtgcagtggttctcaagctttgctgcatgctataattactttgggagctttgctttttaaaattgtaatgcccagaccaattaaatcagaatgtctggttgaggacctaggcatattgatgtgtgtgtgtgtgtgtgtgtgtgtgtgtgtgtgtgtgtgtaaaagtattaatattgaccaggccctctgctagatgactcagggagcactagaaaagccgtttgcccacatctggcttctctctcaccttctagatccttagggtgaaggcactgcaaaggaggtaaaacaatatgccattatcaatcattaacatcttagaggaaattgttccagacccttgccagtgtgacagctagcttaacaggaatttgtca

SEQ ID NO: 26365 - DNA, 262 bp, Homo sapiens
  Z67007
  Located on chromosome X
  Distance between a terminus base of telomere on chromosomal short arm and 5'-terminus of this base sequence : 106278898
  Distance between 3'-terminus of neighbour sequence of sequence listing upward to telomere on chrosomal short arm and 5'-terminus of this base sequence : 171127
tgaggccagtttaccccttcatgctcagagcctgaatcacaaattcatgggctgtattaaatgctttccccacttattttatcagattcttagaaccagagaaggaacctaatagaatatctggttcaactcattcacattttctagatagggagactgaggccaaaagaaaggggtcttgatttcattttcaccaagtgtacgcgtgtgtgtgtgtgtgtgtgtgtgtatgtgtgtgtccattcgtgtgttgcatgagtgg

SEQ ID NO: 26366 - DNA, 328 bp, Homo sapiens
  AL031117.1_139247
  Located on chromosome X
  Distance between a terminus base of telomere on chromosomal short arm and 5'-terminus of this base sequence : 106645108
  Distance between 3'-terminus of neighbour sequence of sequence listing upward to telomere on chrosomal short arm and 5'-terminus of this base sequence : 365948
actcaatgaactatcagctagcacaagagttgctcctcctgtgactgtcagtgaaagctgaggcagacagacagacagagagagagagagagagagagagagagagagagagaggaggcaatgccttctgggtaacaaatttcagaagacttttgtgtcaactggcttaagtagaggtagaaagatgtcctacacaatggtgttttagaggcaattaagcatcaactctgtactgaagaaggaaaaaaagagagtaaattgaaaccccaaagttgagataatgtctggcttggccatttctcaagtgtcagcttcatatgcctagaaa

SEQ ID NO: 26367 - DNA, 332 bp, Homo sapiens
  AL035067.2_19977
  Located on chromosome X
  Distance between a terminus base of telomere on chromosomal short arm and 5'-terminus of this base sequence : 106730399
  Distance between 3'-terminus of neighbour sequence of sequence listing upward to telomere on chrosomal short arm and 5'-terminus of this base sequence : 84963
cttgagcctaggaatttgaaaccagcttgggcaacagagggagaccccgttctacaaaaaataaaaagctgggcatggtggctcatgcctataatcccagctacatgggaggctgaggcaggagggtcacttgagcccaggaactccaggctacagtgagctgtgatcataccattgtactccagcctgggtgacagagtgagactttacctcaaaacacatacacacacacacacacacacacacacacacacacacacacacacacgcaaactgctgctttatagctccatgccccctttatgttgttattgtcacaaattgcatcttta

SEQ ID NO: 26368 - DNA, 191 bp, Homo sapiens
  AL049563.4_59750
  Located on chromosome X
  Distance between a terminus base of telomere on chromosomal short arm and 5'-terminus of this base sequence : 107075050
  Distance between 3'-terminus of neighbour sequence of sequence listing upward to telomere on chrosomal short arm and 5'-terminus of this base sequence : 344319
caactttattgaggcacaatttacacagaataaaattcaaccatttaaagtgtttgatgagttttgacaggtatatatacccatgtaacaatcattataatcaacacacacacacacacacacacacacacacacacatcagtgtacatttctaggagttttaagagctgcattgactgatgtaactgtta

SEQ ID NO: 26369 - DNA, 352 bp, Homo sapiens
  chrX.fa.O7frz.108840302
  Located on chromosome X
  Distance between a terminus base of telomere on chromosomal short arm and 5'-terminus of this base sequence : 107190431
  Distance between 3'-terminus of neighbour sequence of sequence listing upward to telomere on chrosomal short arm and 5'-terminus of this base sequence : 115190
tattgcggtatcttagtgtgatgtcaatttgcatttctttgattactaataatgttgaggatgttttcatgtgcttattagctcttcatttgaattgtctgttcagatcttttggccatttttaagttgggttgtttgtctttttattattgagttgtaggggttcttatatatatatatatatatatatatagacacacacgcgtgtgtgcgcacacacacacatatatctgacaatgaactttatatattctggttgaaagttcattgtcagatatatattttgtgaatattttctctcagtctctgggttgcctgttcattttattaactgtatgatttgatgagtttg

SEQ ID NO: 26370 - DNA, 369 bp, Homo sapiens
  AC005191.1_132988
  Located on chromosome X
  Distance between a terminus base of telomere on chromosomal short arm and 5'-terminus of this base sequence : 107261262
  Distance between 3'-terminus of neighbour sequence of sequence listing upward to telomere on chrosomal short arm and 5'-terminus of this base sequence : 70479
gtatacatatgtaacaaacctgcacattgcgcacatgtaccctaaaacttaaagtataataaaataaaataaaataaaataaaataaaataaaataaaataaaataaaaacaacaaaaaaaataaataaataacaaaacaaaacaaaaaaaattgccacagccacttcaaccttcagcaacccccacccttatcagtcagcctgatcagtcagcagtcatcaacattgtggcaggaccctccaccagcaaaaagattatgacttgctgaaaactcagataatcgttaacattttttagcaatacagtattttaaaattaaggtttgtatattgttttttaacataatgttattgcatacttaataggct

SEQ ID NO: 26371 - DNA, 180 bp, Homo sapiens
  DXS8110
  Located on chromosome X
  Distance between a terminus base of telomere on chromosomal short arm and 5'-terminus of this base sequence : 107308652
  Distance between 3'-terminus of neighbour sequence of sequence listing upward to telomere on chrosomal short arm and 5'-terminus of this base sequence : 47021
ccctgagacaccaattacattacaatgtacagagaagcacctctggaaggttggagtgtgtgtgtgtgtgtgtgtgtgtgtgtatctcaaggagagactggcccaacaatatcaactttaatagcaattcagtctttcttacctgtgtttctcttatatagtccaaggtaaggatgagct

SEQ ID NO: 26372 - DNA, 347 bp, Homo sapiens
  AL031388.1_58618
  Located on chromosome X
  Distance between a terminus base of telomere on chromosomal short arm and 5'-terminus of this base sequence : 107372529
  Distance between 3'-terminus of neighbour sequence of sequence listing upward to telomere on chrosomal short arm and 5'-terminus of this base sequence : 63697
cataaacagtttcacttaatgcagaatccgtttctcttatttgctgagttggaaagaggcaattcattgcattttggtaacatagtaataaatagaaagtttaacagacgaacctgggtgctttggaagcacaaattcacctcctgctcccctctgttacaaaagcagagccaagattgtatggggttgattgaggtccttgaaaaactacatacacacacacacacacacacacacacacacacacacacacacacagattttctctctctccctatgtatattgtgaaagtttatgaaaacagcatcttccagggaccaaaatgtggattttaggtgacattcaa

SEQ ID NO: 26373 - DNA, 190 bp, Homo sapiens
  DXS1059
  Located on chromosome X
  Distance between a terminus base of telomere on chromosomal short arm and 5'-terminus of this base sequence : 107375093
  Distance between 3'-terminus of neighbour sequence of sequence listing upward to telomere on chrosomal short arm and 5'-terminus of this base sequence : 2217
ggacaacccgtcgtggttgtgatgtggggtgtgtgtgtgtgtgtgtgtgtgtgagagagagagagagagagagagagagagagagagaaagagagagagagagagagagagagattgagacaaccgtggtaggcaaaagcacccctcacctcccccagcccccgggccgaagccactctcaatctcctgg

SEQ ID NO: 26374 - DNA, 270 bp, Homo sapiens
  chrX.fa.O7frz.111091957
  Located on chromosome X
  Distance between a terminus base of telomere on chromosomal short arm and 5'-terminus of this base sequence : 107472738
  Distance between 3'-terminus of neighbour sequence of sequence listing upward to telomere on chrosomal short arm and 5'-terminus of this base sequence : 97455
acaaagtcagtaatgcgataatgcatctttgtggagtcaaatttgcaagaaaaatgcataaaatgaactagaattctccttaaaatagtagcctgtccctttctttctttctttctttctttctttctttctttctttctttctttctttctttctttctttcttttttctatacctatgaaattcttaaaggatcttgtcatacagtggattctcagtaaatgtttatttattaaacttttttttttgttcagttgaccatgtatgatt

SEQ ID NO: 26375 - DNA, 255 bp, Homo sapiens
  AL031176.7_21701
  Located on chromosome X
  Distance between a terminus base of telomere on chromosomal short arm and 5'-terminus of this base sequence : 107573925
  Distance between 3'-terminus of neighbour sequence of sequence listing upward to telomere on chrosomal short arm and 5'-terminus of this base sequence : 100917
ccacagatcaacatttccttcctctcagtttgtctcagacaagtttgtccaggatgagtgttggctgtgtctcttataatatgcattttgcaaacaagatgtgagccaaattcatgaatatagatatatgtatgtttgtacacacacacacacacacacacacacacacacacacacacacatgcacacattgatggggtggtggggtggaaaagagaagaaataatagtgatgtttggaattgttttcaacaga

SEQ ID NO: 26376 - DNA, 407 bp, Homo sapiens
  HUMUT583B
  Located on chromosome X
  Distance between a terminus base of telomere on chromosomal short arm and 5'-terminus of this base sequence : 107966491
  Distance between 3'-terminus of neighbour sequence of sequence listing upward to telomere on chrosomal short arm and 5'-terminus of this base sequence : 392311
ctacagtgagctatgattgcaccactgcactccagcctgggtgaaagagcaagaacttgtatgaaagaaaggaagaaagaaagaaaggaaagaaagaaagaaagaaagaaagaaagaaagaaagaaagaaagaaagaaagaaagaaagaaagaaagaaagaaagaaaggaagggaaagaaagagagaaagaaagaaagaatctaggctttaccactcactagctgtcatcttaaatcagtgtaccatgcttgaagaaggttacgtaaaaatctttgccaattctacaaaggattaaagcctgaacctttgcagttttcaggatattacagaaaagagaatagcaataatttggtgaaaaaaaatatttcttagctctattagttctcttcatgtctaggaatatctg

SEQ ID NO: 26377 - DNA, 255 bp, Homo sapiens
  Z67442
  Located on chromosome X
  Distance between a terminus base of telomere on chromosomal short arm and 5'-terminus of this base sequence : 108044165
  Distance between 3'-terminus of neighbour sequence of sequence listing upward to telomere on chrosomal short arm and 5'-terminus of this base sequence : 77267
cactggctctctcactaacttgttgtagaaattcagaaaagtcacttaacaacttaatggttgttgagcagaagcaatgagaaaatagttgtaacgtgttccaaaaattattaggcattatacaaagaatacacacacacacacacacacacacacacacacacacacacacacacagagccctcagaagaaaaggtaggctcatctcctcaattttatttcttccaaattgtcttacattggcaaaaagcaatt

SEQ ID NO: 26378 - DNA, 273 bp, Homo sapiens
  DXS1072
  Located on chromosome X
  Distance between a terminus base of telomere on chromosomal short arm and 5'-terminus of this base sequence : 108099556
  Distance between 3'-terminus of neighbour sequence of sequence listing upward to telomere on chrosomal short arm and 5'-terminus of this base sequence : 55136
gcccgactgaataatccaagatgattgcctcatctcaagatccttaatttaattacatctgcaaagtctctttttctaaataaggtcacattcacatgttctggagattaggatgtgaacatatctttctgggaacaaccattcaaaccactaccgtgtgtgtgtgtgtgtgtgtgtgtgtgtgtgtgtgtgtgtgtttgcggggggagggggggcacaggcagggaagtctgtttatagatttttaccagattctctgggggctgtgataaa

SEQ ID NO: 26379 - DNA, 185 bp, Homo sapiens
  DXS6804
  Located on chromosome X
  Distance between a terminus base of telomere on chromosomal short arm and 5'-terminus of this base sequence : 108108403
  Distance between 3'-terminus of neighbour sequence of sequence listing upward to telomere on chrosomal short arm and 5'-terminus of this base sequence : 8574
cccagatattttgaccaccatatatattttcttttctccctagcaatatctatctatctatctatctatctatctatctatctatctatctatctatcaatgtgtggtgggactctagtgttctataaaacacagaagcacagtgtgtaggtagcgtcttggcttggttatagcaaccacatgcc

SEQ ID NO: 26380 - DNA, 140 bp, Homo sapiens
  Z66710
  Located on chromosome X
  Distance between a terminus base of telomere on chromosomal short arm and 5'-terminus of this base sequence : 108126462
  Distance between 3'-terminus of neighbour sequence of sequence listing upward to telomere on chrosomal short arm and 5'-terminus of this base sequence : 17874
aggctatgtttaggctatgcttctgacctctcttgttccctctctctgtctctctctctctgagtgtgtgtgtgtgtgtgtgtgtgtgacagagtctctctctgccacgcaggtgtgtgtgtggtgacagagtctcgctc

SEQ ID NO: 26381 - DNA, 479 bp, Homo sapiens
  AC002072.1_29092
  Located on chromosome X
  Distance between a terminus base of telomere on chromosomal short arm and 5'-terminus of this base sequence : 108197475
  Distance between 3'-terminus of neighbour sequence of sequence listing upward to telomere on chrosomal short arm and 5'-terminus of this base sequence : 70873
tagctctgaaactccatcagactattaggccagggactttctctgtcttatttacccaatgcatcatctgtgcatacatcaaagagcagttgcaaagtttaaaagaattaatacccttgcctagcacagtacctggcaaattgtaaacattcaatatatatttgtgtgtgtgtgtgtgtgtgtgtgtgtgtgtgtgtgtgtgtgtgtgtgtttgacagactttcgccatgtcgcccaggctggagtgcagtgatgcgatcttggctcactgcaacctctggctactgggttcaagtgattcttgtgcctcagcctcccaagtagctaggactacgggcatatgccaccacacctggttgattttttttggtatttttgtagagacgagagttccccatgttgcacaggctggtctcgaactcctgacctcaagtgatcctcccgccttggcctcccaaaatgttggtattacaggcatg

SEQ ID NO: 26382 - DNA, 371 bp, Homo sapiens
  AL023876.2_42789
  Located on chromosome X
  Distance between a terminus base of telomere on chromosomal short arm and 5'-terminus of this base sequence : 108269417
  Distance between 3'-terminus of neighbour sequence of sequence listing upward to telomere on chrosomal short arm and 5'-terminus of this base sequence : 71463
tttacctaggtaacaaacctgtacgtcctgcacacgtatcccataacttaaaataaaataaaataaaataaaataaaataaaataaaataattttttttaaaaaaagaaaaggctttcagttttccccactcagtatgatactagctgtgtgtctgtcatgcacggattttattatattgaggtatgttccttctatatccaattctttgagggtttttatcacattttatcaaatatttttcagcatcaattgaaataatcatatagtttttatccttcattctgttgacatgatatatcacactgattgatttgcacattttgaatcatccttgcatcctagagataaatctcatttggtcacgtgaat

SEQ ID NO: 26383 - DNA, 299 bp, Homo sapiens
  chrX.fa.O7frz.112003211
  Located on chromosome X
  Distance between a terminus base of telomere on chromosomal short arm and 5'-terminus of this base sequence : 108372667
  Distance between 3'-terminus of neighbour sequence of sequence listing upward to telomere on chrosomal short arm and 5'-terminus of this base sequence : 102879
agcatatggtagaagtgatgttatgtcatttcagagattaagttatacaagactgagccttctgtctttggtgttctctgtctctctctctctctctctctctctctctctctctctctctctctctctcagaagatatgctgttggggaaaccatgccatgtgcagctctatggaaaagcctacatggcaaggaactgaaacctcctggcaacagtcacataaatgtgattgtaaatggatgcttcagcccctttggagagtgcctccctggtggatagcttgactaccactttatgg

SEQ ID NO: 26384 - DNA, 412 bp, Homo sapiens
  chrX.fa.O7frz.114508264
  Located on chromosome X
  Distance between a terminus base of telomere on chromosomal short arm and 5'-terminus of this base sequence : 108509254
  Distance between 3'-terminus of neighbour sequence of sequence listing upward to telomere on chrosomal short arm and 5'-terminus of this base sequence : 136288
tcttcctctgctagaaggttacagagttcagaacaaattttatttgccgcctcacctccacccacacacacagatgaaacttcaaaggagaaaagaaatacataaatgcaaaaatgcgtaaaaattctagacatagtgccctggttatagaggtaaagattagaggtacagattacggaatgattttaatatatatgggtcttcctttttaatctaggtctctcagagtcattttaactttccccaaccccagccaccacactgagtgccaatatcattgccacttctctcaacttcaacacacacacacacacacacacacacaccattcatacccatgtacccacgtacatactttataccaacttttctttaattcacttacccatagagtagccttgctttaattgtc

SEQ ID NO: 26385 - DNA, 241 bp, Homo sapiens
  DISO7_10004751
  Located on chromosome X
  Distance between a terminus base of telomere on chromosomal short arm and 5'-terminus of this base sequence : 109211458
  Distance between 3'-terminus of neighbour sequence of sequence listing upward to telomere on chrosomal short arm and 5'-terminus of this base sequence : 701792
ttgcttatctgctactttagttctctcatataatttttatctcttcattattatgttttaattttcttggttgtttttccacccatttttattggggtaaaacttacatatatgtaaacattatatatatatatatatatatatatatatatatatatatatacacataaaacaaattataaaataaattacaccagttttaggtatacaattgtatgcaataatataatgagcaatgacc

SEQ ID NO: 26386 - DNA, 224 bp, Homo sapiens
  AC002449.1_44207
  Located on chromosome X
  Distance between a terminus base of telomere on chromosomal short arm and 5'-terminus of this base sequence : 109346118
  Distance between 3'-terminus of neighbour sequence of sequence listing upward to telomere on chrosomal short arm and 5'-terminus of this base sequence : 134419
tgtccttcgtattagtcaaggtgccccagagaaacagaaccaatagggtgtgtgtgtgtgtgtgtgtgtgtgtgtgtgtgtgtgtgtagataggaatttattttaatgaattgttttacttgatttgtggggtctggcaactctgaaatcttcagagcaggccaatggagtggagactcagagaagagctgatgttgcacctcaagtcagaagttattctggag

SEQ ID NO: 26387 - DNA, 257 bp, Homo sapiens
  AC003014.1_48837
  Located on chromosome X
  Distance between a terminus base of telomere on chromosomal short arm and 5'-terminus of this base sequence : 109417473
  Distance between 3'-terminus of neighbour sequence of sequence listing upward to telomere on chrosomal short arm and 5'-terminus of this base sequence : 71131
ctctgctatttgcaaagcatactctgtgtgtgtgtgtgtgtgtgtgtgtgtgtgtgtgtgtgtgtgtgtgtagtcatgcatttcttaatgatggggatacattctcagaaatgcatcattaggtcatttcattgtgtgaacatcatagagtgtacttacacaaacctagatggtatagcctactacccacctaggctatatgttatagtctattgctcctaggctacaaacctgtacagcatgtgactgtactgaat

SEQ ID NO: 26388 - DNA, 308 bp, Homo sapiens
  AC003014.1_48459
  Located on chromosome X
  Distance between a terminus base of telomere on chromosomal short arm and 5'-terminus of this base sequence : 109417708
  Distance between 3'-terminus of neighbour sequence of sequence listing upward to telomere on chrosomal short arm and 5'-terminus of this base sequence : -22
acagcatgtgactgtactgaatactttagataactaatacaatggtaagtgtttgtgtatgtaaacatatctaaacctacaaatggtacaaaaaatacagtattataatcttatgggaccactgccatatatggggccatatatacatacacatagatatatatatatgtatgtatatatgtatatacgtgtgtgtgtgtgtgtgtgtgtgtgtattcacctggacccagttctaagtattcaagaggtggtacacaatagttgattaataaatatttgtttgagtgaataagtgaaagaacaggttc

SEQ ID NO: 26389 - DNA, 247 bp, Homo sapiens
  AC004998.2_1388
  Located on chromosome X
  Distance between a terminus base of telomere on chromosomal short arm and 5'-terminus of this base sequence : 109619127
  Distance between 3'-terminus of neighbour sequence of sequence listing upward to telomere on chrosomal short arm and 5'-terminus of this base sequence : 201111
actgctctgaacatccttaagtagatacatcatggtcagaacaaaaaccatcaactgtcatgatattaagtattttagaaaagttaggtgtgtgtgtgtgtgtgtgtgtgtgtgtgtgtgtgtgtgtagggtgagtgaataggagagagttattcatgaaagatcactgagccaggattaagaaagcatgctttccctacagagactaccagtgtgttattatgtgaactcaggctaatgatttaat

SEQ ID NO: 26390 - DNA, 207 bp, Homo sapiens
  chrX.fa.O7frz.114755198
  Located on chromosome X
  Distance between a terminus base of telomere on chromosomal short arm and 5'-terminus of this base sequence : 109915060
  Distance between 3'-terminus of neighbour sequence of sequence listing upward to telomere on chrosomal short arm and 5'-terminus of this base sequence : 295686
tgttctacgcatcctaatattaagctttctcaacataagtagaaagtgacatatgactttgaacagaaattttcagtatcacacagatgtgtgtgtgtgtgtgtgtgtgtgtgtgtagacggaaagagacacacaaaaaagagagaggtgaagaggtggaaaaagagagaaccatgcataatggtaacttaggttactgctacagga

SEQ ID NO: 26391 - DNA, 384 bp, Homo sapiens
  chrX.fa.O7frz.114843961
  Located on chromosome X
  Distance between a terminus base of telomere on chromosomal short arm and 5'-terminus of this base sequence : 110003755
  Distance between 3'-terminus of neighbour sequence of sequence listing upward to telomere on chrosomal short arm and 5'-terminus of this base sequence : 88488
gagaactccttatcaccagaacggcataggggaaactgcctccatgatccaatcacctcccatcaggtccctcccttgacatgcagggatcacaattcgagatgagatttgggtgggaacacagaggcaaaccatctcatttgctgacaatgctttgtgtgtgtgtgtgtgtgtgtgtgtgtgtgtgtgtgtgtgaaaaaacagcaaatcaggttgatggctattgttgtgtgtgtcctagctgggatggcccatatttaaaagtcccccactgaacaacgtagtgcttgtgggtcgttaattataatgttgaagtgtttttgcacaactaaaacagagcttgccatgtgtcatgcccaagttaacaatcactttactattgcc

SEQ ID NO: 26392 - DNA, 336 bp, Homo sapiens
  chrX.fa.O7frz.114944576
  Located on chromosome X
  Distance between a terminus base of telomere on chromosomal short arm and 5'-terminus of this base sequence : 110104393
  Distance between 3'-terminus of neighbour sequence of sequence listing upward to telomere on chrosomal short arm and 5'-terminus of this base sequence : 100254
atcacatgatcttatgtaaggaacttgagcattgataaattatggtaatttcagtgggttctagaactaatcttccaaggatactgtatgtatgtatatgtgtgtgtatatatatatatatatatatatatacacacacacacacacacacacatatatgcccatacacacacatacatgcacacatacacataatcttgtctctctgtctatatataacatatatataaatttaaaaatgtattaacataaaaattcacacacaaatgttcacaacagcataatttccaatagtctaaaaatgaaaacaagccaagtgtccagttgatcaatgta

SEQ ID NO: 26393 - DNA, 323 bp, Homo sapiens
  MX_110227520
  Located on chromosome X
  Distance between a terminus base of telomere on chromosomal short arm and 5'-terminus of this base sequence : 110227443
  Distance between 3'-terminus of neighbour sequence of sequence listing upward to telomere on chrosomal short arm and 5'-terminus of this base sequence : 122714
tgactgtcttttctcctacccttatatcttttaatcttatatatatttaatttttcagttttagaatatttatttaagtgtgtgtgtgtgtgtgtgtgtttcaattctctggtgaaattctccaccttttcatttatttttccatattttcctctattttattgagttataaaatagttattttatagtcattcttggaacccatgtcctgggtgtgtcccagactctaatctttgtatagtgaactttacactacttttcacaaccttgacctatatcataaaaggcaaaatgagggcaaaatcagctgtgtgcttgagatg

SEQ ID NO: 26394 - DNA, 327 bp, Homo sapiens
  DXS6805
  Located on chromosome X
  Distance between a terminus base of telomere on chromosomal short arm and 5'-terminus of this base sequence : 110518990
  Distance between 3'-terminus of neighbour sequence of sequence listing upward to telomere on chrosomal short arm and 5'-terminus of this base sequence : 291224
acagcaagaagatggctgtcaatgaaccaagaagcaggccctcaccagacactatatgtgccagcacctttaacttggacattccagcctccagaattgtaggatatagatagatagatagatagatagatagatagatagatagatagatagaaatctgtctatctatcatagggagatatctttataagctctcagtctatagtagttttgttatagcagccctaatgtactaagataccatgttcgttggaatctgagtgataatgcttctgagatgcagtatagcagactaagtaaagaagtggattctggagtcatgctgct

SEQ ID NO: 26395 - DNA, 226 bp, Homo sapiens
  DXS8081
  Located on chromosome X
  Distance between a terminus base of telomere on chromosomal short arm and 5'-terminus of this base sequence : 110529373
  Distance between 3'-terminus of neighbour sequence of sequence listing upward to telomere on chrosomal short arm and 5'-terminus of this base sequence : 10056
gatcctctgaccctcatttctaaatagggataatatgtcattctgctgttgtgagacttatatttgaatttttcacctgaatgcccctactcacacacacacacacacacacacacacaggtttgccacctcaaagtaccttcacttgccattttccccaccatccttatttcagtcaatgtaccctatagctcatttcagaaacctccactgcaaagtcctatca

SEQ ID NO: 26396 - DNA, 354 bp, Homo sapiens
  chrX.fa.O7frz.115750251
  Located on chromosome X
  Distance between a terminus base of telomere on chromosomal short arm and 5'-terminus of this base sequence : 110655598
  Distance between 3'-terminus of neighbour sequence of sequence listing upward to telomere on chrosomal short arm and 5'-terminus of this base sequence : 125999
ggtatggtaattatgagaataggagaatgtccttatttttttaaatgcataaaagttcagtggtgtcatgtcatgatgtctgaaacttactttcaaatagttcagccaaaaacatacaggcacacacacacacacacacacacacacacacacacacacacacatccctggagaaagacagattgatttgattttaatcaaaagcataggaagaaaattcatcaatgaagtttccaatataagcaaaaaatagtttgatcattcacaaaaagagaaatggttggcataacatcagagtacagaggaagctttgaatacaaatacaggtgactactagctcagactgtttcaact

SEQ ID NO: 26397 - DNA, 475 bp, Homo sapiens
  chrX.fa.O7frz.116217426
  Located on chromosome X
  Distance between a terminus base of telomere on chromosomal short arm and 5'-terminus of this base sequence : 110832402
  Distance between 3'-terminus of neighbour sequence of sequence listing upward to telomere on chrosomal short arm and 5'-terminus of this base sequence : 176450
gtatgcaagtggacaagtctattgggaggaaagaggtgtgtgtgtgtgtgtgtgtgtgtgtgtgagagagagagagagagagagagagagacagagagagagcgattacatgagtttattgattgatttgaaataaaagacatattttgtttttataattaagtattgaggaaataatcatattcaccttgccatagagagtctaaatgcctatgtgaatcaccttcataaagttaatttcaggattagcaataacagaagaataaaagacccaaacggtaccaaagactgctatggttatgaactaaaatatgttcccctttaaacagtgaactaatgccaaaactcaaaactgtttgtatttatattacataatgtaaattagatttacattacatcatttacataaaacattcatgagaagttggatgagagtttttcaaattgacaagtttgcacctagactgatagaata

SEQ ID NO: 26398 - DNA, 278 bp, Homo sapiens
  AC006975.2_92105
  Located on chromosome X
  Distance between a terminus base of telomere on chromosomal short arm and 5'-terminus of this base sequence : 110910662
  Distance between 3'-terminus of neighbour sequence of sequence listing upward to telomere on chrosomal short arm and 5'-terminus of this base sequence : 77785
tggttgctaaaatcaacgtaagtaaatcaaggttccgggatctagattcaaaaacaatgaaacagctaggtctctatagtctgcattcccagaagtctgataggcaaaaaaaaaaaacaaaaaacagtaatcagattatcaatatgagcttgatactgggatagagtttcattgccacaaaggtcccttatacacacacacacacacacacacacacacacacacacacacaccctgacaaggcaggatattttctcagtatgtaagtggaactggac

SEQ ID NO: 26399 - DNA, 430 bp, Homo sapiens
  chrX.fa.O7frz.115973943
  Located on chromosome X
  Distance between a terminus base of telomere on chromosomal short arm and 5'-terminus of this base sequence : 111075758
  Distance between 3'-terminus of neighbour sequence of sequence listing upward to telomere on chrosomal short arm and 5'-terminus of this base sequence : 164818
aacttcctcaaacctacagataacatcatacttaatggtgaaagactgattgctttcaccatttttctagaggttttatccagtgcaataaggtaaggaaaaaaaaggcatcagactggaaagaaaaaagaaaagaggaaagaaaaagaaaggaagaaaggggaaagaaaagaaagggagggcaagaaaggatgaaaaggaagaaggaaggaaggaaggaaggaagggaggaaggaaggaaggaaggaaggaaggaaggaaggaaggaaggaaggaaggcaggcaggcaggcaggcaggcaggcaggaaggcaggaaggcaggaaggcaggcaggcaggcaggcaggcttatttataggcaaaatgattgcctatataggaaaacctatagaatctaccaaaaaagctgctagaactgataagtcagttt

SEQ ID NO: 26400 - DNA, 314 bp, Homo sapiens
  chrX.fa.O7frz.116517197
  Located on chromosome X
  Distance between a terminus base of telomere on chromosomal short arm and 5'-terminus of this base sequence : 111214704
  Distance between 3'-terminus of neighbour sequence of sequence listing upward to telomere on chrosomal short arm and 5'-terminus of this base sequence : 138516
ccatactttggcagaacagctccatcttctcccagccatgcctgcaccctgcccctagggacctgagctgaatctgcactctgctgctgagcaaacagcgctttggtggagccctgcatcctggtgaaaacagggccatccagaagagtcacacacacacacacacacacacacacacacacacacaccctcacctgaactgaaactgaaaattgcccccttgggagttggtgcctttgctgagctgagcagctgcacatcccttcaggaggtattccagaaaaaaagcattgttaccataggaaatgacagct

SEQ ID NO: 26401 - DNA, 339 bp, Homo sapiens
  chrX.fa.O7frz.117472675
  Located on chromosome X
  Distance between a terminus base of telomere on chromosomal short arm and 5'-terminus of this base sequence : 111483787
  Distance between 3'-terminus of neighbour sequence of sequence listing upward to telomere on chrosomal short arm and 5'-terminus of this base sequence : 268769
actcatgtaattaggccagatccacctatataatctacctaatcttttttttttctttttttgagacagaatctcactctgtcacccaggctggagtgcgatctgggctcactgcaacctccgcctcccaggttcaagcgattctcctgcctcagcctcctgagtagctgggattacaggcatgcgccaggacgcccggctaatttttgttgtttgtttgtttgtttgttttttattattatactttaagttatagggtacatgtgcaggtttgttacatatgtatacatgtgccatgttggtgtgctgcacccattaactcgtcatttacattaggta

SEQ ID NO: 26402 - DNA, 416 bp, Homo sapiens
  chrX.fa.O7frz.117244345
  Located on chromosome X
  Distance between a terminus base of telomere on chromosomal short arm and 5'-terminus of this base sequence : 111535590
  Distance between 3'-terminus of neighbour sequence of sequence listing upward to telomere on chrosomal short arm and 5'-terminus of this base sequence : 51464
ttataggaatgccttatgtcatactaaactgtctgctttttatttatttatttatttattttttgagacttgagtctcgctctgttgcccaggctagagtgcagtggtgtgatctcagctcactgcaacctccacctcctgggttgaagcaattcttctgcctcagcctcccaagtagctgggtttacaccaacacaccaccacgccaggctaattttttatatttatttatttatttatttattttgtatttttagtagagatggggtttcaccatgttggccaggctggttttgaactcctgacctcagttgatccgcccacctcagcctcccaaagtgctgggattacaagcataagtcaccgtgtccggtcacagtgagctttttgcagcaaacaatgctttagcataatca

SEQ ID NO: 26403 - DNA, 362 bp, Homo sapiens
  chrX.fa.O7frz.117001445
  Located on chromosome X
  Distance between a terminus base of telomere on chromosomal short arm and 5'-terminus of this base sequence : 111782329
  Distance between 3'-terminus of neighbour sequence of sequence listing upward to telomere on chrosomal short arm and 5'-terminus of this base sequence : 246323
gtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctat

SEQ ID NO: 26404 - DNA, 114 bp, Homo sapiens
  chrX.fa.O7frz.116915610
  Located on chromosome X
  Distance between a terminus base of telomere on chromosomal short arm and 5'-terminus of this base sequence : 111867403
  Distance between 3'-terminus of neighbour sequence of sequence listing upward to telomere on chrosomal short arm and 5'-terminus of this base sequence : 84712
tcttattgcttatgaggtcaagccataaactgactgctctctctctctctctctctctctcctcctaacctccctctctcattctggtcatccttcaaggtctagttcaactcc

SEQ ID NO: 26405 - DNA, 157 bp, Homo sapiens
  chrX.fa.O7frz.118469901
  Located on chromosome X
  Distance between a terminus base of telomere on chromosomal short arm and 5'-terminus of this base sequence : 112143287
  Distance between 3'-terminus of neighbour sequence of sequence listing upward to telomere on chrosomal short arm and 5'-terminus of this base sequence : 275770
ctccttgtgttacatgtttcagtatatggaaacacacacacacacacacacacacacacacacacacacacacacacaatccttgctagtacaggggaaacttggggcaagaatgtggacagtgaatggtgcaagctacattagaacgcacgtctac

SEQ ID NO: 26406 - DNA, 470 bp, Homo sapiens
  chrX.fa.O7frz.118348767
  Located on chromosome X
  Distance between a terminus base of telomere on chromosomal short arm and 5'-terminus of this base sequence : 112179675
  Distance between 3'-terminus of neighbour sequence of sequence listing upward to telomere on chrosomal short arm and 5'-terminus of this base sequence : 36231
caggtcacctgaagtcagtagtttgagaccagcctgaccaatatggtgaaaccccgtctctactaaaaatagaaaaattagctgggcatggtggtgcacacctataattccagctatttgggaggctgaggcagtagaatcaattgaacccaggaagtgaaggttgcagtgagcagcgatcacaccactgtgctccagcctgggcaacaaagtgagactttgtcccaaaagaaaggaagaaagagagaaagagagaaagagaaagaaagaaaggaaggaaggaaggaagaaaggaaggaaggaaggaaggaaggaagaaagaaagaaagaaagaaagaaagaaagaaagaaagaaagaaagaaagaaagaaagaaagaaagaaagaaagaaagaaagatcactctggtcactgtatagagaataaggtgtgtgtgtgtgtatgtgtttgtattcatctggcaaagaaata

SEQ ID NO: 26407 - DNA, 136 bp, Homo sapiens
  DID22N_0035823
  Located on chromosome X
  Distance between a terminus base of telomere on chromosomal short arm and 5'-terminus of this base sequence : 112735362
  Distance between 3'-terminus of neighbour sequence of sequence listing upward to telomere on chrosomal short arm and 5'-terminus of this base sequence : 555217
gaatgttcttagcctcctcactcattcattcgttcattcatctattcaacaaatatttattaaggtcaagtacttaccatgttctgggtatccgtgagaaagaaagaagttatagctccctatgtcttagctaccg

SEQ ID NO: 26408 - DNA, 117 bp, Homo sapiens
  DISO7_10004758
  Located on chromosome X
  Distance between a terminus base of telomere on chromosomal short arm and 5'-terminus of this base sequence : 112842803
  Distance between 3'-terminus of neighbour sequence of sequence listing upward to telomere on chrosomal short arm and 5'-terminus of this base sequence : 107305
gctcctgtatacatgcaaagggatggagagagagagagagagtgtgagtgtgtgtgtgtgtgtgtgtgtgtgtgtgtgtgtgtgtgtgtgtgtggtttggggcacatacaagcacaa

SEQ ID NO: 26409 - DNA, 397 bp, Homo sapiens
  AC004973.1_40912
  Located on chromosome X
  Distance between a terminus base of telomere on chromosomal short arm and 5'-terminus of this base sequence : 112981396
  Distance between 3'-terminus of neighbour sequence of sequence listing upward to telomere on chrosomal short arm and 5'-terminus of this base sequence : 138476
ctgatgtccgtattcctatgagacctgaaaaattttccaaagttcagagtgtttgacaaaaaaatgcaccaattcctagatatggggtttgccaaattgtaacccacaggccaaatccatcccatcactggttttttgtacagcctacacgctaactacacacacacacacacacacacacacacacacacatatatatatatacacacacatatattaaacagttaaaaaaattgaaagaagaaaaatgttttgtgactcgtgaaatttacatgaaattcaaatttcagtgttaataaataaagttttatgggaacacatcctccctcactcattcatttacatattgtctatggctgtttgcatcactttcctgttgctgtataacaaattacca

SEQ ID NO: 26410 - DNA, 198 bp, Homo sapiens
  AC004973.1_42025
  Located on chromosome X
  Distance between a terminus base of telomere on chromosomal short arm and 5'-terminus of this base sequence : 112982521
  Distance between 3'-terminus of neighbour sequence of sequence listing upward to telomere on chrosomal short arm and 5'-terminus of this base sequence : 728
attaagctgagtttcaaacttgaaaactgcatgatctccgttcagcaaataaccctaaatctgggacagtgtaaacagaagggagaggccatgagagtgagacaatagtagcattaccaaactgtttcaacttttcaactcacatacacacacacacacacacacacacacacaaatacagatggtactgaactggtg

SEQ ID NO: 26411 - DNA, 246 bp, Homo sapiens
  AC004000.1_44861
  Located on chromosome X
  Distance between a terminus base of telomere on chromosomal short arm and 5'-terminus of this base sequence : 113082190
  Distance between 3'-terminus of neighbour sequence of sequence listing upward to telomere on chrosomal short arm and 5'-terminus of this base sequence : 99471
gaattactaggcattgccttagctttagttcctcttaattagacttatattttacatagcttccagaaacacaataattactaacacagcactatgtctcaatggaggaattagttttgattaactgaccagccatatatcattatcaacatcatcatcatcatcatcatcatcatcattaatattcttctcggctgggtgcagtggctcatacctgtaatcccagcaatttggaaggctaaggtg

SEQ ID NO: 26412 - DNA, 370 bp, Homo sapiens
  chrX.fa.O7frz.120058039
  Located on chromosome X
  Distance between a terminus base of telomere on chromosomal short arm and 5'-terminus of this base sequence : 113182054
  Distance between 3'-terminus of neighbour sequence of sequence listing upward to telomere on chrosomal short arm and 5'-terminus of this base sequence : 99618
cgtgttagcagaagtcttataaacttccgggctgtcctatcaggctaagatatacgggggtgcgcctggagcctcccagaacctactttgtcttggccaagttagctgggactcctgtgatctgggagtcacttctcaatgaagattggtgggctttctcacaacacccttaatattatataaattctttacatttctataacgcatgcatttatatgtatatatacacatatgtatatataagaccagctaaataaaggactatgcattatatagtttatattatatatatatatatatatatatgatactgatttgggtgtgtttctaaatatgattgtgattttaatgactattccagatgagtaca

SEQ ID NO: 26413 - DNA, 107 bp, Homo sapiens
  DISO7_11765109
  Located on chromosome X
  Distance between a terminus base of telomere on chromosomal short arm and 5'-terminus of this base sequence : 113306899
  Distance between 3'-terminus of neighbour sequence of sequence listing upward to telomere on chrosomal short arm and 5'-terminus of this base sequence : 124475
tctcaactgattctagaaagaacacaccccccacatacatacacatacacacacacacacacacacacacacacacacacacacactagggcacttactcgcatggt

SEQ ID NO: 26414 - DNA, 164 bp, Homo sapiens
  DISO7_00001677
  Located on chromosome X
  Distance between a terminus base of telomere on chromosomal short arm and 5'-terminus of this base sequence : 113616322
  Distance between 3'-terminus of neighbour sequence of sequence listing upward to telomere on chrosomal short arm and 5'-terminus of this base sequence : 309316
acttcaatcaccgaaggccctatagccctatagccttcgcatctggaaaggaggagagggaaaggaagggagggagggagggagggagggagagagagagagagagagagagagagagagagagagagagagagagagagaggcgcacagggcagcctagactc

SEQ ID NO: 26415 - DNA, 194 bp, Homo sapiens
  DID22N_0035835
  Located on chromosome X
  Distance between a terminus base of telomere on chromosomal short arm and 5'-terminus of this base sequence : 113616740
  Distance between 3'-terminus of neighbour sequence of sequence listing upward to telomere on chrosomal short arm and 5'-terminus of this base sequence : 254
agctcctggttcgagttccggcgcgtggacttcgggtccaacgcctgcacgtggcggggagccggctgctgccctggtcgcctccgctggcggggtatgtgtgtgtgtgtgtgtgtgtgtgtgtgtgtgtgtgtgtgtggcggacggaaggtcctgctggcacgcgctcacggcaggaaggtggcggtaaagtc

SEQ ID NO: 26416 - DNA, 456 bp, Homo sapiens
  chrX.fa.O7frz.121083747
  Located on chromosome X
  Distance between a terminus base of telomere on chromosomal short arm and 5'-terminus of this base sequence : 113719659
  Distance between 3'-terminus of neighbour sequence of sequence listing upward to telomere on chrosomal short arm and 5'-terminus of this base sequence : 102725
gagctcaatggctatgaatctgcttaattaaaaagctaatattgaagattttgggtgtgtgtgtgtgtgtgtgtgtgtgtgtgtgtatgtgtgtgtgtgtgtccacttaaaaggcctttatggttttttttcctagaacttcattttttttgtagaaaaagttttgtttttctcagttgactgaattctgttttctccatttttcttcctgtctctccttccttttgcccctctctgctgcatgagggacctaaaatggtttttaacagcctgagattccttaaagaaaacagagaaggtgccagactccattttggggagaaacctctgtttttccgtatggaaccttaagagtataaacagacaagttcttctcaaatcttaaatagcttgcttttgtattgttacctgattttgttttgactaaagtagttattacaacagtggctattcttg

SEQ ID NO: 26417 - DNA, 226 bp, Homo sapiens
  DXS8067
  Located on chromosome X
  Distance between a terminus base of telomere on chromosomal short arm and 5'-terminus of this base sequence : 113843176
  Distance between 3'-terminus of neighbour sequence of sequence listing upward to telomere on chrosomal short arm and 5'-terminus of this base sequence : 123061
caggagtccaaggctgctgtgagttataatcaagcgactatactccagtgagggcaacagagtggagaccctatctcccaaacacacacacacacacacacacacacacacacacacacacacaccacattataccccataaatgtgtacaaaatcatgtcaatgaaaaatacttcatttttatgttttattattaatatttttagagacagggtatcactctgtg

SEQ ID NO: 26418 - DNA, 207 bp, Homo sapiens
  AC002476.1_9968
  Located on chromosome X
  Distance between a terminus base of telomere on chromosomal short arm and 5'-terminus of this base sequence : 114052585
  Distance between 3'-terminus of neighbour sequence of sequence listing upward to telomere on chrosomal short arm and 5'-terminus of this base sequence : 209183
actgactatgcatcaggttcagcaggggagcttacacacacacacacacacacacacacacacacacacacacactctctctctctctctctgtctctctctctctctgtctcctcattagacctactacgttaaatcctctaaggatgcagcctggaatctatttttataaaacgcttcccaggttgatcttattctgtagcctgc

SEQ ID NO: 26419 - DNA, 327 bp, Homo sapiens
  chrX.fa.O7frz.121482343
  Located on chromosome X
  Distance between a terminus base of telomere on chromosomal short arm and 5'-terminus of this base sequence : 114159863
  Distance between 3'-terminus of neighbour sequence of sequence listing upward to telomere on chrosomal short arm and 5'-terminus of this base sequence : 107071
tcgactggcaatattaatacttaggaaagcacagaaataggggaatccactgaattttaattggcctgaagagtttaaaggtcacatcagcctctagtattatttctaaattaccttctaaacacacacacacacacacacacacacacacacacacacccctaataatcgaatccttggatgaaaactaattaactagggaaaagaataacttgaagtttgtattatgaaaacaactgttaacacttcaaatcacacctgaaaacagttactaacatgtttaggatggctaaagtgctgcaagtgatttaacgacagtttaagact

SEQ ID NO: 26420 - DNA, 206 bp, Homo sapiens
  DXS1001
  Located on chromosome X
  Distance between a terminus base of telomere on chromosomal short arm and 5'-terminus of this base sequence : 114319301
  Distance between 3'-terminus of neighbour sequence of sequence listing upward to telomere on chrosomal short arm and 5'-terminus of this base sequence : 159111
tacaagtaaccctcgtgacacgtgtttaactatgtaacacaccttcacatgtatccccaaacctaaaataaaaattcacacacacacacacacacacacacacacacacacacacacacacggctgaatagtattccattatgtatatataccacattttctttatccattcatctgatgacggacacttggattgattccataac

SEQ ID NO: 26421 - DNA, 255 bp, Homo sapiens
  Z66693
  Located on chromosome X
  Distance between a terminus base of telomere on chromosomal short arm and 5'-terminus of this base sequence : 114395214
  Distance between 3'-terminus of neighbour sequence of sequence listing upward to telomere on chrosomal short arm and 5'-terminus of this base sequence : 75707
aggtaatggatgctgggcttaatacctaggtgatggaatgatatgtgcagcaagccaccatggcacatgtttacctatgtaacaaacctgcacatcctgcacatgtacctctgaacttaaaataaaagttgagggaaaaaaaagaaaatgcttttcttttcagacgtacacacacacacacacacacacacacacacacacacataattaaagacaagtcaaattatatttcttcttttggtcctgacattacgg

SEQ ID NO: 26422 - DNA, 380 bp, Homo sapiens
  chrX.fa.O7frz.114199132
  Located on chromosome X
  Distance between a terminus base of telomere on chromosomal short arm and 5'-terminus of this base sequence : 114588256
  Distance between 3'-terminus of neighbour sequence of sequence listing upward to telomere on chrosomal short arm and 5'-terminus of this base sequence : 192787
tatggtaggaaagtttcttgttagacggaagtaaaatatgactagtagcagactttttggcaaattctcattttattttaaataactctatagggaaaaaaacagctctatggattttattttctaagacaatcaaccattttcatgtgtggaaaagacccaggcattacttgactgtcctgaatgttttgtgacaacatattaaacaagcaaaattgtttgtttgtttgtttgtttgtttgtttgttcttagacagagcttcactgtgttgcccaggctagagggtagtggcgtgatcaaggctcactgcagactcaacctcctaggctcaagtatattctcctcagcttccagtatattctcctgcaagaacatacca

SEQ ID NO: 26423 - DNA, 433 bp, Homo sapiens
  chrX.fa.O7frz.114011122
  Located on chromosome X
  Distance between a terminus base of telomere on chromosomal short arm and 5'-terminus of this base sequence : 114760904
  Distance between 3'-terminus of neighbour sequence of sequence listing upward to telomere on chrosomal short arm and 5'-terminus of this base sequence : 172268
ttcatacctgttatcttagcactagggggctgaggcagggaggatccacttgagcccaggagtttgagaccaggctgggcaaaaaagtgagtcctccaactctacaaaaataaataaataaataaataaataaataaataaataaataaataaaaaataaattagctggacatggtggcctgttgtagtcccagccactcaggaggctgagatgggagaatcccttgagcctcggaggttgaggctgcagtgagctgtgattgtgccactgcactccagcctgggcaacagaccctgtttcaaaacaaaacaaaacaaaacaaaaaaaaactttacaccaatttgtccatctattatactagcagtgtttgtgagtacctatccattttactgaaatttctctcaatcccttaaacgttcttaatttgactga

SEQ ID NO: 26424 - DNA, 375 bp, Homo sapiens
  AL049591.12_51494
  Located on chromosome X
  Distance between a terminus base of telomere on chromosomal short arm and 5'-terminus of this base sequence : 114874640
  Distance between 3'-terminus of neighbour sequence of sequence listing upward to telomere on chrosomal short arm and 5'-terminus of this base sequence : 113303
acttaccatagtgctttcaggtatcgtccatgttgtatagatgtatcagtacttaattccttttcagtaacaaatagtactccattgtatggatatggcacattttatttatcctttcatccgctgatgggcatttgggttgttttcacttttttgactattatgagaaagctcttatgcacatttgtgttcaggtttctgtgtggacattgttcctaagtgtgtgtgtgtgtgtgtgtgtgtgtgtgtgtgtaactagagggcttattaaattgagggagcatttctagtcaaatgctcttgtaagtagctgttggtgagctgtaagaaaatgatgactagagtgacccactaaagtactggctagtgacctgt

SEQ ID NO: 26425 - DNA, 347 bp, Homo sapiens
  AL049591.12_36185
  Located on chromosome X
  Distance between a terminus base of telomere on chromosomal short arm and 5'-terminus of this base sequence : 114889948
  Distance between 3'-terminus of neighbour sequence of sequence listing upward to telomere on chrosomal short arm and 5'-terminus of this base sequence : 14933
atagcactatgacttcatagtggagacattaaataaatataaatattgaaatgaaagaatgctcaatctaaaaataagcagaaggaaatatcccattgtcatgtgaataatttgattttccaaatcaattaaagaagatgtcatttgaaggcatatgttatcaatttgtttgcttgcattctgcccaacttcattccaaaaaatacagtagtcagtggttaaatgtgtgtgtgtgtgtgtgtgtgtgtgtgtgtaaagttatgttcatattgcaagtttatatttaattcaacaaagatttgctgaatgtctactatgtgtgtctctgcaacttattggagaagtac

SEQ ID NO: 26426 - DNA, 216 bp, Homo sapiens
  DXS1220
  Located on chromosome X
  Distance between a terminus base of telomere on chromosomal short arm and 5'-terminus of this base sequence : 114921654
  Distance between 3'-terminus of neighbour sequence of sequence listing upward to telomere on chrosomal short arm and 5'-terminus of this base sequence : 31359
ggggcctataaaatggagatggtgtgtggtcccttaggtttggagacaaaaggcgcaggcaaggaaagagtgggcgcgatgtgtctgtgtgtgtgtgtgtgtgtgtgtgtatgtgtgtgtgtgtgtgtgtgtgtgtgtgtgtgtgtgtacttcccatgctgagaattgcccctatttcccacaaaggaaaggaattctgtgggtcagactctcgct

SEQ ID NO: 26427 - DNA, 114 bp, Homo sapiens
  DISO7_10004753
  Located on chromosome X
  Distance between a terminus base of telomere on chromosomal short arm and 5'-terminus of this base sequence : 115228229
  Distance between 3'-terminus of neighbour sequence of sequence listing upward to telomere on chrosomal short arm and 5'-terminus of this base sequence : 306359
caggagggaggacaatacctaaatgtacacacacacacacacacacacacacacacacacactcaagaaggggcagatttgcaaactttactgagagctataattccattctca

SEQ ID NO: 26428 - DNA, 463 bp, Homo sapiens
  chrX.fa.O7frz.118999722
  Located on chromosome X
  Distance between a terminus base of telomere on chromosomal short arm and 5'-terminus of this base sequence : 115530226
  Distance between 3'-terminus of neighbour sequence of sequence listing upward to telomere on chrosomal short arm and 5'-terminus of this base sequence : 301883
gattgtattctcagcactttgtgaacctgaggtgggtagattgttgtagcccaggagttcacaactagcctgggtaacacagtgaaactctgtcaaaagaaaggaaagaaaaaaaaagaaagaaagaaaaaagaaagaaagaaagagagagagaaggacggaagggatgaatggagggaaggaagaaaggaaggaagaaagatagaaggaaggaaggaaaagaaagaaagaaagaaagaaagaaagaaagaaagaaagaaagaaagaaagaaagaaagaaagattgattccatgaaggagtgagatttaagaagaaaaagaaaaatgaggagaatcttcaaatcaccagaacttgacactacagagggaattctaatctttcttgagaagacagaggatgtctcctcttaaggaagaaaacgtaggaggtgcgtcccattgttggcagtagaatactgatagc

SEQ ID NO: 26429 - DNA, 208 bp, Homo sapiens
  AC007022.2_30710
  Located on chromosome X
  Distance between a terminus base of telomere on chromosomal short arm and 5'-terminus of this base sequence : 115711561
  Distance between 3'-terminus of neighbour sequence of sequence listing upward to telomere on chrosomal short arm and 5'-terminus of this base sequence : 180872
taatctgattcacaaggcctagagagtagggggaaccaggatcagccatggcaccggatagagagagagggaaggctttctcaagaatgtaccctcaaagattcatagcatacccctccccaaacacacacacacacacacacacacacacacacccctgtacatttcatttcaacaaacagcattctcaagtcttgcaaatttcatc

SEQ ID NO: 26430 - DNA, 222 bp, Homo sapiens
  DISO7_10019612
  Located on chromosome X
  Distance between a terminus base of telomere on chromosomal short arm and 5'-terminus of this base sequence : 115763178
  Distance between 3'-terminus of neighbour sequence of sequence listing upward to telomere on chrosomal short arm and 5'-terminus of this base sequence : 51409
atttggatctgtggctgccaacccacactgagggattccggagacaaaacagaacactcatacatacacacacacacacacactctctctctctcacacacacacacacacacacacacacaaacacacatacacattctctctctccccccccacacacagacaacacacacacacacacacacacacacacacacacttcacagacaccttgtcagaaac

SEQ ID NO: 26431 - DNA, 451 bp, Homo sapiens
  chrX.fa.O7frz.129190629
  Located on chromosome X
  Distance between a terminus base of telomere on chromosomal short arm and 5'-terminus of this base sequence : 115976412
  Distance between 3'-terminus of neighbour sequence of sequence listing upward to telomere on chrosomal short arm and 5'-terminus of this base sequence : 213012
agactgaattaggtaaggtcattagatgcagaggttttaagacggtgcttcatagacttttgtatttaatgaaccaatgctaactttaaaaaatgattaggaatgaacatattcctaaggtgtttgttggtggtggtattttcgaagtaaggccattaaaacaacacacacacacacacacacacacacacacacacacacacacacacacaccaaaaacactttgtattggctgggtcaatgcttttcaatgtccctctaaaaactatccaaaataagtataagtatgtttttgcaaggcaaatggctcatttacaaccattcattgtcccaaactcctcataggtaacatttttggaaacataactaaccatattctatcctatctcttaataacagaaacagtattttgtaataactaatacaggaaagatacggtcttaggacatat

SEQ ID NO: 26432 - DNA, 270 bp, Homo sapiens
  Z84481.1_27792
  Located on chromosome X
  Distance between a terminus base of telomere on chromosomal short arm and 5'-terminus of this base sequence : 116070602
  Distance between 3'-terminus of neighbour sequence of sequence listing upward to telomere on chrosomal short arm and 5'-terminus of this base sequence : 93739
accactttaatgtcatttagcaataaatagcaagaaatagttgttctttgatatttgcacatgatattttgcaattcaaaagattctgattaatttatcctttttaaaataagatgtattcaagtatctccaaatagttacataaatattataattcaacaaattccaggttatgtcagatatatatgtatatatgccatatatacatatatgtgtgtgtgtgtgtgtgtgtgtgtgtgtgtgtgtgtgtaaagacttatggaagcaatt

SEQ ID NO: 26433 - DNA, 257 bp, Homo sapiens
  DXS8009
  Located on chromosome X
  Distance between a terminus base of telomere on chromosomal short arm and 5'-terminus of this base sequence : 116070672
  Distance between 3'-terminus of neighbour sequence of sequence listing upward to telomere on chrosomal short arm and 5'-terminus of this base sequence : -200
gcaattcaaaagattctgattaatttatcctttttaaaataagatgtattcaagtatctccaaatagttacataaatattataattcaacaaattccaggttatgtcagatatatatgtatatatgccatatatacatatatgtgtgtgtgtgtgtgtgtgtgtgtgtgtgtgtgtgtgtaaagacttatggaagcaatttccacagtttggggaaaaaggatattttaaaatggaaatatatagaggacgaaggct

SEQ ID NO: 26434 - DNA, 278 bp, Homo sapiens
  Z76735.1_104554
  Located on chromosome X
  Distance between a terminus base of telomere on chromosomal short arm and 5'-terminus of this base sequence : 116239434
  Distance between 3'-terminus of neighbour sequence of sequence listing upward to telomere on chrosomal short arm and 5'-terminus of this base sequence : 168505
ttatagtacatggctcagccactcataacatttataaagtcatgataatgtagacattaactattgaaccaaccaaaatggcaatataactatattaggagaatgggaagggaagtgtgtgtgtgtgtgtgtgtgtgtgtgtgtgtgtgtgtcgtgtatgtgtgaaaagtaattatgcattagttttctattgctgacctaaaaaattatcacaaatttggaaacttacagtacattattacctcacagttttgtatgtcaaaagtatgacatggatc

SEQ ID NO: 26435 - DNA, 167 bp, Homo sapiens
  DXS1206
  Located on chromosome X
  Distance between a terminus base of telomere on chromosomal short arm and 5'-terminus of this base sequence : 116275629
  Distance between 3'-terminus of neighbour sequence of sequence listing upward to telomere on chrosomal short arm and 5'-terminus of this base sequence : 35917
agcatgggacttctcaaccttcataattatctgagccacttcccctcgtgtgtgtgtgtgtgtgtgtgtatgtgtgtgtgtgtgtgtgtgtgtgtgtgtgtgtaggtatatgtataccattgattctatgtatcctgttgctttcagattgcagacagcagattgtg

SEQ ID NO: 26436 - DNA, 202 bp, Homo sapiens
  DXS8078
  Located on chromosome X
  Distance between a terminus base of telomere on chromosomal short arm and 5'-terminus of this base sequence : 116437964
  Distance between 3'-terminus of neighbour sequence of sequence listing upward to telomere on chrosomal short arm and 5'-terminus of this base sequence : 162168
caaatggcaggatttcccttattacatctgaatatacgtatgtgtgtatgtgtgtgtgtgtgtgtgtgtgtgtgtgtgtgtgtgtagatagatagatggataaatcagtctcaaagtttatttgttcatgcattcatgaccacctaggttgtttcaatatctcagttattgttaataatgcaccaattactatggggatgca

SEQ ID NO: 26437 - DNA, 171 bp, Homo sapiens
  AL049562.7_73333
  Located on chromosome X
  Distance between a terminus base of telomere on chromosomal short arm and 5'-terminus of this base sequence : 116586966
  Distance between 3'-terminus of neighbour sequence of sequence listing upward to telomere on chrosomal short arm and 5'-terminus of this base sequence : 148800
tgtttcttaagtttatggccacttctctagcctggagcacaggaggcaattagatagatagatagatagagagagagagagagagagagagagagagagagagagagagagagagagataatagatagatgctaaatagatagatgggtaggtagctagacgtaggtcaaa

SEQ ID NO: 26438 - DNA, 198 bp, Homo sapiens
  AC002377.1_112807
  Located on chromosome X
  Distance between a terminus base of telomere on chromosomal short arm and 5'-terminus of this base sequence : 116862045
  Distance between 3'-terminus of neighbour sequence of sequence listing upward to telomere on chrosomal short arm and 5'-terminus of this base sequence : 274908
agagttaatagcctggtgcatatccttctgtacatttttctaaagtcccttcatctgtttcaaacacacacacacacacacacacacacacacacacacacacacacggcttttgtttggacattatttaaaaatgtgattattatataatacattttttctatatcttttaatcagtacctagtggaatttgcgtaa

SEQ ID NO: 26439 - DNA, 286 bp, Homo sapiens
  chrX.fa.O7frz.122332434
  Located on chromosome X
  Distance between a terminus base of telomere on chromosomal short arm and 5'-terminus of this base sequence : 117083340
  Distance between 3'-terminus of neighbour sequence of sequence listing upward to telomere on chrosomal short arm and 5'-terminus of this base sequence : 221097
atactgtggtaacaatttgtcatacacccaagacacagcatggacaatccttgcaaattgttggcacctacactcgagaactggtttctgcttacttaaatctgttttatattgtttatgatatctaaactcatttttctgtttcttgccccaaacagtgacacagtgatagaataaactgaagctgttacttggcacctgtaatttttaaaaatgagtgtgtgtgtgtgtgtgtgtgtgtgtgtgtgtgtgtgtgtttgtgtgtgttccaaatcctattagatgt

SEQ ID NO: 26440 - DNA, 201 bp, Homo sapiens
  DISO7_10004766
  Located on chromosome X
  Distance between a terminus base of telomere on chromosomal short arm and 5'-terminus of this base sequence : 117344215
  Distance between 3'-terminus of neighbour sequence of sequence listing upward to telomere on chrosomal short arm and 5'-terminus of this base sequence : 260589
aaccactttatgctgcacacccagctcttcacatacactcacacacatactttatacacacacacatatatatgtgtgtgtgtatatatatatatatatatatatacatagtctagtccttaaagcatgtatgtgtgtgcgtgcgtgtgtgtgtgtgtgtgtgtgtgtgtatacacaaaggcttgaaagattagtcaatca

SEQ ID NO: 26441 - DNA, 115 bp, Homo sapiens
  Z67098
  Located on chromosome X
  Distance between a terminus base of telomere on chromosomal short arm and 5'-terminus of this base sequence : 117553744
  Distance between 3'-terminus of neighbour sequence of sequence listing upward to telomere on chrosomal short arm and 5'-terminus of this base sequence : 209328
acatttggcatttgctttggtgctctgtgtacgtgtgtgtgtgtgtgtgtgtgtgtgattattattatttattttgctgaaccttttaagagtgcgttgtgtgtatgaacctcta

SEQ ID NO: 26442 - DNA, 441 bp, Homo sapiens
  chrX.fa.O7frz.123429129
  Located on chromosome X
  Distance between a terminus base of telomere on chromosomal short arm and 5'-terminus of this base sequence : 117679020
  Distance between 3'-terminus of neighbour sequence of sequence listing upward to telomere on chrosomal short arm and 5'-terminus of this base sequence : 125161
cttaggtccaggagttctagaccagcctgggcaacatggtgaaaccctgactctacaaaaaatacaaaaattagcctggtgtggtggtgcatgcctgtagtcccagctcctttggaggttaaggttggaggattgcttgagcctgagaggcagaggttgtagtgagccaagatcacaccaatgcactccagcctgggtgacagagtgagaccctgtcaacaaaacaaacaaacaaacaaacaaacaaacaaaccaaaattaccattcaacccagcaatgccattattgcgtatacacccaaaggaatataaattttgtgtaattaaatattctaccacaaagacgtatgcacatgtatgcttactgcagcagtattcacaatagcaaatacatggaatcaacctaaatgttcattaatcgtagactagataaagcaaatgt

SEQ ID NO: 26443 - DNA, 266 bp, Homo sapiens
  chrX.fa.O7frz.123345664
  Located on chromosome X
  Distance between a terminus base of telomere on chromosomal short arm and 5'-terminus of this base sequence : 117762341
  Distance between 3'-terminus of neighbour sequence of sequence listing upward to telomere on chrosomal short arm and 5'-terminus of this base sequence : 82880
gagtctagtccatttacaatcaacattattattgataagtaaggtctttttcctcccattttgtcatttgtgtgtgtgtgtgtgtgtgtgtgtgtgtgtgtgtgtgtgtgtggtcttctcttcattcttttcaaccagtcttccttttagtgaaggtgattttctctgttgttatgattgaatttcctgctttttacttcttgtgtattcactgtgttttttgatttgaggttactatgaggctttcaaatagtatcttacaaccg

SEQ ID NO: 26444 - DNA, 451 bp, Homo sapiens
  chrX.fa.O7frz.123263972
  Located on chromosome X
  Distance between a terminus base of telomere on chromosomal short arm and 5'-terminus of this base sequence : 117835801
  Distance between 3'-terminus of neighbour sequence of sequence listing upward to telomere on chrosomal short arm and 5'-terminus of this base sequence : 73194
cttttcttgcctatttatccactttgggatgggtatgcctatcctatgcctatgccatcattgtattttggaagtagataacttctctttttgttttgttttgtttcgttttgttttgttttgttttgagatagagtctctctctgtcacccaggatggagtgcagtggcaccatctcggctcactgcaacctccacctcccaggttcgagtaattgtcctgtctcagcctcccaagtaattgggactacaggcgcccactaccatgcccagctaatgtttttttatttttagtagagatggggtttcaccagataacttcttttaatttcacagtctaacagcttgtgggaattttccacagattcaatcatggcttaagtctcacccatatctgatttagttgaaactctggactttggacttttgagttgatgttggaacaagttaag

SEQ ID NO: 26445 - DNA, 155 bp, Homo sapiens
  DISO7_10004770
  Located on chromosome X
  Distance between a terminus base of telomere on chromosomal short arm and 5'-terminus of this base sequence : 117961105
  Distance between 3'-terminus of neighbour sequence of sequence listing upward to telomere on chrosomal short arm and 5'-terminus of this base sequence : 124853
aattacatacaccttgaaggaaacaaagacatagcaaaatatcaaactactgctgcaaaagaataatacacacacacacacacacacacacacacacacacacacacacacacacacacaaaacaccatcaggaatgccaggagtcatgcacaaa

SEQ ID NO: 26446 - DNA, 146 bp, Homo sapiens
  DISO7_10004769
  Located on chromosome X
  Distance between a terminus base of telomere on chromosomal short arm and 5'-terminus of this base sequence : 118006138
  Distance between 3'-terminus of neighbour sequence of sequence listing upward to telomere on chrosomal short arm and 5'-terminus of this base sequence : 44878
catgcagcattattcatgctatatatatatatatatatatatatatattctgtatgtatagatgataccttatttccccacacatacacacctttttctattttaaatatatttctataaactccagataattccctacaatattc

SEQ ID NO: 26447 - DNA, 213 bp, Homo sapiens
  AL109800.25_21464
  Located on chromosome X
  Distance between a terminus base of telomere on chromosomal short arm and 5'-terminus of this base sequence : 118668835
  Distance between 3'-terminus of neighbour sequence of sequence listing upward to telomere on chrosomal short arm and 5'-terminus of this base sequence : 662551
ggactatacaagatgaacttggaacatcactgccagaaaagaaggaaaaaagtgctcagatagacacacacacacacacacacacacacacacacacacacactgaagggagcatatcagagagacatgggagccaactaaaagagctcacaatggccaaaaatagaaaaaattgagcaacaaaataaatgagttggtattactggactacaa

SEQ ID NO: 26448 - DNA, 470 bp, Homo sapiens
  chrX.fa.O7frz.123982729
  Located on chromosome X
  Distance between a terminus base of telomere on chromosomal short arm and 5'-terminus of this base sequence : 118769453
  Distance between 3'-terminus of neighbour sequence of sequence listing upward to telomere on chrosomal short arm and 5'-terminus of this base sequence : 100405
ccatcaaacatctgagttagagtacagaagttagccagttggaatgattgagtctgtatttcaaaacctaagcctcactgtgcttttattgtatatttgtgtgtttaaaaatttatttttcaaactaggtttctcctgcttctttagggaggcattctccttctgcaacacatatgagagatgatagatagatggatagataaatagatagatagatagatagatacatagatagatagatagacagaccactaaaaagtcttttaactctgagatcctagaacgcataagaagtcaaacgcataatttccatgcacaaagatgggtcacaaaaaggatatatcttcaaaagcttagtttgacattctagaagtattctaatagatacatttgatgtcatacatgcctaccatcttcagcaacagaatagcaggattcatatttcaatcttgcatattcttatttgcaac

SEQ ID NO: 26449 - DNA, 218 bp, Homo sapiens
  DXS8059
  Located on chromosome X
  Distance between a terminus base of telomere on chromosomal short arm and 5'-terminus of this base sequence : 118859013
  Distance between 3'-terminus of neighbour sequence of sequence listing upward to telomere on chrosomal short arm and 5'-terminus of this base sequence : 89090
cagtgcattccagccagatactatgcttttcccatggtctttgcaagccacagaccaggagattccctccggtgcctacaccaccaaggccctgggattcaagcacaaaactgtgcagccattcgggcagacaccaagctagctgcaggagtttcttgtgtgtgtgtgtgtgtgtgtgtgtgtgtgtgtgtgttttcataccttggtggcacctggaa

SEQ ID NO: 26450 - DNA, 464 bp, Homo sapiens
  chrX.fa.O7frz.124143139
  Located on chromosome X
  Distance between a terminus base of telomere on chromosomal short arm and 5'-terminus of this base sequence : 118929719
  Distance between 3'-terminus of neighbour sequence of sequence listing upward to telomere on chrosomal short arm and 5'-terminus of this base sequence : 70488
ttaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctac

SEQ ID NO: 26451 - DNA, 232 bp, Homo sapiens
  DXS1212
  Located on chromosome X
  Distance between a terminus base of telomere on chromosomal short arm and 5'-terminus of this base sequence : 119082340
  Distance between 3'-terminus of neighbour sequence of sequence listing upward to telomere on chrosomal short arm and 5'-terminus of this base sequence : 152157
tggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgcca

SEQ ID NO: 26452 - DNA, 447 bp, Homo sapiens
  chrX.fa.O7frz.124373575
  Located on chromosome X
  Distance between a terminus base of telomere on chromosomal short arm and 5'-terminus of this base sequence : 119160109
  Distance between 3'-terminus of neighbour sequence of sequence listing upward to telomere on chrosomal short arm and 5'-terminus of this base sequence : 77537
tcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaac

SEQ ID NO: 26453 - DNA, 422 bp, Homo sapiens
  chrX.fa.O7frz.124561211
  Located on chromosome X
  Distance between a terminus base of telomere on chromosomal short arm and 5'-terminus of this base sequence : 119218326
  Distance between 3'-terminus of neighbour sequence of sequence listing upward to telomere on chrosomal short arm and 5'-terminus of this base sequence : 57770
tcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatt

SEQ ID NO: 26454 - DNA, 236 bp, Homo sapiens
  DISO7_11775115
  Located on chromosome X
  Distance between a terminus base of telomere on chromosomal short arm and 5'-terminus of this base sequence : 119312850
  Distance between 3'-terminus of neighbour sequence of sequence listing upward to telomere on chrosomal short arm and 5'-terminus of this base sequence : 94102
attgcaagagggatgctagaaataattaagtatatttgatttcctttaaatttttcagccattatattttcaaatattttttctgccccttattctcccttctggggtatctgttacacatatattggactgcttttctcttcattcttcttcaatcttttttgtgttattcaaattggagtgtgtgtgtgtgtgtgtgtgtgtgtgtgtgtaaaatcaagcccactgattcttct

SEQ ID NO: 26455 - DNA, 101 bp, Homo sapiens
  DISO7_10004775
  Located on chromosome X
  Distance between a terminus base of telomere on chromosomal short arm and 5'-terminus of this base sequence : 119387390
  Distance between 3'-terminus of neighbour sequence of sequence listing upward to telomere on chrosomal short arm and 5'-terminus of this base sequence : 74304
gtatttgattacatacgcatatgcgtgtgtgtgtgtgtgtgtgtgtgtgtgtgtgtgtgtgtgtgtgtgtataagcaaatgaatgacttcagtgatgcaag

SEQ ID NO: 26456 - DNA, 250 bp, Homo sapiens
  DXS8098
  Located on chromosome X
  Distance between a terminus base of telomere on chromosomal short arm and 5'-terminus of this base sequence : 119509876
  Distance between 3'-terminus of neighbour sequence of sequence listing upward to telomere on chrosomal short arm and 5'-terminus of this base sequence : 122385
cagaggcatttaccaagcaaaaggtgttccttaagtgagagggacacatgagacaatgagttagtgacctgcagccaccaggaaagtagaccctggactctggatatctctctctctgtgtgtgtgtgtctctgtctctgtctctctctctctctctctcacacacacacacacacacacacacactctctctctctctctctctctctctctctcaactaggattctgttgtagtctttgctccagggg

SEQ ID NO: 26457 - DNA, 416 bp, Homo sapiens
  chrX.fa.O7frz.125047175
  Located on chromosome X
  Distance between a terminus base of telomere on chromosomal short arm and 5'-terminus of this base sequence : 119668639
  Distance between 3'-terminus of neighbour sequence of sequence listing upward to telomere on chrosomal short arm and 5'-terminus of this base sequence : 158513
tttgaattggtagactgagtaaagcagatggccctccccagtgtgggtgggcctcatataatcagttgaaggcctgaatagaacaaaaaggctgaccctctcaagagtaacgggtagttcctactacttgactgcttgaactgagacattggtctttttctgcctttggactcaaacggaaatattagctcttgttgggtcttgtgctggctctcagagtggaaccacaccattgactcaccttggtctccagcttgccaactgcagatctttggacttttcagcctccatgatcacgtgagccaattccttaacacacacacacacacacacacacacacacacacacacacacacacagtggttctgtttctctggggaatcatgactaatacaaagactttagcttcatcttt

SEQ ID NO: 26458 - DNA, 417 bp, Homo sapiens
  chrX.fa.O7frz.125439384
  Located on chromosome X
  Distance between a terminus base of telomere on chromosomal short arm and 5'-terminus of this base sequence : 119907166
  Distance between 3'-terminus of neighbour sequence of sequence listing upward to telomere on chrosomal short arm and 5'-terminus of this base sequence : 238111
ttctatttcttgttcatgctaaaccaattaaagcatattgctgctggctgggcgcaatcgctcatgcctgtaatcctggcactataggaggctgaggcagaaggatcatttgagcttaggagttcgaggtgagcatgggcaacatagtaagatccctttctcaacaaaaataaaaataagaaaattagctgggcatggtggtatgtgcctgtagtcccagctactcaggcggctgaagcaggaggatcattgcttgagcctgggaggtcaaggctacagtgagctatgatcacactgctgcactgcagtctgggcaacagagcaagaccctgtcacacacacacacacacacacacacacacacacaaagcccaaaataaaacaaaaaagagtatgttactgacattatgccacttc

SEQ ID NO: 26459 - DNA, 469 bp, Homo sapiens
  chrX.fa.O7frz.125538651
  Located on chromosome X
  Distance between a terminus base of telomere on chromosomal short arm and 5'-terminus of this base sequence : 120006375
  Distance between 3'-terminus of neighbour sequence of sequence listing upward to telomere on chrosomal short arm and 5'-terminus of this base sequence : 98792
tagagttaatccacctgtcattctgtccaacaacagcaacaacaacaacaacacacacacacacacacacacacacacacacacccctaccttactataaacaaagtgaaaaaacaaatattagtatacagactatattgagaattcctgtaaatcaagaagaaaaaggcaagcaacccaatagaagaataggaaaaaaaaaaaaaaaaggaaatccagagtagtaaacacaaatggccaataaataaaagaaaaaaatgctccccattgctaatcaaggaaatacaaatgaactatgagaggtcattttatacctctcaggctgacaaaaattaaaagtttgacagttccaagtgttggttagagggtggagcaaagagaggtgtcttttattgttgggtaggatgtaaattggctttagacgcttgagagaggagtttgacaatatctagtaaacttggcaacatgt

SEQ ID NO: 26460 - DNA, 283 bp, Homo sapiens
  AL022718.1_59555
  Located on chromosome X
  Distance between a terminus base of telomere on chromosomal short arm and 5'-terminus of this base sequence : 120096119
  Distance between 3'-terminus of neighbour sequence of sequence listing upward to telomere on chrosomal short arm and 5'-terminus of this base sequence : 89275
gaattaggccaagttttcaaacacacttttgctgtattatgtaaggatcattaaaactataatactaactaaagataaagttataccatttctaattgaaactatttatacctgtttatttaaaaaattctctgtatcactgcagagatgattgaataagaaattaaactttattatgaagaaagttatgtgtaaaatatactgacaaacacacacacacacacacacacacacacacacacacacacacacgtttgtatattatttcgccagaaatagctct

SEQ ID NO: 26461 - DNA, 388 bp, Homo sapiens
  chrX.fa.O7frz.126455828
  Located on chromosome X
  Distance between a terminus base of telomere on chromosomal short arm and 5'-terminus of this base sequence : 120193119
  Distance between 3'-terminus of neighbour sequence of sequence listing upward to telomere on chrosomal short arm and 5'-terminus of this base sequence : 96717
aagatggttaaagtttccgtacacagaatcaaataaatgaggttccatgccgtgcaactcgctaaggaagacccttggccaaggtggtggtaatgtctcaacatttaacagtgaaaccagacactgataataatgtgatttatttttctttgctttatagaggttggggtgtgtgtgtgtgtgtgtgtgtgtgtgtgtgtgtgtgtgtggagagagagagagagagattggggtaagtagatggtgctagttcaagttgaaatgcacatgtcttgttttatttttgtgttagagttcccactcaaaagatgcctgcaggctgagatttaagggttctcagtatatatgggctaagataaatgaggtttactaaatctgagctgcatat

SEQ ID NO: 26462 - DNA, 234 bp, Homo sapiens
  Z81008.1_22667
  Located on chromosome X
  Distance between a terminus base of telomere on chromosomal short arm and 5'-terminus of this base sequence : 120318722
  Distance between 3'-terminus of neighbour sequence of sequence listing upward to telomere on chrosomal short arm and 5'-terminus of this base sequence : 125215
tgatgtactgatggattcagtttgctagtattttgttgggaatttttgcatctatgttcaacagggatactggcctgtagtttgttgttgttgttgttgttgttgttgttgttgttgttgtatctttgccaggttttggtaccagggtgatgttgccttcatagaattagttagggaggagtcactttcctcgattttttggaatagtttcagtagaattggtaccagctcttc

SEQ ID NO: 26463 - DNA, 256 bp, Homo sapiens
  Z85995.1_2125
  Located on chromosome X
  Distance between a terminus base of telomere on chromosomal short arm and 5'-terminus of this base sequence : 120419856
  Distance between 3'-terminus of neighbour sequence of sequence listing upward to telomere on chrosomal short arm and 5'-terminus of this base sequence : 100900
ttaagtcctttcagaggacagactaggaatatacaaacaaataaaaaaatttttagattttataacctgctttgttagagtgtgtgtgtgtgtgtgtgtgtgtgtgtgtgtgtgtgtgtgtatacacacatatatgtggattgctacagtttggatgtttgaccctccaaatctcaggttgaaattggattccaaatgttgaaggtggggcctaatggaaagtgtttgagtcatgtgagtggattcctcataaatg

SEQ ID NO: 26464 - DNA, 383 bp, Homo sapiens
  Z97629.1_25563
  Located on chromosome X
  Distance between a terminus base of telomere on chromosomal short arm and 5'-terminus of this base sequence : 120537075
  Distance between 3'-terminus of neighbour sequence of sequence listing upward to telomere on chrosomal short arm and 5'-terminus of this base sequence : 116963
taacctgttaagtggtatgcaatataaaaagatgtaaatggtgacattaaaaaatcaaaatgtggggggagtgcagtaaaagtgtagagtttttaaaaattgtcatcaaagttaagttgtgataagcttaaaataatctgttatgactgcaagatattttgtaagtatcatggtacccacacagcaaagacacacagtagatgcaaaaaaatacaaagtaaggaatcaaaatatatcactagagaaaatcacttacacacacacacacacacacacacacacacacacacacacagaggaaggaaggtaccaaagaatctacaaaactactagaaaacaattaacaaaatggcagcagtaagtcctcaccttgaatgtaaatg

SEQ ID NO: 26465 - DNA, 361 bp, Homo sapiens
  Z98303.1_3313
  Located on chromosome X
  Distance between a terminus base of telomere on chromosomal short arm and 5'-terminus of this base sequence : 120734429
  Distance between 3'-terminus of neighbour sequence of sequence listing upward to telomere on chrosomal short arm and 5'-terminus of this base sequence : 196971
agaaaccatgactcattaattcactcactcacttactgacttaattactcagcaaatatgtgccttttggtctcctgcctcttgaccttatcctctttccagaaaactaaatttctattcaaaattcagtctgaaagaaattagaccagcattatcaaaagtgtgctccacataatactaattcttcaggatgctaaaagatgtatacatacacacacacacacacacacacacacacacacacacacacaaataattctatggccaaatcagtttgggaaatcatggattaaataaacagctttctttattgaagagcttttcagagcctctaataaactattatgcattggaattctgc

SEQ ID NO: 26466 - DNA, 170 bp, Homo sapiens
  Z66856
  Located on chromosome X
  Distance between a terminus base of telomere on chromosomal short arm and 5'-terminus of this base sequence : 120734810
  Distance between 3'-terminus of neighbour sequence of sequence listing upward to telomere on chrosomal short arm and 5'-terminus of this base sequence : 20
tgcagtatttccccagtgtattaaacaatcttttgacctgacttggttgtgtgtgtgtgtgtgtgtgtgtgtgtgtgtgtgtgtattttgtttgtttaaggaacatctctatgaaacatattttgatcaatgttccactagtagagtctagggtttgtttgctctacatg

SEQ ID NO: 26467 - DNA, 174 bp, Homo sapiens
  Z82242.1_47092
  Located on chromosome X
  Distance between a terminus base of telomere on chromosomal short arm and 5'-terminus of this base sequence : 120869233
  Distance between 3'-terminus of neighbour sequence of sequence listing upward to telomere on chrosomal short arm and 5'-terminus of this base sequence : 134253
aagcattacttcaggttcacactgcaattagctgccctcaacacacacacacacacacacacacacacacacacggagagagagagagagagagagagagagagagacagagaatgagagagagagaagtagagagagagtattcaaggagtaatcaaagactgcactatcctt

SEQ ID NO: 26468 - DNA, 197 bp, Homo sapiens
  chrX.fa.O7frz.125687321
  Located on chromosome X
  Distance between a terminus base of telomere on chromosomal short arm and 5'-terminus of this base sequence : 120961704
  Distance between 3'-terminus of neighbour sequence of sequence listing upward to telomere on chrosomal short arm and 5'-terminus of this base sequence : 92297
tccatttatgaccatttatcagaggtgagaatgttgctttagtttccccgtctaagcacccttttttgtttgttttcagagatgttcgatttgttttgtgtatatatatatatatatatatatatatatatcctgttcacataggcaatatctttaccctgttaaaagtgattgtgttagtctgtttgcattgctat

SEQ ID NO: 26469 - DNA, 359 bp, Homo sapiens
  chrX.fa.O7frz.128234556
  Located on chromosome X
  Distance between a terminus base of telomere on chromosomal short arm and 5'-terminus of this base sequence : 121159309
  Distance between 3'-terminus of neighbour sequence of sequence listing upward to telomere on chrosomal short arm and 5'-terminus of this base sequence : 197408
cttcagaattcatctgcaataccagctcttccctgagtctccagcccattggcttctcccatcagatttttgacttaccaagcctttgtaatggtgagaccaaattccttaaaataaatctcttcatttatacatatatacataacacacacacacacacacacacacacacacacacacaccttatcagttctgttctctggagaacactgataataatacaatacctatgcagaaaagtgaattaaatataaatatataacaaataattaaaatggtaaacatcagagtttacagatcaagaaataaagctttcccaatgttctatttgtgatgtattgataaggtacgtgaatacc

SEQ ID NO: 26470 - DNA, 158 bp, Homo sapiens
  DXS8093
  Located on chromosome X
  Distance between a terminus base of telomere on chromosomal short arm and 5'-terminus of this base sequence : 121296448
  Distance between 3'-terminus of neighbour sequence of sequence listing upward to telomere on chrosomal short arm and 5'-terminus of this base sequence : 136780
aagggcaggttttttggagacaataaagtggctatttgcacacccggagtggaatggacccccaaacacacacacacacacacacacacacacacttctgctctgaaagggaaggtgggtttgagaggtgacagcatgctagcagtcctcagagccct

SEQ ID NO: 26471 - DNA, 193 bp, Homo sapiens
  Z79699.1_2605
  Located on chromosome X
  Distance between a terminus base of telomere on chromosomal short arm and 5'-terminus of this base sequence : 121424444
  Distance between 3'-terminus of neighbour sequence of sequence listing upward to telomere on chrosomal short arm and 5'-terminus of this base sequence : 127838
atagtgccatgcacttgtatttccagctacttgagaggctgaagcaagaaggttcctcaggagtagaagcccagaagtccaagaccagtctgggcaatatagtgagattctctctctctctctctctctctctctgtctctctctctctgtgtgtgtgtgtgtgtgtgtgtgtatgaatttctcactgcttgg

SEQ ID NO: 26472 - DNA, 405 bp, Homo sapiens
  chrX.fa.O7frz.127835094
  Located on chromosome X
  Distance between a terminus base of telomere on chromosomal short arm and 5'-terminus of this base sequence : 121513700
  Distance between 3'-terminus of neighbour sequence of sequence listing upward to telomere on chrosomal short arm and 5'-terminus of this base sequence : 89063
ttcataagatgagtttggaagtactctctttttctctatttttcagaatattttgagtagcattagtattagttctttatgtttggtataactaatcagtgaagtcattggatcctgggtttttctttgctgggaggctttttattatgacttctatctcatttctgttcatgttttggatttcttcgtgtttcaatctgtattagtcagggttctctagaggaacagaactcataggatatatctatatatctatatctatatctttatctatctgtctatctatctatctatctatctatctatctatctatctatctatctatatctggcactggagaaatgaccacaggatgagtccagggacccactgggccccgtgtaagtcagacctgaggtaaaact

SEQ ID NO: 26473 - DNA, 391 bp, Homo sapiens
  AL034407.1_56994
  Located on chromosome X
  Distance between a terminus base of telomere on chromosomal short arm and 5'-terminus of this base sequence : 121588091
  Distance between 3'-terminus of neighbour sequence of sequence listing upward to telomere on chrosomal short arm and 5'-terminus of this base sequence : 73986
aatattgttcttgcagtatgcacaggaagatatttgaatcctgatgtgtgtgtgtgtgtgtgtgtgtgtgtgtgtgtgtgtgtgtgtgtgtttacctacatgcatgctgcatttgtgagacttcatgaataagtagagggtgatacatatgtaacttaaccctgtttcatatgttctgtgttatagatgtatccatgttttctcttttatactgaatttatgctcagatattaaaagatactattacatgtgatttgctttttaaatgaagacaagcatttaataaagtcacccttggatattctagaaatagaaggatgaaaattatttcatggatggacttaatttcatgcatgcacttttccactagtggaaccatccacactagtta

SEQ ID NO: 26474 - DNA, 407 bp, Homo sapiens
  AF001905.1_165688
  Located on chromosome X
  Distance between a terminus base of telomere on chromosomal short arm and 5'-terminus of this base sequence : 121685251
  Distance between 3'-terminus of neighbour sequence of sequence listing upward to telomere on chrosomal short arm and 5'-terminus of this base sequence : 96769
ctgtattggtaatggactggagagggcctcactttaccataatctctgcacagatgcacaggaagggtgagaattaaaataattttaagaaaatcttctttgatatggcagaatatattttggtacatatattaatcagagtttttcagggaaacaaaaccaataggatatttgtatttgtgtgtgtgtgtgtgtgtgtgtgtgtgtgtgtgtgtgtgtgtacacagtgataaaagagagatagagatttacagagaaagacttattttaagaaatttgctcatgtagttgtagattttggcaagtctaatatctacaagccaggccaactagaaattaccacaggagttgatgctgcagtcttgagttttaaggtagtctggaggtagaattctttcctggagacc

SEQ ID NO: 26475 - DNA, 356 bp, Homo sapiens
  chrX.fa.O7frz.127487381
  Located on chromosome X
  Distance between a terminus base of telomere on chromosomal short arm and 5'-terminus of this base sequence : 121794592
  Distance between 3'-terminus of neighbour sequence of sequence listing upward to telomere on chrosomal short arm and 5'-terminus of this base sequence : 108934
cgtgacatgagtttacctagagcaattctgcacatgtacctctgaaccaaatataaaattttttaaaaagcaaaatcagtttacaggaataaaaaataagaaataaaaagaaaaaaatggtaggatccctttttttcatggctgaagggtactccactgtgtgtgtgtgtgtgtgtgtgtgtgtgtgtgtgtgtgtgtgtgtgtatataaattttctttatccattcatctgttgatcaacacttgggttacatccaaatcttggctattgtgaatagcactgtaataaacatgggcatgcagacatctcttcaatatacacatttcctttcttcttggtacatacctagcagtga

SEQ ID NO: 26476 - DNA, 332 bp, Homo sapiens
  chrX.fa.O7frz.127254483
  Located on chromosome X
  Distance between a terminus base of telomere on chromosomal short arm and 5'-terminus of this base sequence : 122027879
  Distance between 3'-terminus of neighbour sequence of sequence listing upward to telomere on chrosomal short arm and 5'-terminus of this base sequence : 232931
tctattcaatagaaagcctcaaggttaatattctgtatctgttgagacttatcaatacctgtgttatactgattgctaaatattttgaatattaccaccaaataaactacagtttattccactaattcactattgtacattcgggctaccaaaatgctgaaaaaaattacacacacacacacacacacacatgcatgcatatctatatctatatgtacatacatactagtacttttatttttcttgtaggcaaaattcttaaaagagtgattgctgggccaaacaatatgtatatatttcttttattagttattgcaagattttctaagtca

SEQ ID NO: 26477 - DNA, 468 bp, Homo sapiens
  chrX.fa.O7frz.127047750
  Located on chromosome X
  Distance between a terminus base of telomere on chromosomal short arm and 5'-terminus of this base sequence : 122184814
  Distance between 3'-terminus of neighbour sequence of sequence listing upward to telomere on chrosomal short arm and 5'-terminus of this base sequence : 156603
acctctatttcctgtgctttacaactcagctgagagaatttgccttccagtcattagagtagctgagagagtgtcaatgtttcaaatatatatttttttaatctggaagacaataaataaaatctattcagctattattctgtactaaaataatatgtgtgtgtgtgtgtgtgtgtgtgagagagagagagagagagagacagagagtgtatgtgcatggggaagtgtgattttatcatataggacttactttgaagcagaagaacaaaatcagtgttttttttcaataggaatgtttaggaagcaaaggagaaaatgtagaaaatatacaatccaataataatggaatcatagctttataattatcagcactttccttgccttttacccaactctgctcatctctgttcccagataatttaattattattactatatttgataaacttcatattgctatttaggcaa

SEQ ID NO: 26478 - DNA, 328 bp, Homo sapiens
  chrX.fa.O7frz.128779826
  Located on chromosome X
  Distance between a terminus base of telomere on chromosomal short arm and 5'-terminus of this base sequence : 122314940
  Distance between 3'-terminus of neighbour sequence of sequence listing upward to telomere on chrosomal short arm and 5'-terminus of this base sequence : 129658
gacctatgtttatccagataatgagttaccctatgagacctgggttgagattctctctctctctctctctctctctttaatatacacacaaacacactacaagaagagaagcaatcagaggcatggatatacatagggcaagcaaatatctgactacaaagcctactaaatgaactataagatctgatggcaaataaagatctaagcaggcaaggagatagaatcagggttggggtagtgtcttatggaagtaatttaacacaaagaaatataaacactgtgacagatcagaaaataaaacacagtagaaattaacaagtgtttacgg

SEQ ID NO: 26479 - DNA, 390 bp, Homo sapiens
  chrX.fa.O7frz.128570726
  Located on chromosome X
  Distance between a terminus base of telomere on chromosomal short arm and 5'-terminus of this base sequence : 122502530
  Distance between 3'-terminus of neighbour sequence of sequence listing upward to telomere on chrosomal short arm and 5'-terminus of this base sequence : 187262
taaacaatatcaaggatgtcaaactgccaaaagcaagatgtatatagttaaaatgaaaactgcagacactttttaaaataaaataagctgaaacatcttcttctgatatagtctcattaagagaactctgcatttagatctctctctctctctctctctctctttaataggaccactgaccttctctacttgaataattatatatcacattgtaaagaaaaactccgggagcatccatactggtgggaggctagatacttcatactctcactttccaaattaaaaaaataaatacaaaaatcccatccaagagagaactgggtgtctcaatttggaaattttcacagcgtgagaagaaatgaatagctacgtgtctactttcaagtcatt

SEQ ID NO: 26480 - DNA, 247 bp, Homo sapiens
  chrX.fa.O7frz.130541813
  Located on chromosome X
  Distance between a terminus base of telomere on chromosomal short arm and 5'-terminus of this base sequence : 122784536
  Distance between 3'-terminus of neighbour sequence of sequence listing upward to telomere on chrosomal short arm and 5'-terminus of this base sequence : 281616
ttcaatcattgagtggataaagaatatgtggcacacacacacacacacacacacacacacacacacacacacacaaatacacaccatggaatacttttcagccataaaaaggaacagagtaatgggatttgcggcaacctggattgaattcaagaccattattctaagtgaactaatttgggaacggaaaaccaaacattgtaggttcgcactcataagtgggagctatgcactttgtagactcagg

SEQ ID NO: 26481 - DNA, 234 bp, Homo sapiens
  DISO7_10004787
  Located on chromosome X
  Distance between a terminus base of telomere on chromosomal short arm and 5'-terminus of this base sequence : 122860160
  Distance between 3'-terminus of neighbour sequence of sequence listing upward to telomere on chrosomal short arm and 5'-terminus of this base sequence : 75377
gaatgtgcctcagtgctgctaaaatatatatttctttgcccgaatgatggatggatatatatatatatatatatgcacatacatatatttttgtaagatagtatctaattgtatacttatgatttgtacatgtttctatatatattgtacttcagttaaatattagaacaaatttaaaagtaaaaaatagtctttctagataaaaattactatactctgcttgttctattgacc

SEQ ID NO: 26482 - DNA, 391 bp, Homo sapiens
  chrX.fa.O7frz.130353909
  Located on chromosome X
  Distance between a terminus base of telomere on chromosomal short arm and 5'-terminus of this base sequence : 123029110
  Distance between 3'-terminus of neighbour sequence of sequence listing upward to telomere on chrosomal short arm and 5'-terminus of this base sequence : 168716
aatcagtttgatttagccattccacaatgtgtgtgtgtgtgtgtgtgtgtgtgtatacatttcaaaacatcatgtttacatgatacatatacataagtttatctgttaatttaaaaattaaaataaaacatttcagggatagaggatgataagacaacaaatgtaaaacaccccaaatttcaccacctatgcatagttatttctatcataaatgaaccatgaaccatcactcataatagctattttcatacatacaggtaggtgactaacaagtatctagatagaaataaggagaaattatgtcacacatgctatatttaattttatgtgaattaatttagcacaaagaatcactttgcaggagtaaatctgaaggtattgctaaacttca

SEQ ID NO: 26483 - DNA, 400 bp, Homo sapiens
  chrX.fa.O7frz.130272997
  Located on chromosome X
  Distance between a terminus base of telomere on chromosomal short arm and 5'-terminus of this base sequence : 123109977
  Distance between 3'-terminus of neighbour sequence of sequence listing upward to telomere on chrosomal short arm and 5'-terminus of this base sequence : 80476
aatttaaccatgtaggttgaattatcccagtgcctgtgtgtgtatatgtgtgtgtgtgtgtgtgtgtgtgtgtgtgtgtgtgtgtgtgtctgtgtgtgtcttgccacagagcattttctaaaatattttgaaaaagttaccataaaaatgaattactgaagcctcaaaactaatccttggggaaaaagagaatttgatttcccaagttacctcattagaatactcaaagtattcaattattaataaaagattacaaagcctacacaaaaacagaaatacatggctcactaacaggaaaaatactagataaaattatattttgtaaaccaagacactggaattactagataaagatatcaaatcatctgttttatatatgatcaaagagttaaagaaaccg

SEQ ID NO: 26484 - DNA, 172 bp, Homo sapiens
  Z70272.1_70694
  Located on chromosome X
  Distance between a terminus base of telomere on chromosomal short arm and 5'-terminus of this base sequence : 123335757
  Distance between 3'-terminus of neighbour sequence of sequence listing upward to telomere on chrosomal short arm and 5'-terminus of this base sequence : 225380
aaggaactaaagtgaagccatgtttggctagcctgcatgttgtcagtggcaagcacatcacttggtacaaggcacaccagacaaacacacacacacacacacacacacacacacacacacacacaccagttcttttgcttccaactctttaacgtgtctcaaatccatctac

SEQ ID NO: 26485 - DNA, 278 bp, Homo sapiens
  Z82253.1_27547
  Located on chromosome X
  Distance between a terminus base of telomere on chromosomal short arm and 5'-terminus of this base sequence : 123351540
  Distance between 3'-terminus of neighbour sequence of sequence listing upward to telomere on chrosomal short arm and 5'-terminus of this base sequence : 15611
tgattatatgccattatcataggagtgggtttgttataaaagggcaagtatgattctctctctctctctctctctctctctctctctctctctctctctctctatatatatatatatatatatatatatatatatatatatatatatctgtctctatctctatctctgcatttatctctatctctcccttcctctttccagtatgtgtgtacacaacatgaaagccttctttactagatggcagggacttaaatttgaactttctagctgccaggtat

SEQ ID NO: 26486 - DNA, 193 bp, Homo sapiens
  Z82900.1_46797
  Located on chromosome X
  Distance between a terminus base of telomere on chromosomal short arm and 5'-terminus of this base sequence : 123638327
  Distance between 3'-terminus of neighbour sequence of sequence listing upward to telomere on chrosomal short arm and 5'-terminus of this base sequence : 286509
cttgtagtctatgctttagccataccaaattaatttctgttccctaaaagagctcaaggcctctgtacattgtcttcctgttgtttgaaacacctttctctctgacacacacacacacacacacacacacactctctcactctcactctctctctgtccctcaacctggctcactcctactcaatctgagaac

SEQ ID NO: 26487 - DNA, 234 bp, Homo sapiens
  Z67729
  Located on chromosome X
  Distance between a terminus base of telomere on chromosomal short arm and 5'-terminus of this base sequence : 123706274
  Distance between 3'-terminus of neighbour sequence of sequence listing upward to telomere on chrosomal short arm and 5'-terminus of this base sequence : 67754
atcctccaggttcatccatgttgttttaaaacacagaattttatttttattttgtaagactgaaaaatactccattgtgtgtgtgtgtgtgtgtgtgtgtgtgtattattctgcagtatcaattgtaatgtcttctctttcttttatgattttatttatttgagtcttttctttttttcttagtttgtctagctaaaggtttggccattttgcttgtgttctcaaaaaagccaa

SEQ ID NO: 26488 - DNA, 349 bp, Homo sapiens
  chrX.fa.O7frz.132706878
  Located on chromosome X
  Distance between a terminus base of telomere on chromosomal short arm and 5'-terminus of this base sequence : 123825768
  Distance between 3'-terminus of neighbour sequence of sequence listing upward to telomere on chrosomal short arm and 5'-terminus of this base sequence : 119260
atgttccattactcttgagtacacacagtaacaattacagtgactgactgtacgctcaaacactggccacacacacacacacacacacactgaattgagacacacagaaatatccaatttcttactaatattttcaaaacagcgtcttcattgaatgactgcaactgctgcattcttttctaatttttgtgcagacaaagacattgctaatttataacatagttaaaccagaactgttttcatgaatttctggacattttaaaagtagaacactaatttttcttcccaaataatttcagatttggcagggcacagtgactcaaacctgtaatctcagtactttgaaagg

SEQ ID NO: 26489 - DNA, 454 bp, Homo sapiens
  chrX.fa.O7frz.132577641
  Located on chromosome X
  Distance between a terminus base of telomere on chromosomal short arm and 5'-terminus of this base sequence : 123954898
  Distance between 3'-terminus of neighbour sequence of sequence listing upward to telomere on chrosomal short arm and 5'-terminus of this base sequence : 128781
taaatccatctgatctcatgagacttatttactaccatgagaacagtatgcaggaaactgcccccatgattcaattatctcccaccaggtcccttccactagtggaaattatgggagctacaattcaagatgagatttgggtggggacacagccaaaccatatcagttatacacacacacacacacacacacacacatatatacacatatacacacacacacccatatacttgtatattttatacagtcattttaagcctttttaagtcattttaagaactatccaataattccaattttattgagagttactttttagttgggaatacatatttaatgtcatatttcttttcagcagttctcatatgaattttttctctgttttcattgaatatggtggaagaatggcaagggaaagagtaattcaaatgactttatggagtaagtcatgttg

SEQ ID NO: 26490 - DNA, 134 bp, Homo sapiens
  DXS8038
  Located on chromosome X
  Distance between a terminus base of telomere on chromosomal short arm and 5'-terminus of this base sequence : 124108391
  Distance between 3'-terminus of neighbour sequence of sequence listing upward to telomere on chrosomal short arm and 5'-terminus of this base sequence : 153039
ccaagatgtgagcattttttccaacagtctgaagtgaaaagtgattttgagtgtgtgtgtgtgtgtgtgtgtgtgtgtgtgtgcgcgcgcgcggcggggcggtggggtggggtacggttacggagacagtccac

SEQ ID NO: 26491 - DNA, 312 bp, Homo sapiens
  chrX.fa.O7frz.132309501
  Located on chromosome X
  Distance between a terminus base of telomere on chromosomal short arm and 5'-terminus of this base sequence : 124182335
  Distance between 3'-terminus of neighbour sequence of sequence listing upward to telomere on chrosomal short arm and 5'-terminus of this base sequence : 73810
ttgtctaactgccaatttctagcaaatagagggtaaaggaatattttaagtgattctactaggatgcaatcagcaaaatccagactgagagagagagatagagataaagatagaatagagagatagagagatagatgatagatagatagatagatagatagatagatagatagatagatagatatagagttagagaaagttagagatagagatagaagagagagtttatatgcctcttaagtctcatttaatttttaggttcctctctcttctctaattgcaatattgcagtgtaggaaccttatttggatc

SEQ ID NO: 26492 - DNA, 272 bp, Homo sapiens
  AL008633.1_29335
  Located on chromosome X
  Distance between a terminus base of telomere on chromosomal short arm and 5'-terminus of this base sequence : 124280973
  Distance between 3'-terminus of neighbour sequence of sequence listing upward to telomere on chrosomal short arm and 5'-terminus of this base sequence : 98326
ctcctgtttcatttcttagtgaagttatttggattttctctcttcttttcttggttaatcttgccaatgatctatcaatttcatctgttcaaagaaccagcttttttttatcatttatcttttgtattgtgtgtgtgtgtgtgtgtgtgtgtgtgtgtgtgtgtgtgtttcaatttcatttagttctgctctgatcttggttatttcctttcttctgctgggtttcagtttggtttgtccttgtttctctagttccttgagatgtgacctta

SEQ ID NO: 26493 - DNA, 264 bp, Homo sapiens
  AL022162.1_74436
  Located on chromosome X
  Distance between a terminus base of telomere on chromosomal short arm and 5'-terminus of this base sequence : 124736175
  Distance between 3'-terminus of neighbour sequence of sequence listing upward to telomere on chrosomal short arm and 5'-terminus of this base sequence : 454930
taggacaactctgaccagaaactggggtaatggcaatgagcggagggagtagattaaagggagagatgccccacccttacttgggataaagagctcccctcttgcttcccccttcatttttactgattgcttacttggtgccaagcattatcagaaacacacacacacacacacacacacacacacacacacacacacacacacatagcattaacacacatggtccctatgaggcaggcactatcattgcctccatcttataga

SEQ ID NO: 26494 - DNA, 478 bp, Homo sapiens
  chrX.fa.O7frz.131781261
  Located on chromosome X
  Distance between a terminus base of telomere on chromosomal short arm and 5'-terminus of this base sequence : 124839865
  Distance between 3'-terminus of neighbour sequence of sequence listing upward to telomere on chrosomal short arm and 5'-terminus of this base sequence : 103426
aactgtgaaccaattaaacctcttttctttataaattacccaatctcaagtatttctttatagcaatgcaaaatggtctaacacaatcaccaacagatttcacaagaagaaggaggagccatgggcagctgtgagctgctgaaaaggagctgaccactggatccaccaaccacagcgaaggacgtccaaccctcgccctgaggacagaaactcccttctctgatgcctggctgtctgggtgaggtcttgggcctcatagcaccaaagatcaaatgccatgaaatgagctctttccccctgctgtgtgaccacaccctacacacacacacacacacacacacacacacacacacacacacacacagaggcagggtagctttgtatcaaagcagggcagatgtgatggatgaggcacccaacagcaccacagcagccttctggggctggaaaattgccctccattcagagtattcctttc

SEQ ID NO: 26495 - DNA, 308 bp, Homo sapiens
  chrX.fa.O7frz.131428030
  Located on chromosome X
  Distance between a terminus base of telomere on chromosomal short arm and 5'-terminus of this base sequence : 124971333
  Distance between 3'-terminus of neighbour sequence of sequence listing upward to telomere on chrosomal short arm and 5'-terminus of this base sequence : 130990
atacagattacaagtgaagaccattttatcaaggaatacatagttccttgtcttgttttaatttggatgtaataatgacaagagaccaaataccttagggtaaaagaatgctttattgaggactccttttcctcaaaatttctgccttctcccagtgactgtaagatcaaatttcacaaattttaaacacacacacacacacacacacacacactgaaatttcccttgtccaaactgagcctctaatatgaagatacactcctttttcatctgaactctaaggcctgtctaaacttgaggatgtctac

SEQ ID NO: 26496 - DNA, 202 bp, Homo sapiens
  DXS1047
  Located on chromosome X
  Distance between a terminus base of telomere on chromosomal short arm and 5'-terminus of this base sequence : 125046679
  Distance between 3'-terminus of neighbour sequence of sequence listing upward to telomere on chrosomal short arm and 5'-terminus of this base sequence : 75038
cctaggtaacatagtgagaccttgtctctacttactatctatctatctatctatctatctatctatctatctatctatctatcatctatctgtgtgtgtgtgtgtgtgtgtgtgtgtgtgtgtgtgtgtgtatcacatgctcattgtagaagtttttaaaatactggaaactagaaagataatagacatcacttgtagccgg

SEQ ID NO: 26497 - DNA, 179 bp, Homo sapiens
  Z67077
  Located on chromosome X
  Distance between a terminus base of telomere on chromosomal short arm and 5'-terminus of this base sequence : 125106139
  Distance between 3'-terminus of neighbour sequence of sequence listing upward to telomere on chrosomal short arm and 5'-terminus of this base sequence : 59258
cagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttca

SEQ ID NO: 26498 - DNA, 351 bp, Homo sapiens
  Z81364.1_29673
  Located on chromosome X
  Distance between a terminus base of telomere on chromosomal short arm and 5'-terminus of this base sequence : 125209457
  Distance between 3'-terminus of neighbour sequence of sequence listing upward to telomere on chrosomal short arm and 5'-terminus of this base sequence : 103139
gttaggcctctcaaagaaactaacttactcttatttctgcagtgaatgatgctcaagatgaaaatggtgaaggactaaagaaggcaatgttagtacaaatattaacgatttgagttttgctcttcactacagcactgcctgccattcagtatattacacacacacacacacacacacacacacacacacacacacaccttctattacatcctttccctatcctgtgcaatggccgagttaacaaaaagcagaaaaacctggaaaatctcccgcttagtttcagaaatgggtgtggcatgccctgcccgcattgccgaagaagtagttggtccctagagcctggcaaagtca

SEQ ID NO: 26499 - DNA, 424 bp, Homo sapiens
  chrX.fa.O7frz.133097412
  Located on chromosome X
  Distance between a terminus base of telomere on chromosomal short arm and 5'-terminus of this base sequence : 125327437
  Distance between 3'-terminus of neighbour sequence of sequence listing upward to telomere on chrosomal short arm and 5'-terminus of this base sequence : 117629
agatgagtaagccacatgacttactctcttattccctttggagaagccctctttgaccacaccatttaaaaaacagaaaccactccttcacctgagccctggcactctctatctacctatattttcttcccatggtacttaccatcagctggcatacatatacattcagacaccacacacacacacacacacacacacacacacacacacacacacacacacacacacccttctctaccatgatgcattatttcagtgagtacaaaccttgctttgcttacttctgtatccccagtacctaaaacagtccttggcatatattaggcactcaaatatttcttaaataaagaaataaagtgaggcaagagactgacagagtacaaatgagcagcaggcacaatttaactagttcaaagtgtctgcc

SEQ ID NO: 26500 - DNA, 286 bp, Homo sapiens
  chrX.fa.O7frz.133237237
  Located on chromosome X
  Distance between a terminus base of telomere on chromosomal short arm and 5'-terminus of this base sequence : 125467385
  Distance between 3'-terminus of neighbour sequence of sequence listing upward to telomere on chrosomal short arm and 5'-terminus of this base sequence : 139524
atatcagcacaatcaaacatcttggcatagctgtgtcacttccacttcattttatttatttatttatttatttatttatttatttatttatttatttattttttgagacggagtcttgctatgttgccaggctggagtgcagtggcgcgatctcggctcactgcaacctccgcctcctgggttcaagcgattctcctgcctcagcctcctgtgtagctgggattattattattatttttttaagtgaaagcaagtttattaagtaaaggaataaagaatggctact

SEQ ID NO: 26501 - DNA, 278 bp, Homo sapiens
  chrX.fa.O7frz.133365068
  Located on chromosome X
  Distance between a terminus base of telomere on chromosomal short arm and 5'-terminus of this base sequence : 125595140
  Distance between 3'-terminus of neighbour sequence of sequence listing upward to telomere on chrosomal short arm and 5'-terminus of this base sequence : 127469
acagtagaatgagttctgagacagaggtaagcctaagcaccatggaagcacagagaaaagacaccctactttgtgaaaaacctatatacaaaaactgaataatataataataataataataataatcatcatcatcatcatcctcatcattgatatggtttggctgtgtccccactcaaatctcaccttggattgtaataatccccacgtgtcaaggtggagataattgaatcattggggcagttttccccatactgttcttgtggtagtgaataagt

SEQ ID NO: 26502 - DNA, 248 bp, Homo sapiens
  Z67016
  Located on chromosome X
  Distance between a terminus base of telomere on chromosomal short arm and 5'-terminus of this base sequence : 125731151
  Distance between 3'-terminus of neighbour sequence of sequence listing upward to telomere on chrosomal short arm and 5'-terminus of this base sequence : 135733
gaatccctcacaaatgcgttagttcataatggagaagtaacaggaagggggaaatcgctgtgttcatacttctctgcatccccatctctctctctctctctctttcacacacacacacacacacacacacacccctcaatacgaaaacaaaaacaaatctgtggactcctttaggacttgttttaggtggtcatcttcacattagtagagttagtaagttaccctcctcactatgagccttggcacca

SEQ ID NO: 26503 - DNA, 311 bp, Homo sapiens
  Z66954
  Located on chromosome X
  Distance between a terminus base of telomere on chromosomal short arm and 5'-terminus of this base sequence : 125842523
  Distance between 3'-terminus of neighbour sequence of sequence listing upward to telomere on chrosomal short arm and 5'-terminus of this base sequence : 111124
gctgaggcaaaatataatggggaaaaagaaggatgacttagccaaagatggtatggcactcctagtcacaaagagcaccacgatacccagaatagcagtggaacaaggttaactatgtgaatttagttcattctcttgtctttgccttaagttacaatcaatggtgcagtttcttaaagcagtttacttgacatatataatctataaagagtattttccaccttttctcttcaaagaagagttacttattgcatgcgcgtgcgcacgcacacacacacacacacacacacaacttacttctgaaatgcttc

SEQ ID NO: 26504 - DNA, 433 bp, Homo sapiens
  chrX.fa.O7frz.133831148
  Located on chromosome X
  Distance between a terminus base of telomere on chromosomal short arm and 5'-terminus of this base sequence : 125938006
  Distance between 3'-terminus of neighbour sequence of sequence listing upward to telomere on chrosomal short arm and 5'-terminus of this base sequence : 95172
tcctgtactagtttcacatcctacacatctagccctagtattaaaaatactgtccatgatattttacttcctggctttgagagcaggggtctcctaggcctgtctataaacctttagggactcaaattccaactttcatcctgtagaaagcatatctgccttcacacaccacccccttttagcaaaatgttggttatgctcaaatgctttgggattaggtgtgaggaaatcttgaattacatacctaaatataactccctaactggtgggccagataaacataagaaagacacatatgttttaataacgtcatctgaagtataagtattcatgtataatcacacacacacacacacacacacacacacacacacacacacacaaacagcactgaattttcttttcaccctagaatgaaagcaggtactaaact

SEQ ID NO: 26505 - DNA, 351 bp, Homo sapiens
  AL022153.1_16459
  Located on chromosome X
  Distance between a terminus base of telomere on chromosomal short arm and 5'-terminus of this base sequence : 126018888
  Distance between 3'-terminus of neighbour sequence of sequence listing upward to telomere on chrosomal short arm and 5'-terminus of this base sequence : 80449
gagttgaattagtatgacagaggaggaagtgctaagaaaaatatcttcatgtttttcctccatcgtaggttcagatccaaaaacatattctcccataccatattgacaaactctccaaggttctccacctaaagacccatttgtaatccagctgaaaacagacaggggttggatgctaacctcaaaacctgattactgctgctgctgctactactactactactactactactactactactattacttgtactactatactaacattgagtacaacttgccaacttcttgttctagagcttagaatccaagctctttcaatatattggctcgtgtaatcgtcataacaat

SEQ ID NO: 26506 - DNA, 241 bp, Homo sapiens
  DXS8068
  Located on chromosome X
  Distance between a terminus base of telomere on chromosomal short arm and 5'-terminus of this base sequence : 126091332
  Distance between 3'-terminus of neighbour sequence of sequence listing upward to telomere on chrosomal short arm and 5'-terminus of this base sequence : 72093
acttagcataatgtcctccaggttcatccatgttgttccaaatgacagtatctccttattttttaaggctgaataatattccattatatatatacacacacacacacacacacacacacacacacacacacacacgcacacacacacacacaccccagaattttttttccttttttgagttataattatgtttaacttttattttaagttcacgggtacatgtgcaggttctttacagagg

SEQ ID NO: 26507 - DNA, 235 bp, Homo sapiens
  Z66935
  Located on chromosome X
  Distance between a terminus base of telomere on chromosomal short arm and 5'-terminus of this base sequence : 126157393
  Distance between 3'-terminus of neighbour sequence of sequence listing upward to telomere on chrosomal short arm and 5'-terminus of this base sequence : 65820
agcgtagaccagtggggtggctgcctgggaggagattctccttaacttatacttgtgtgtgtgtgtgtgtgtgtgtgtgtgtgtgtatacataatagcacaataaattatctctatctatatatatatatatatatagataaagggagagagaaagagagagtcatatatatatatatacttgaaaatatgttgcagatatcatgacatttcactcctaaatacttcagaatgca

SEQ ID NO: 26508 - DNA, 440 bp, Homo sapiens
  Z77723.1_7018
  Located on chromosome X
  Distance between a terminus base of telomere on chromosomal short arm and 5'-terminus of this base sequence : 126294050
  Distance between 3'-terminus of neighbour sequence of sequence listing upward to telomere on chrosomal short arm and 5'-terminus of this base sequence : 136422
ggatttatggcaaattatgtaacttctcctgaagattaaatgagataatattgtctactgggcatagagaagatggtctaggatgaagagacataaaatgggttgttttctggggacaagagagggcaaaattctggaatgtagtttgaaaagggtaaagccaaaataggactttgtgtgtgtgtgtgtgtgtgtgtgtgtgtgtgtgtgtgtgtttgtggtggggtgtggggggggcagtgacagtacagggtaggacagcaaagaatgtagtagtatagttttaaaagtattggaagcagaatcataaatatctaggttcaaaacatgcctctgacaccaattagctttgtggaccttaggcatgtcactacatcttatggaactccattttctataccattaaaatgagggtggtcattaaatctgcttggataatt

SEQ ID NO: 26509 - DNA, 322 bp, Homo sapiens
  chrX.fa.O7frz.137143257
  Located on chromosome X
  Distance between a terminus base of telomere on chromosomal short arm and 5'-terminus of this base sequence : 126505954
  Distance between 3'-terminus of neighbour sequence of sequence listing upward to telomere on chrosomal short arm and 5'-terminus of this base sequence : 211464
ttagatgctcactgattcctactttctccattccttcatgaccactcccatttactactttttttctccctattttaccaaatggaagcagaggtattatgtgtccacattattattattttagatggacagaagtgaacctttgacagactagctgaagtatactgaagtataatttccatactccactccctattacacacacgcgcgcgcgcgcacacacacacacacacacacacacacacagagagagagagagagagagactttgctcagaatggatgaaagaagggtctttcacttgtgatggtaattcactcat

SEQ ID NO: 26510 - DNA, 378 bp, Homo sapiens
  AL049734.11_76875
  Located on chromosome X
  Distance between a terminus base of telomere on chromosomal short arm and 5'-terminus of this base sequence : 126605634
  Distance between 3'-terminus of neighbour sequence of sequence listing upward to telomere on chrosomal short arm and 5'-terminus of this base sequence : 99358
ctcagatctgtaatctcagcactttgggagaccgatgcaggtggatcacttgaagtcaggagttcaaaatcagcccggccaacatggtgaaaccctgtctccactaaaaacacaaaaattagcctggtatggtggcgtgtgcctgtaatcccagctactcgggaggctgaggcaggagaatcgcttgtacatagggggtggaggttgcagtgagcccagattgcgccactgcactccagtctgggcagcagagtaaaactccgtctcaaaaaaaaaaagaaagaaagaaagaaaagaaaagaaaagaaaagaaaagaaaagaaaagaaaagaaaagaaatctataggaaaataaaactggatctttctcatgatacct

SEQ ID NO: 26511 - DNA, 322 bp, Homo sapiens
  chrX.fa.O7frz.136837738
  Located on chromosome X
  Distance between a terminus base of telomere on chromosomal short arm and 5'-terminus of this base sequence : 126811333
  Distance between 3'-terminus of neighbour sequence of sequence listing upward to telomere on chrosomal short arm and 5'-terminus of this base sequence : 205321
ggcaagatactcatagtacatatgttcaattcctgtccaggttactcagtgtttcatctcggggtctcatcatctaacatcaaaacacagcatgttcccatgccattacatattcttcaggtatttcctgagactttatggtgtgtgtgtgtgtatgtgtgtgtgtgtgtctgtctgcattttataatttgtcttttaggtataatgtttacagtattctcccactaattaattaaaaaataatggctgccaaagattcggaaaaatccacatactactaaagaagaaaaacactaccatacaacgtgtcaaggcaactaac

SEQ ID NO: 26512 - DNA, 244 bp, Homo sapiens
  AL008629.9_136687
  Located on chromosome X
  Distance between a terminus base of telomere on chromosomal short arm and 5'-terminus of this base sequence : 126928347
  Distance between 3'-terminus of neighbour sequence of sequence listing upward to telomere on chrosomal short arm and 5'-terminus of this base sequence : 116692
atttcatttaccatttgaagacactttccgatgccattaagtggtctccaattgcttcctaccactttattggatatgtagggacatgtgtgtgtgtgtgtgtgtgtgtgtgtgtgtatttatctttatatctgtatttaccatttatctcttagagataagccttaaaaccacttcctcattagtaattaagacatgatgtttgccaaggattcagaaataaccatgcactgataaagagtaa

SEQ ID NO: 26513 - DNA, 128 bp, Homo sapiens
  HUMUT763
  Located on chromosome X
  Distance between a terminus base of telomere on chromosomal short arm and 5'-terminus of this base sequence : 127004556
  Distance between 3'-terminus of neighbour sequence of sequence listing upward to telomere on chrosomal short arm and 5'-terminus of this base sequence : 75965
agaggagttgcaacccagaatatctatctatctatctatttatctatctatctatctatctatctatctatctatctatctatcatctatctatcgattgagagagatggcttttcattgagtagctg

SEQ ID NO: 26514 - DNA, 121 bp, Homo sapiens
  DISO7_10004795
  Located on chromosome X
  Distance between a terminus base of telomere on chromosomal short arm and 5'-terminus of this base sequence : 127126072
  Distance between 3'-terminus of neighbour sequence of sequence listing upward to telomere on chrosomal short arm and 5'-terminus of this base sequence : 121388
ttcaaatgttgacaccttcacaagatttaatttatagatacacacacacacacagacacagacacacacacacacacacacaggaaaaatcatttaaaagcccacaagcaatcccatgtaa

SEQ ID NO: 26515 - DNA, 111 bp, Homo sapiens
  DISO7_10004797
  Located on chromosome X
  Distance between a terminus base of telomere on chromosomal short arm and 5'-terminus of this base sequence : 127174767
  Distance between 3'-terminus of neighbour sequence of sequence listing upward to telomere on chrosomal short arm and 5'-terminus of this base sequence : 48574
tggagtttcaaggtgatatacatacatacacatatatatatatatatatatatatatatatatatatatatattattttctttttccttttacgttaggctgacatttggt

SEQ ID NO: 26516 - DNA, 117 bp, Homo sapiens
  DISO7_11785109
  Located on chromosome X
  Distance between a terminus base of telomere on chromosomal short arm and 5'-terminus of this base sequence : 127231427
  Distance between 3'-terminus of neighbour sequence of sequence listing upward to telomere on chrosomal short arm and 5'-terminus of this base sequence : 56549
ccacagatgactcactactgctatcatcatcatcaccaccattatcatcatcatcactatcatcatcatcatcatcatcatcaatctattattgttaagcagagaaggtactattgg

SEQ ID NO: 26517 - DNA, 109 bp, Homo sapiens
  DISO7_10004792
  Located on chromosome X
  Distance between a terminus base of telomere on chromosomal short arm and 5'-terminus of this base sequence : 127308866
  Distance between 3'-terminus of neighbour sequence of sequence listing upward to telomere on chrosomal short arm and 5'-terminus of this base sequence : 77322
ggtcaatgacaatgaacactgtaattttgagagagagagagagagagagagagagagagagagagagagagagagagagagagaaacaagaacacaatctacaggaaag

SEQ ID NO: 26518 - DNA, 197 bp, Homo sapiens
  DXS8071
  Located on chromosome X
  Distance between a terminus base of telomere on chromosomal short arm and 5'-terminus of this base sequence : 127407144
  Distance between 3'-terminus of neighbour sequence of sequence listing upward to telomere on chrosomal short arm and 5'-terminus of this base sequence : 98169
cataatgccatcaagtttcatcaactctgtcccatatcataatttccttctttttaaaggccaaataatattcatgtgtgtgtgtgtgtgtgtgtgtgtgtgtgtgtgtgtgtatgcatgcatatatttaccacattttctctattcattcatttattaatggacatttagattgtttccacatcttggttattgtg

SEQ ID NO: 26519 - DNA, 456 bp, Homo sapiens
  chrX.fa.O7frz.135855665
  Located on chromosome X
  Distance between a terminus base of telomere on chromosomal short arm and 5'-terminus of this base sequence : 127697165
  Distance between 3'-terminus of neighbour sequence of sequence listing upward to telomere on chrosomal short arm and 5'-terminus of this base sequence : 289824
actaccttccactttagatggtgaatgctccttgttcatcactatatacctacggcctagcacagtatctagcgcagagcagagttcagtaaacatttgttgaatgaatgaatgaatgaatgaatgaatgaatgaatcagtcaagcaactggagctgcagtttgcttaaaggagacttcttggggaattcagccagaggagcaacagaagtagcaggagccagagagcgaggaagcatgcactcatccagtcataattatctaaagtgcccctgcccttgcattcccctttgttgttcagtaatacacaacaggatgcacctgcccagatatggaaactctagcagggtagataggaaagctgatacaaagcccctgttaattaaaaagcatttgcaactggaattgtcttctggctaacacaaagtgccctgcctcctgatgcatttaatgtcta

SEQ ID NO: 26520 - DNA, 310 bp, Homo sapiens
  Z86064.1_115134
  Located on chromosome X
  Distance between a terminus base of telomere on chromosomal short arm and 5'-terminus of this base sequence : 127814997
  Distance between 3'-terminus of neighbour sequence of sequence listing upward to telomere on chrosomal short arm and 5'-terminus of this base sequence : 117376
gacaagacactcctattagtggacttaccatccagagcccaatgtgctcgtcttctactccagccgcaagaaataagtaatctacaatgtactgacctaccccatgatttagagtccctacacagtgaagagaggctatgatcccttccacaaaatttggccttgtgaacaaaaacaacacaactttgggtgaaaagacaaaacacacacacacacacacacacacacacaagaaaatatttttagaaggaaaacataaagccatatattgattcctaggatcagaaaattccaaagttaagtatgcagc

SEQ ID NO: 26521 - DNA, 225 bp, Homo sapiens
  Z67392
  Located on chromosome X
  Distance between a terminus base of telomere on chromosomal short arm and 5'-terminus of this base sequence : 127955930
  Distance between 3'-terminus of neighbour sequence of sequence listing upward to telomere on chrosomal short arm and 5'-terminus of this base sequence : 140623
tgggaccaagcatttcgaatttggtttacttgcaccattgccccctggggagacagaagaaagggatggaggtggagatagaggcgttaaagcacaggtaggaagtctacacatacagatgtatgaacataatttactttaactatgaagtctaaagtccagataagaaaatgctattttctacatctacacacacacacacacacgctcccacatcatacacac

SEQ ID NO: 26522 - DNA, 248 bp, Homo sapiens
  G09205
  Located on chromosome X
  Distance between a terminus base of telomere on chromosomal short arm and 5'-terminus of this base sequence : 128123996
  Distance between 3'-terminus of neighbour sequence of sequence listing upward to telomere on chrosomal short arm and 5'-terminus of this base sequence : 167841
ggttctccatagaaaaacaaccaataggaaagagatagatgatggataaatagatgatagatagatagatagatagatagatagatagatagatagatagacagacatttatcataagggattggcttatgtgattatggaggccgagaagtcccatgatctgccatctgcaaactggaggcccaggaaagccaatggtgtatttccagttcaaacccaaaagcctgagaatgaggggagtaaacggt

SEQ ID NO: 26523 - DNA, 187 bp, Homo sapiens
  Z81365.1_66111
  Located on chromosome X
  Distance between a terminus base of telomere on chromosomal short arm and 5'-terminus of this base sequence : 128124863
  Distance between 3'-terminus of neighbour sequence of sequence listing upward to telomere on chrosomal short arm and 5'-terminus of this base sequence : 619
acatgagccaattccttaaatcaatctctctctctacacacacacacacacacacacacacacacaccctgttggttgtttctctggtgaactctcactgatacattgaaagagtagctagcctggctgtatttctagcagaaaaactggaaaatatgtctatgtgttggctaaattattccaggac

SEQ ID NO: 26524 - DNA, 396 bp, Homo sapiens
  Z77249.1_74597
  Located on chromosome X
  Distance between a terminus base of telomere on chromosomal short arm and 5'-terminus of this base sequence : 128292611
  Distance between 3'-terminus of neighbour sequence of sequence listing upward to telomere on chrosomal short arm and 5'-terminus of this base sequence : 167561
tcttcatttgaaaggtgagaaaactgcccgggcgcagtggctcaaacctgtaatcccagcactttgggtggctgaggcgggtggatcacttgaggtcaggagttcgaaaccagcctggccaacatgttgaagccccgtctctactaaacacacacacacacacacacacacacacacacacacagccaggtgcggtggcacacgtctgtagtcccagctactggggaggctgaggcatgagaattgctcaaactcaggaggcagaggctgcagtgagctgagatcatgccactgcactccagcctgggcgacagagcaagactccatctcaaaaaaagaaacaaaggtgagaaaactaaatctgcgagcagggaagtgcttcatccaagatcctat

SEQ ID NO: 26525 - DNA, 369 bp, Homo sapiens
  Z77249.1_129139
  Located on chromosome X
  Distance between a terminus base of telomere on chromosomal short arm and 5'-terminus of this base sequence : 128347072
  Distance between 3'-terminus of neighbour sequence of sequence listing upward to telomere on chrosomal short arm and 5'-terminus of this base sequence : 54065
gtattgaccagaaatgaatttgaccagcataaaagcataggaataatttagaatatatatatatgtgtgtgtgtatgtatatatatatatgtatgtgtatatatatatgtatgtgtatatatatatgtatgtgtatatatatgtatgtgtatatatatatgtatgtgtatatatatatgtatgtgtatatatatatgtatgtgtgtatatatatatatatatatatatagagagagagagagagagagagagagagatagggtctcgctctgtcatccagaaaacagggaagcaggcatgtccctacatttttggagcaggaggaagagagcgaagggggaggtgctacatacctttaaacagccagat

SEQ ID NO: 26526 - DNA, 211 bp, Homo sapiens
  DXS6748
  Located on chromosome X
  Distance between a terminus base of telomere on chromosomal short arm and 5'-terminus of this base sequence : 128368952
  Distance between 3'-terminus of neighbour sequence of sequence listing upward to telomere on chrosomal short arm and 5'-terminus of this base sequence : 21511
tgcatttctctatcaccctagaacatacacacgaggccaggaaaaatataaatttcttgatgatctcacctctcacttctcaccactactgtttcccctacacacatacacacacacacacacacacacacacacagccatacacatagtagtcactcaataagtgctgaaataattaatgtgtattagggtcaaacatgatagcacagca

SEQ ID NO: 26527 - DNA, 316 bp, Homo sapiens
  chrX.fa.O7frz.135001340
  Located on chromosome X
  Distance between a terminus base of telomere on chromosomal short arm and 5'-terminus of this base sequence : 128551371
  Distance between 3'-terminus of neighbour sequence of sequence listing upward to telomere on chrosomal short arm and 5'-terminus of this base sequence : 182208
cttgctcagaactccttaattccagggaggtttcagatatatgtatttataaaagtaacatataatttatatatatatttataacaggaatataaccacattacagaaactttgaaaagcagagaaaaagaaaagaaaaaccctccctattcataattacaactcctaaacacagacactggtagtattttgctgttttttttttttaagtcctttcccaatgtgtagacatgcacacacacacacacacacacacttttttgtaccttgcttttcacaattattataaacttttctatgtagtggcttcatagtt

SEQ ID NO: 26528 - DNA, 221 bp, Homo sapiens
  AL008712.1_69778
  Located on chromosome X
  Distance between a terminus base of telomere on chromosomal short arm and 5'-terminus of this base sequence : 128804241
  Distance between 3'-terminus of neighbour sequence of sequence listing upward to telomere on chrosomal short arm and 5'-terminus of this base sequence : 252554
aacagtaaccataacctgcaaggaggcagctgagaattcccaggaaacaaagtgaaaagctattttgggatgtgctcataaatggcctagctatagttcatctggatggacgcacatggggcatacatgcagagagagagagagagagagagagagagagagagagaggagaagtatttctgtatttataaatatgtatgttggagcatgctattgtagtt

SEQ ID NO: 26529 - DNA, 349 bp, Homo sapiens
  chrX.fa.O7frz.134680284
  Located on chromosome X
  Distance between a terminus base of telomere on chromosomal short arm and 5'-terminus of this base sequence : 128897450
  Distance between 3'-terminus of neighbour sequence of sequence listing upward to telomere on chrosomal short arm and 5'-terminus of this base sequence : 92988
aggagaattgattagaagtaggaggtggaggttgcagtgagccgagattacaccactgcactccagcctgggcgacagagcgagactctgtctcaaaaataaataaataaataaataaataaataaataaataaataaataaataaaagcaccacaggaggatacttgttttccagatcaattgtgttgctatgaaatgaccaatatcagaggcaacctttgaacactcctacaccctgtctttaatgttgtctctttattttcctcttactgaaagcatttccaagcccctggcatgctttctttgtgtcttacacacagtgggctctcaatcagtattaggtgaatg

SEQ ID NO: 26530 - DNA, 464 bp, Homo sapiens
  chrX.fa.O7frz.134516428
  Located on chromosome X
  Distance between a terminus base of telomere on chromosomal short arm and 5'-terminus of this base sequence : 129061129
  Distance between 3'-terminus of neighbour sequence of sequence listing upward to telomere on chrosomal short arm and 5'-terminus of this base sequence : 163330
cgaggtgctgtaaagactaatatgctagtacagtatagttagcacttagttaacaatcaaaaatgttactttttaaaagttttagcattaagtaatggtttcatatttccctcactcaaatatgattatttcttttttgtagcaaaagatatatatcactataattttttgaaaaattcagaaaataaaaagagaaacaaaaattaactcttagcccaccatgccaaaaaaaaaaacaaccagataatgcagcatagatgcttatgtattttttcatcaaactggaaatatatatatatatatatatatatatatatatatataaagttttatattcttttctttataaaattttaacaagtatcatcatctggctcataaaagatcattttttcttaccataaaatattctttgaaagcataattgttaacagcatcataatattccattgtatggatgtacc

SEQ ID NO: 26531 - DNA, 204 bp, Homo sapiens
  D7S2512
  Located on chromosome X
  Distance between a terminus base of telomere on chromosomal short arm and 5'-terminus of this base sequence : 129136043
  Distance between 3'-terminus of neighbour sequence of sequence listing upward to telomere on chrosomal short arm and 5'-terminus of this base sequence : 74450
agctattatcttgctgtagctgggaggagagtctggttccatggctccaaaagcagcataaatcaagttttctgggagagggttaagaaagggtgttcaacagctgccgccatgggaggagctcatacacagccgtgcacatggccacacacgcacacattgtttgtcttgggcccagtttcctttgccctccaggtgatgttc

SEQ ID NO: 26532 - DNA, 246 bp, Homo sapiens
  chrX.fa.O7frz.134299513
  Located on chromosome X
  Distance between a terminus base of telomere on chromosomal short arm and 5'-terminus of this base sequence : 129278240
  Distance between 3'-terminus of neighbour sequence of sequence listing upward to telomere on chrosomal short arm and 5'-terminus of this base sequence : 141993
gcttaatgaagactcagttatgacaccacctgggaagctaacacattgcaaggttgagatgctgtgctataggatgtagaatcactctgaaagtgctctctctctctctctctctctctctctctctctatatatatatatatatatatatatatagccattttctcatcatcagaatacatggatctgggaaccaaagggcggaaaaggttcctagcacctctcaatagtaaacctaatgatcca

SEQ ID NO: 26533 - DNA, 397 bp, Homo sapiens
  chr2.fa.O7frz.105492409
  Located on chromosome X
  Distance between a terminus base of telomere on chromosomal short arm and 5'-terminus of this base sequence : 129392913
  Distance between 3'-terminus of neighbour sequence of sequence listing upward to telomere on chrosomal short arm and 5'-terminus of this base sequence : 114427
atcaagtatccttgaccactttactggggattttttttaaaacttaaaaaaatccttccagtaggcaagtcattgagccaaatcagtgtttattgtattttctttgcgtattacttaaaatatatgtaataggatgttattttcattttcagtaaatcacagtatctataaaacatatacatgtttccaagcttctgctttctctttctgatgaagttattgcaggaatacaaatggaaacgaagctttggaaatctcatatcagagtgtgtgtgtgtgtgtgtgtgtgtgtgtgtacacacacacatatattcactcaaaaacacataatgattcaccaaatcatttatgaatacaaatcagcaattttgtgatctcgtaagcaaatatgtctttg

SEQ ID NO: 26534 - DNA, 393 bp, Homo sapiens
  AC004387.1_10942
  Located on chromosome X
  Distance between a terminus base of telomere on chromosomal short arm and 5'-terminus of this base sequence : 129628575
  Distance between 3'-terminus of neighbour sequence of sequence listing upward to telomere on chrosomal short arm and 5'-terminus of this base sequence : 235265
taccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgt

SEQ ID NO: 26535 - DNA, 336 bp, Homo sapiens
  AC004676.1_15487
  Located on chromosome X
  Distance between a terminus base of telomere on chromosomal short arm and 5'-terminus of this base sequence : 129994492
  Distance between 3'-terminus of neighbour sequence of sequence listing upward to telomere on chrosomal short arm and 5'-terminus of this base sequence : 365524
ggagctgttaagcagtgaatagagggaaaagaagagggtcctgcctgaaatactggccatttctttgcctttgaaagggcttctgtatgagcaagtattcctaaactaaactgaactaaactaaactgaactaaactaaactaaactaaactaaactaaactaaactaaactaaacaaaacaccttccttccctgatcccttcgtcacttgtgtgtagcctcttgagaacattacccagctaagggtttggaaaatcagttctatatgtggtgcattcgctgcaattctaggcttttcatttgggtgccttaattaaggccaatattcaagtgtct

SEQ ID NO: 26536 - DNA, 480 bp, Homo sapiens
  Z83826.12_21049
  Located on chromosome X
  Distance between a terminus base of telomere on chromosomal short arm and 5'-terminus of this base sequence : 130251166
  Distance between 3'-terminus of neighbour sequence of sequence listing upward to telomere on chrosomal short arm and 5'-terminus of this base sequence : 256338
atgttttgcataaagaaacagaagtagcctggccaacatggcaaaaccctgtctctactaaaaatacaaaaattagccaggtgtggtggtgcaaatctgtaatcccacctactcaggaggctgaggttgcagtgagccgagattgcgccactgaactccagcctgggtgacagagagagaccctgtctcaaacacacacacacacacacacacacacgtatatttaaactaataaaagtggtcacttgtaaggggctgggtgcaccgggagggtgaggagtgatttttcactttatatctatagttttctacttttgaaacatatgattgttacctattcaagaagttaaattacaaagtgaattaaatcccttggtaaatcaagctgatatatttcactgtttctatttttcctatgtcagtcacagaaatatgagacaactttaggaaataggagagctaaaaccttaagttcctcaa

SEQ ID NO: 26537 - DNA, 229 bp, Homo sapiens
  DXS8074
  Located on chromosome X
  Distance between a terminus base of telomere on chromosomal short arm and 5'-terminus of this base sequence : 130313796
  Distance between 3'-terminus of neighbour sequence of sequence listing upward to telomere on chrosomal short arm and 5'-terminus of this base sequence : 62150
ctaggtgtgtctgtaaaggtaggtaggtgtgtgtgtgtgtgtgtgtgtgtgtgtgtgtgttttaatatagagatagggtcttgctcttgctctgttgcctagactggagtgctgtagcatgactatagcttactgcagcctcagcctcccaggcgcaagcaatcctcccattccagcctcccaagtatctagaacgacaggtgcatgccaacacctctggctaatttat

SEQ ID NO: 26538 - DNA, 262 bp, Homo sapiens
  DXS8033
  Located on chromosome X
  Distance between a terminus base of telomere on chromosomal short arm and 5'-terminus of this base sequence : 130317887
  Distance between 3'-terminus of neighbour sequence of sequence listing upward to telomere on chrosomal short arm and 5'-terminus of this base sequence : 3862
atgggttgataggtgcagcaaaccaccaagacacacgtttacctatgtaacaaacctgcatgccctgcacatgtatcccagaacttaaaaaatatgtgtgtgtgtgtgtgtgtgtgtgtgtgtgtttaaatggaaaaccatcaaccaagagagagcagtatccactcgcagattcggatcccagagtcctgaggccttacatgtctggaatcaatgcattctcaactggtcctgtagtaagatgctcatggggtttgtcttc

SEQ ID NO: 26539 - DNA, 367 bp, Homo sapiens
  Z83826.12_115655
  Located on chromosome X
  Distance between a terminus base of telomere on chromosomal short arm and 5'-terminus of this base sequence : 130345719
  Distance between 3'-terminus of neighbour sequence of sequence listing upward to telomere on chrosomal short arm and 5'-terminus of this base sequence : 27570
gttcaactatgccttgtagaagacacatcatactcaacttctctccaaaagatgcccaaagtctcataagtctcataagttattaaatccagctctaaattcaggattgttgaacaatgtttattcctctttaggtcatcaaaatcttgtactgatactctgtaatttatagactggattatgaagtttaactaccatcaatcaaagtatcttatataaagtggcagggtgaagaaaatgtcctacacacacacacacacacacacacacatgcacacacacacgcagacacaataaggaaaaaaaaatatgaacagctacttccaccttgtttctgaaagtagtcacaaggacatagttggtagtt

SEQ ID NO: 26540 - DNA, 349 bp, Homo sapiens
  chrX.fa.O7frz.142040113
  Located on chromosome X
  Distance between a terminus base of telomere on chromosomal short arm and 5'-terminus of this base sequence : 130818332
  Distance between 3'-terminus of neighbour sequence of sequence listing upward to telomere on chrosomal short arm and 5'-terminus of this base sequence : 472246
atggatttagaggccagactgggtcttaagtatttgtttgccttcctcctggtgctctgtgcagatgcgctgggactgacttcagagtgtccctgagccatgactgcttgactccacagatccacagatggcttcaggaagacaggacaacagagatacatacacacacacacacacacacacacacacacacacacacacacacacacgggattataaaaagctttgtgacaatttgtgattttaaatgtcagctatatcatttctttgagtcccacatatgcataaatgtatttctagaatatctttgttggcccatgaacatgtctatcaattcctgtttcatttg

SEQ ID NO: 26541 - DNA, 282 bp, Homo sapiens
  chrX.fa.O7frz.141942254
  Located on chromosome X
  Distance between a terminus base of telomere on chromosomal short arm and 5'-terminus of this base sequence : 130915931
  Distance between 3'-terminus of neighbour sequence of sequence listing upward to telomere on chrosomal short arm and 5'-terminus of this base sequence : 97250
aagcattagctaagtctgagactaaatagagttccacttcaacatcctgctgccttttggatacctttgctatctatgtgtgtgtgtatccaatatatgtacacacacgcacacacacacacacacacacacacagcttgacatgtttttcttactatttggtacatacttttatgctaccttttttcccactcaaccattataattgtgaaatttacctacgttggtgtgtatagttctatatcctacatttcagctcttctcttgtatgtcaatgtactg

SEQ ID NO: 26542 - DNA, 114 bp, Homo sapiens
  DISO7_10004823
  Located on chromosome X
  Distance between a terminus base of telomere on chromosomal short arm and 5'-terminus of this base sequence : 131060203
  Distance between 3'-terminus of neighbour sequence of sequence listing upward to telomere on chrosomal short arm and 5'-terminus of this base sequence : 143990
cagagctcctagaaagtctatgtgtatatgtatgtaaatgtgtaagtgtatatatatatatatatatacacacacacactccattattattaccacagtgattgtctagcctga

SEQ ID NO: 26543 - DNA, 181 bp, Homo sapiens
  DISO7_10004820
  Located on chromosome X
  Distance between a terminus base of telomere on chromosomal short arm and 5'-terminus of this base sequence : 131087906
  Distance between 3'-terminus of neighbour sequence of sequence listing upward to telomere on chrosomal short arm and 5'-terminus of this base sequence : 27589
cgatgaatgtgtcccttgaaatatgaagtactaagtgatgttgttttacttgaatggtcctactaaaaatctaaatgtggggagtgtgtgtgtgtgtgtgtgtgtgtatgtgtgtgtgtgtgtgttatactgacttgcccattaaagcatgaaaacaaatgggattatagctgcactcatg

SEQ ID NO: 26544 - DNA, 315 bp, Homo sapiens
  chrX.fa.O7frz.138439079
  Located on chromosome X
  Distance between a terminus base of telomere on chromosomal short arm and 5'-terminus of this base sequence : 131669001
  Distance between 3'-terminus of neighbour sequence of sequence listing upward to telomere on chrosomal short arm and 5'-terminus of this base sequence : 580914
tgtgacatatctaggtggaaataccaagctgctgccaggtaatctcaggtaagtgagaggatcacttaagcccgggagtttgaggctgcagtgagccatgattacactgcactccagcctggcaatagagtgagaccccatctcttaaataaaataataataataataataataataagaagaagaagaagaagaagaaataccaggctgacagttgagattgtggacccgattctcaggagacaaggtcagtaccagagatatttgggagtccccttaatagacacttgggttgaaacagaagtgacactaagt

SEQ ID NO: 26545 - DNA, 238 bp, Homo sapiens
  Z97632.1_109003
  Located on chromosome X
  Distance between a terminus base of telomere on chromosomal short arm and 5'-terminus of this base sequence : 131872058
  Distance between 3'-terminus of neighbour sequence of sequence listing upward to telomere on chrosomal short arm and 5'-terminus of this base sequence : 202742
atagtgacatgtgcctgtcatcccggctactcagaaggctaaggcagggggatcactggagcccaggagttcgaggttgcagtgagccataagcatgccactgaactccaatctgggtgacagagagacactccgtctctaaaacacacacacacacacacacacacacacacacacacacacaacacacactgaaattaacacaacaaacaagcgtaggaagattctgaaagatgga

SEQ ID NO: 26546 - DNA, 328 bp, Homo sapiens
  AL078638.9_182273
  Located on chromosome X
  Distance between a terminus base of telomere on chromosomal short arm and 5'-terminus of this base sequence : 132014048
  Distance between 3'-terminus of neighbour sequence of sequence listing upward to telomere on chrosomal short arm and 5'-terminus of this base sequence : 141752
agaattatgcctgcaacttactctcaaatgacttagaaacaaataagtggtgtgtgtgtgtgtgtgtgtgtgtgtgtgtgtgtgtgttcttctatcctattcttccaatctttctataagtttgaaatcatatcaaaataaagataaaagaaaacagtatgtgctcctcattaaaaagtgatgacaaaactagcaacctggggccactgctagcagagaagtactgtgtcaacactacccttgctaaggaaaaaagttgttaagttactcacagcagcgcagtgtcctgtcaacagttgggatgatcttgttgacaagccagacgtct

SEQ ID NO: 26547 - DNA, 235 bp, Homo sapiens
  AL078638.9_170090
  Located on chromosome X
  Distance between a terminus base of telomere on chromosomal short arm and 5'-terminus of this base sequence : 132026103
  Distance between 3'-terminus of neighbour sequence of sequence listing upward to telomere on chrosomal short arm and 5'-terminus of this base sequence : 11727
taattgcctatccaatacaggagcaaaagttactgactgtagaggctaggtgcctcaaaaacccagcctcccacctcaagaatgtcacaaaaccccagcctcctgcctcaagaatgctccagaacacgttacactctttcagccagcaaagcctgtcctactccacttggggtgtgagcgtgtgtgtgtgtgtgtgtgtgtgtgtgtgtgtgtgtacatggtatgagcaagacct

SEQ ID NO: 26548 - DNA, 480 bp, Homo sapiens
  AL078638.9_35709
  Located on chromosome X
  Distance between a terminus base of telomere on chromosomal short arm and 5'-terminus of this base sequence : 132160424
  Distance between 3'-terminus of neighbour sequence of sequence listing upward to telomere on chrosomal short arm and 5'-terminus of this base sequence : 134086
cttccatggcacaatttaatacacttgaactctgaaatatggttcaaacatttatatgtgtgcaaatttataatcctgtaatgggtaaaggagatacttttaaaaaataaaaacataatgtccagtcaatggttccattgatttggtattctgacaaaaggttctctttacagacagttcattcacattaactaaataatactttatttcactaaaaagaaaagtatttccttgagacattatgtgtgtgtgtgtgtgtgtgtgtgtgtgtgtgtatttctacatgacttcttagctttctttacaaccacaatgggtactctggttgaagactgtgtaagaatcaaagactagagattccacttttcgagagtccagttaggaccccttttctaagtgagacagtttctctcctcaagtgaaaatgaattctttctaaatcagaggctgggaaaagttaggagatgttacaagaggtca

SEQ ID NO: 26549 - DNA, 387 bp, Homo sapiens
  AL078638.9_15682
  Located on chromosome X
  Distance between a terminus base of telomere on chromosomal short arm and 5'-terminus of this base sequence : 132180558
  Distance between 3'-terminus of neighbour sequence of sequence listing upward to telomere on chrosomal short arm and 5'-terminus of this base sequence : 19654
aggtgaaatgacgatcatttacagggtagttgctagaacgtgttgaaaaacaaattttgttaagtcaaatgtctaaatccactgctctggcttagtgatataaatatttttggaccgataatttgcaggtctgcctatgtgtgtgtgtgtgtgtgtgtgtgtgtgtgtattccttagtctctgagaaacctggggggaaacctgttacttcagtccacctggccacccgaaagtgcaggtgattgattatgtctgtaggcagacttgcactcagcttcccaaaccagaatgacgcataaaactagacctggcagagtgcactgaaaaaccaatccttaatgtctcataaatcatacatttcaaatctgacaagaatcaaacagcttt

SEQ ID NO: 26550 - DNA, 436 bp, Homo sapiens
  chrX.fa.O7frz.138724926
  Located on chromosome X
  Distance between a terminus base of telomere on chromosomal short arm and 5'-terminus of this base sequence : 132255058
  Distance between 3'-terminus of neighbour sequence of sequence listing upward to telomere on chrosomal short arm and 5'-terminus of this base sequence : 74113
gacttgatgtgtctatggtcatatagctagtaaatagctcactgattgcaaagcatatatatatatatatatatatacacacacacacacacacacacacacacacacacacagagagagagagagagagagagagagagagagagagagagagagagagagagagtgagacagtctcactgtgtcacccaggctggagtgcagtgtggcatgatcacagctcaccgcagcctctatctcctggctctaagcaatcctcctacctcatccccccaagtagctggggctacaggtgtgcatcaccacacctggctaatttttaatttttttgtggagatggggtctcgctgtgttgcccaggctggtcttggactcctgggctcaagcagttctccctcctcagcttcccaaagtgttggaattacagacataagcc

SEQ ID NO: 26551 - DNA, 229 bp, Homo sapiens
  DXS8094
  Located on chromosome X
  Distance between a terminus base of telomere on chromosomal short arm and 5'-terminus of this base sequence : 132470627
  Distance between 3'-terminus of neighbour sequence of sequence listing upward to telomere on chrosomal short arm and 5'-terminus of this base sequence : 215133
gccattgtaaaataaaattcagaaagcaaacacatatgcaatgtcaccattaacagtttggttataattctttcatgaatttttttctctgtcttctccttccccctaactgacacacacacacacacacacacacacacacacacacacacacactatatatatgcaatttagagtaggtttacctactgtaacacacagaccctaagagacagtgactcaagaccat

SEQ ID NO: 26552 - DNA, 211 bp, Homo sapiens
  DISO7_11805112
  Located on chromosome X
  Distance between a terminus base of telomere on chromosomal short arm and 5'-terminus of this base sequence : 132591308
  Distance between 3'-terminus of neighbour sequence of sequence listing upward to telomere on chrosomal short arm and 5'-terminus of this base sequence : 120452
gattcctgcagcaccttcaaaaagtttggtttttggtatttgggacagtaagctaaaacaacagaatagaatttgatcctagaacaactagatagagttacatgtttgttttctctctctctctctctctctctctctctctctctctctctctctcttaaatagacaaacagaatagctgagataaaacttgaggactagtcattcagca

SEQ ID NO: 26553 - DNA, 115 bp, Homo sapiens
  DISO7_10004816
  Located on chromosome X
  Distance between a terminus base of telomere on chromosomal short arm and 5'-terminus of this base sequence : 132769756
  Distance between 3'-terminus of neighbour sequence of sequence listing upward to telomere on chrosomal short arm and 5'-terminus of this base sequence : 178237
aataagtcctcttggaacatgagaaaagttggctgtatcacacacacacacacacacacacacacacacacacacacacacacacatacacacacaccctggaagattgaagcca

SEQ ID NO: 26554 - DNA, 239 bp, Homo sapiens
  AL035443.3_55235
  Located on chromosome X
  Distance between a terminus base of telomere on chromosomal short arm and 5'-terminus of this base sequence : 132869313
  Distance between 3'-terminus of neighbour sequence of sequence listing upward to telomere on chrosomal short arm and 5'-terminus of this base sequence : 99442
agtaaagctcgtatacggcactgagctacagagtgcttttccatagctagccttctgtgtgtgtgtgtgtgtgtgtgtgtgtgtgtgtgtgtgtgtgtgtgtgtgtgtgttgtgggggagttatggaattgtgaagttaaaaataataataatgagcctcaaatttttaccatgtaattttaaagtctgttttaatgaggaatataaggaatattaaatggactttctgatcttaaaga

SEQ ID NO: 26555 - DNA, 228 bp, Homo sapiens
  chrX.fa.O7frz.139523073
  Located on chromosome X
  Distance between a terminus base of telomere on chromosomal short arm and 5'-terminus of this base sequence : 133016198
  Distance between 3'-terminus of neighbour sequence of sequence listing upward to telomere on chrosomal short arm and 5'-terminus of this base sequence : 146646
tttcaccatgttagccaagctggtctcgaactcctgatctcaaatgatccacccacctcagcctcccaaagtgtgggattacaggcatgagccactgcgcccagccacatgtgtatacatatgtgtgtgtgtgtgtgtgtgtgtgtgtgtgtgtgtatatatatatatgacaagatacatcaccttgatgggcagctttaaatagtacaacttctaatctttccaaca

SEQ ID NO: 26556 - DNA, 198 bp, Homo sapiens
  DXS8050
  Located on chromosome X
  Distance between a terminus base of telomere on chromosomal short arm and 5'-terminus of this base sequence : 133219941
  Distance between 3'-terminus of neighbour sequence of sequence listing upward to telomere on chrosomal short arm and 5'-terminus of this base sequence : 203515
cagttccttgacctaccctgatcaacttcattccctagtggcaaactctttcaaatctgtaactctttcctctgatatttatgtctattttccaaaatgttcaaaacacacacacacacacacacacacacacacacacacggttattggatcaagtttagacattgtctattgagtattattatgtcaaatctggag

SEQ ID NO: 26557 - DNA, 236 bp, Homo sapiens
  DXS1062
  Located on chromosome X
  Distance between a terminus base of telomere on chromosomal short arm and 5'-terminus of this base sequence : 133536855
  Distance between 3'-terminus of neighbour sequence of sequence listing upward to telomere on chrosomal short arm and 5'-terminus of this base sequence : 316716
gttgcctgttaagcactttgaatcatttacggtcacatttgtgtgtgtgtgtgtgtgtgtgtgtgtgtgtgtgtgtgtgtacttactgtgtgccaggcatcatgccatgtgctttacatgtattagttcaattgattttcataaaatcctattaggtgggtgctacttttgtttttaattttataggtaggaatgctgaaatttggagaaggaaagtgctcaaggtcacacatctc

SEQ ID NO: 26558 - DNA, 462 bp, Homo sapiens
  chrX.fa.O7frz.140196075
  Located on chromosome X
  Distance between a terminus base of telomere on chromosomal short arm and 5'-terminus of this base sequence : 133660101
  Distance between 3'-terminus of neighbour sequence of sequence listing upward to telomere on chrosomal short arm and 5'-terminus of this base sequence : 123010
gatgtactttgcttatggatagaggactcaatacgaaaaaatgcggattctttccaaactcatttatagcttcaatgacaggtcaattaaaatttccccaaaattcactgtggaacttgacagctgattctaataaacacacacacacacacacacacacacacacacacacacacgaatgaatgaacaaaaggccaacattagcaaagataatcctgaaaaagaagtttgtgactggagagagagatgttccttatctgatatagatatttattataaaaccatagttatacagatagtgtgacattcatagatacacagatgagccaatggaacagaatggagaggctaaaaataaatctatgtctatatatctatctatatctatctatatatatgcacacacatatatatggaaacgatatataacagagatgcattgcagattagtatgtaaagagc

SEQ ID NO: 26559 - DNA, 339 bp, Homo sapiens
  Z82193.1_35878
  Located on chromosome X
  Distance between a terminus base of telomere on chromosomal short arm and 5'-terminus of this base sequence : 134010862
  Distance between 3'-terminus of neighbour sequence of sequence listing upward to telomere on chrosomal short arm and 5'-terminus of this base sequence : 350299
ctggttatttctcaatttatggactaattattttacttttctaaagaggtttgggattgctgaaaacataacattaaaaactgggatcttaggagtaggatatttacatggtctcaaagtgtctcccagtggattatttactagttgaaacacacacacacacacacacacacacacacacacacacacacacacaaacccagaaaaccaagagttatacaggggaaaatgagaaaacaccttgattttatcatcaaaattaacgtccaatgaggggcaaatggatactgcatacctccagatgtgataccctaagaaggacatactatcacctaagca

SEQ ID NO: 26560 - DNA, 380 bp, Homo sapiens
  Z83313.1_61287
  Located on chromosome X
  Distance between a terminus base of telomere on chromosomal short arm and 5'-terminus of this base sequence : 134134333
  Distance between 3'-terminus of neighbour sequence of sequence listing upward to telomere on chrosomal short arm and 5'-terminus of this base sequence : 123132
acttcaatgacaggaaattcaccactacttacggtatctcagtctacttaaggaaggctatgtccatacgaaggaatttcttatttgagcccaaatctatctccttcaattggtcctggcacctcctaatcatactcctaaagttatctaatcatactcctaaagttatataaggatatatatatgcacagacacacacacacacacacacacacacacacacacacacacacacactcatatgctagaaaggactttatatttcatctagttcaagttcttcattttacagatgagaattaaggctcagagaaatttagagatttgctcacagcaccccagactgtcagcagcagaactcttaaacaagcaattcggta

SEQ ID NO: 26561 - DNA, 389 bp, Homo sapiens
  HUMUT1537
  Located on chromosome X
  Distance between a terminus base of telomere on chromosomal short arm and 5'-terminus of this base sequence : 134229556
  Distance between 3'-terminus of neighbour sequence of sequence listing upward to telomere on chrosomal short arm and 5'-terminus of this base sequence : 94843
gattactcagaatcacagcaataaacaagtcaggaaggggaaagaaaagaaaagagaagagaagagaagaaaaagagagagagagggagggagggaaggagggatggaggaaggaaggaaggaaggaaggaaggaaggaaggaaggaaggaaggaaggaaggaaggaaggaaggaaagaaaactatcagggcgaacaaggagtattttaacatcaatcttagaacataataatatgacttgactgttttttccaatccttatgattagaagaattttttgttttgggtttctggtgcaaagataagactccaggatgaaataacttaatagaaacaacatgtctccaccccaggattacatccagaccaaccctcagggaaggctctca

SEQ ID NO: 26562 - DNA, 266 bp, Homo sapiens
  AL023800.1_55210
  Located on chromosome X
  Distance between a terminus base of telomere on chromosomal short arm and 5'-terminus of this base sequence : 134297200
  Distance between 3'-terminus of neighbour sequence of sequence listing upward to telomere on chrosomal short arm and 5'-terminus of this base sequence : 67255
gtgcttgtgataagactggaagactgagcaaaaaatagaggaaaagggtactctaggtagagaaacaacaggtacaatggcaacaggatgtgaaagaacttggccccgttggataaacacagctggaacaaaattgtgtgcttacacacacacacacacacacacacacacacacacacacatgcgaacacaagggaggagggttatcctgatgagaaatgaggcagttgagaatcagggctctatatgccatactaaggaatgca

SEQ ID NO: 26563 - DNA, 378 bp, Homo sapiens
  AL023798.1_83748
  Located on chromosome X
  Distance between a terminus base of telomere on chromosomal short arm and 5'-terminus of this base sequence : 134370693
  Distance between 3'-terminus of neighbour sequence of sequence listing upward to telomere on chrosomal short arm and 5'-terminus of this base sequence : 73227
tggtcatttaaacaatattgattctacccatttatgagaatgggatgtgtttccatttgtttgtgttgtctatgatttctttcagcagcattttgtagttttccttgtagttttctttccagcattttgtagtcttcctttgtagttttccttcaaggaggtctttaacctccttggttaggtatattcctaagtgttgtgttgtgttgtgttgtgttgtgttgtgttgtgttgtattgtattgtattgtattgtattgtattgtattttgcagctattgtaaaaggggttgagttcttgatttgatcctccgcttggtcgctgttggtgtatagaagagctactgatttgtgtatgttaatcttgtatccggaaagt

SEQ ID NO: 26564 - DNA, 287 bp, Homo sapiens
  AL023798.1_25632
  Located on chromosome X
  Distance between a terminus base of telomere on chromosomal short arm and 5'-terminus of this base sequence : 134428902
  Distance between 3'-terminus of neighbour sequence of sequence listing upward to telomere on chrosomal short arm and 5'-terminus of this base sequence : 57831
tcattccattagaatgcatctccaggacctggaacagtgcctcatacatagtaagcacaatatttatttagtgaattaattacttgattatgtagtgtgtgtgtgtgtgtgtgtgtgtgtgtgtgtgtgtgtgtgtgtgtgttttcatttagaccaggttctattccagaaaataaaattaaagtggctttttgagtagtgccaagacactaagtcatgaaaacaaaagggtaaatgttcacaaccaatgccaactggaggctgtgtctatcaacagtgctccaaat

SEQ ID NO: 26565 - DNA, 363 bp, Homo sapiens
  Z81007.1_1047
  Located on chromosome X
  Distance between a terminus base of telomere on chromosomal short arm and 5'-terminus of this base sequence : 134457046
  Distance between 3'-terminus of neighbour sequence of sequence listing upward to telomere on chrosomal short arm and 5'-terminus of this base sequence : 27857
aggtctttcctcaccactagatagatgatagatagatagatagatagatagatagatagatagatagatagataagagtgtacacacacacacacacacacacacacacacaattggcaccctttccccaagggcacactcttggacctttgctgctttcatagcactcctcaccatgtgatatgttctacttgttggtttctttactatctccaaactccactccactagaatataaaatccacaaaagcaaggaattcactgtctattttattatttggcttatccctcagagccgaggacaatgcctggaatgtagtaaatgttcaataattacctgtgaaatgaatagtaactgcattg

SEQ ID NO: 26566 - DNA, 159 bp, Homo sapiens
  DXS1211
  Located on chromosome X
  Distance between a terminus base of telomere on chromosomal short arm and 5'-terminus of this base sequence : 134539199
  Distance between 3'-terminus of neighbour sequence of sequence listing upward to telomere on chrosomal short arm and 5'-terminus of this base sequence : 81790
ccctccaatctggcagaaacttgataggtagatgacatgagagggaaatatcgagaaattggcaaatctttctgttttttcccctcaatttgtaaacacacacacacacacacacacacacacacacacgtcagattctacaggccaaacccaggtctt

SEQ ID NO: 26567 - DNA, 253 bp, Homo sapiens
  Z80903.1_9589
  Located on chromosome X
  Distance between a terminus base of telomere on chromosomal short arm and 5'-terminus of this base sequence : 134539211
  Distance between 3'-terminus of neighbour sequence of sequence listing upward to telomere on chrosomal short arm and 5'-terminus of this base sequence : -147
gcagaaacttgataggtagatgacatgagagggaaatatcgagaaattggcaaatctttctgttttttcccctcaatttgtaaacacacacacacacacacacacacacacacacacgtcagattctacaggccaaacccaggtcttggacagacttgccagaagggtctagaaaagaatgtcatcatccatgagccaggccagaggtgaaagtatgaggagcactggtgcctagtcactttccagctgtcat

SEQ ID NO: 26568 - DNA, 245 bp, Homo sapiens
  Z80903.1_21398
  Located on chromosome X
  Distance between a terminus base of telomere on chromosomal short arm and 5'-terminus of this base sequence : 134551078
  Distance between 3'-terminus of neighbour sequence of sequence listing upward to telomere on chrosomal short arm and 5'-terminus of this base sequence : 11614
ctccgtatcgttatagtactcctcttcatcatcatcatcatcatcatcatcatcatcaccatcatcgttgtcattattgtcatcaacatcaaagtattactgtagttgcccaaccagaaaagttcaaggccagggacagcagtgcccaggggatgctactggcttgcacagctctgatctgactctgatacttttgagaaaaaaattacataacctgaggaagggaggataagttggcataaagc

SEQ ID NO: 26569 - DNA, 131 bp, Homo sapiens
  DXS1192
  Located on chromosome X
  Distance between a terminus base of telomere on chromosomal short arm and 5'-terminus of this base sequence : 134601954
  Distance between 3'-terminus of neighbour sequence of sequence listing upward to telomere on chrosomal short arm and 5'-terminus of this base sequence : 50631
tgtggtgcagggaagccaaaagattggctaccactgctcttgaacgtgtgtgtgtgtgtgtgtgtgtgtgtgtgtgtgtgtgtgtgtgtgtgttttagggtacctgtttaaacgttccagcagttggcaac

SEQ ID NO: 26570 - DNA, 431 bp, Homo sapiens
  AL035262.1_23010
  Located on chromosome X
  Distance between a terminus base of telomere on chromosomal short arm and 5'-terminus of this base sequence : 134693000
  Distance between 3'-terminus of neighbour sequence of sequence listing upward to telomere on chrosomal short arm and 5'-terminus of this base sequence : 90915
aggataaatacctaacgtagatgacgggttgatgggtgcagcaaaccaccgtggcatgtgtatacctatgtaacaaacctgcatgttctgcacatgtatcccagaacttagagtataataataataataataataataataaagatattaggctgttatcatcctgctagatttctgagctcatctactggtgtctgctccgtgcatatgccctttgttgaaagacattagtaagaatttatatttccatggtgtttgtgtgaaaaaaatatgatgttagctacaaggtttttgttgatgcactgtattaagttgaggcaattctcttccattcctaacttgctgagagttttttcatgattgggtgttagattccatcaaataacttttcctgtatcagttgatatgatcatgtttatcttcctttagct

SEQ ID NO: 26571 - DNA, 380 bp, Homo sapiens
  chrX.fa.O7frz.143455865
  Located on chromosome X
  Distance between a terminus base of telomere on chromosomal short arm and 5'-terminus of this base sequence : 134965137
  Distance between 3'-terminus of neighbour sequence of sequence listing upward to telomere on chrosomal short arm and 5'-terminus of this base sequence : 271706
tctaagccattcacttactagaagcttataagaaccaagtcatatttcaccactatgcaatatattcatgtaacaaaactctatgtacttgtactcccacatttatacaaataaaaaggaaccaaatcattgcttatctagagtagcagtaaatatgtgtgtgtgtgtgtgtgtgtgtgtgtgtgtgtgcatgcacacatgtgtatactagcttcatatactttccttcacctgctggaaaaaaatgcaagtttgatgctggtaaaattttcatactcattttcaaggctggagtactcagtactgagacgttcacaattccttgtactgtactatatcactactatgttttagtactgtacaataacctcaatctgact

SEQ ID NO: 26572 - DNA, 377 bp, Homo sapiens
  AL161777.4_11204
  Located on chromosome X
  Distance between a terminus base of telomere on chromosomal short arm and 5'-terminus of this base sequence : 135046985
  Distance between 3'-terminus of neighbour sequence of sequence listing upward to telomere on chrosomal short arm and 5'-terminus of this base sequence : 81468
cctaaatcttaccactcctgagtaggacacagggaatttgagtaagagggaataccctccctcccttccctccctccctcccttccttccttcctttctttttctttcttttctttctttccttccttccttctttctcttctctcctctcctctcctctcctctcctctcctctcctctcttctcatctcgtctcctcttcttttctttttgtttgagacagagtcttttgtttttgtttgagacagagtcttgctctgtcacccaggctggagcgcagtggcgcaatctcagctcactgcaacctccaccacccgggctcaagcgattctcatgcctcagcctcccaagtaggtgagattacagttgcatgccac

SEQ ID NO: 26573 - DNA, 345 bp, Homo sapiens
  chrX.fa.O7frz.143208509
  Located on chromosome X
  Distance between a terminus base of telomere on chromosomal short arm and 5'-terminus of this base sequence : 135212402
  Distance between 3'-terminus of neighbour sequence of sequence listing upward to telomere on chrosomal short arm and 5'-terminus of this base sequence : 165040
gtgatcctagttcaggtgactaaaaaggagcgaagccaaaatttgtatctcaatggactgactctcaagcctgcatacctaacacagtattacactgtcttaagcaaatgcacaaatcaaattcgtgtagtcctagataataatcctgttatacacacacacacacacacacacacacacacaccctcttcatccacagtttctagctcataacttccataacccttgtcataatctgttgttataatgttggggcactttaggcctcaggaaacagatctctctgaccctctcctgtcttcctttcacctgcccaagggaagactcttatcaacagacactcat

SEQ ID NO: 26574 - DNA, 102 bp, Homo sapiens
  DISO7_10004831
  Located on chromosome X
  Distance between a terminus base of telomere on chromosomal short arm and 5'-terminus of this base sequence : 135468280
  Distance between 3'-terminus of neighbour sequence of sequence listing upward to telomere on chrosomal short arm and 5'-terminus of this base sequence : 255533
gcaactccaactcagtatgttcaaaattgaactcatctccctcccacacacacacacacacacacacacacacacacacacaccagcttctgtgcagtgttc

SEQ ID NO: 26575 - DNA, 350 bp, Homo sapiens
  chrX.fa.O7frz.144253277
  Located on chromosome X
  Distance between a terminus base of telomere on chromosomal short arm and 5'-terminus of this base sequence : 135555722
  Distance between 3'-terminus of neighbour sequence of sequence listing upward to telomere on chrosomal short arm and 5'-terminus of this base sequence : 87340
ctactaaatgccaatagcgactcattcagtctctgtaataatcaaaagtgctgctcccatccactaatactgaactatcgaaaaggaaattgagaaaacaatcccatttacaatgacacacacacacacacacacacacacacacacacacacacacacacacaaagaataaaatacttaggaaaaagagcacaggtaaaagacttacacactgaaaattataaaacattgaaaattaaagaagacacagataaatgaaaatatatcctgtgttgatggagtggaagaattaatattgttgaaatgtccatattacccaaagtgatctatagattgactgcaattcctag

SEQ ID NO: 26576 - DNA, 169 bp, Homo sapiens
  DXS1232
  Located on chromosome X
  Distance between a terminus base of telomere on chromosomal short arm and 5'-terminus of this base sequence : 135599232
  Distance between 3'-terminus of neighbour sequence of sequence listing upward to telomere on chrosomal short arm and 5'-terminus of this base sequence : 43160
agagatgggagcagcatgagagagtttgcaatctcctttcatagcctgttgctgcttactaatacttgccaggtgctcgtgtgtgtgtgtgtgtgtgtgtgtgtgtgaaagagagagagaatatgaatgcattcatcttatggctccagagcattattaggctgttggt

SEQ ID NO: 26577 - DNA, 113 bp, Homo sapiens
  DISO7_11815103
  Located on chromosome X
  Distance between a terminus base of telomere on chromosomal short arm and 5'-terminus of this base sequence : 135652368
  Distance between 3'-terminus of neighbour sequence of sequence listing upward to telomere on chrosomal short arm and 5'-terminus of this base sequence : 52967
cattacgtttcttgtcttgtctctcctgccccctgcctctaaccatttccccacgtgcacacacacacacacacacacacacacacacacatcgttatattcaagccctaagc

SEQ ID NO: 26578 - DNA, 469 bp, Homo sapiens
  chrX.fa.O7frz.143984152
  Located on chromosome X
  Distance between a terminus base of telomere on chromosomal short arm and 5'-terminus of this base sequence : 135824834
  Distance between 3'-terminus of neighbour sequence of sequence listing upward to telomere on chrosomal short arm and 5'-terminus of this base sequence : 172353
tcttggactagtaacttgcagtctaatcataaaaattcagggatataactctccatactttacactcaattttgctgtgaacctatgtagtggtagggttctccagagactcagaaccagtgggagatagatagatagatagatagatagatagatagatagatagatagatagataatagatacatagatacaaagatagatagatacacagatacatagatagacagataataaggaattggcttatgggattatggaggtcaagaagtcccaatatctgcagtccaaagccttgggactcagaagagccgatggtgtaaattcctgttcgagtcccagcttgaagactatcaggcagagagagcagattctctcttgctcagtctttttgttctattcaggccttcaacagtttagatgaagcccacctacatgggggagggcaatctgctttattcagtctacca

SEQ ID NO: 26579 - DNA, 168 bp, Homo sapiens
  DXS984
  Located on chromosome X
  Distance between a terminus base of telomere on chromosomal short arm and 5'-terminus of this base sequence : 135950868
  Distance between 3'-terminus of neighbour sequence of sequence listing upward to telomere on chrosomal short arm and 5'-terminus of this base sequence : 125565
tttccgtctgccaagtgtttattacaaataagtggaggtctgatttaatggcagcgtacatgcccccacccccacctccctgaaatacacacacacacacacacacacacacacacacacacacgcttggtgtaaaggggccagtgtggaatggagtagggcacagta

SEQ ID NO: 26580 - DNA, 345 bp, Homo sapiens
  AL137016.11_3364
  Located on chromosome X
  Distance between a terminus base of telomere on chromosomal short arm and 5'-terminus of this base sequence : 135950892
  Distance between 3'-terminus of neighbour sequence of sequence listing upward to telomere on chrosomal short arm and 5'-terminus of this base sequence : -144
caaataagtggaggtctgatttaatggcagcgtacatgcccccacccccacctccctgaaatacacacacacacacacacacacacacacacacacacacgcttggtgtaaaggggccagtgtggaatggagtagggcacagtagctgcatgcttcctgcatgaatgcacaaaaagttcttagcgagtactattaggtctttgctaaatgattaaaaaataaacccaactacactctgtatgtgaatagattacaaatggacgatttctcagtttgggggtaggtggaatgggagcaggtataatactttactttggggaaatgttctaacggtcaaatcatttg

SEQ ID NO: 26581 - DNA, 171 bp, Homo sapiens
  AL137016.11_10014
  Located on chromosome X
  Distance between a terminus base of telomere on chromosomal short arm and 5'-terminus of this base sequence : 135957568
  Distance between 3'-terminus of neighbour sequence of sequence listing upward to telomere on chrosomal short arm and 5'-terminus of this base sequence : 6331
ccatcagtggatgaataaagacaatgtgagatatagacacacacacacacacacacacacacacacacacaatggaatactattcatccataaaaaggaggaaatcctgtcatctatgctactgcatggatggaactggaggccattatgttaagtgaaataagccaagca

SEQ ID NO: 26582 - DNA, 404 bp, Homo sapiens
  AL137016.11_47758
  Located on chromosome X
  Distance between a terminus base of telomere on chromosomal short arm and 5'-terminus of this base sequence : 135995182
  Distance between 3'-terminus of neighbour sequence of sequence listing upward to telomere on chrosomal short arm and 5'-terminus of this base sequence : 37443
gagttgagtaattgcaacagaggtcatatggcctgaaaaagtctaaaatgtttgccgtctggccctttacaggaaaagtttgcagacccctgatttagtaacctgcctttagagggttattacttccaagtcttcattggcggtagtagtggtggtggtgatggtaatgatgatgatgatgatgatgatgatgatgatagctaacacatactaacacttaagtaccctaagcactttgcatgtatacattcatttaaccctcacaacaaccctatattatagcactgttactatcccaattttgcatataaggaaaaggaagcagagagagggtgagtgatatgttcattctcacttggccagtgagtggcagagccaggctgtctggctcaagaacttatgta

SEQ ID NO: 26583 - DNA, 445 bp, Homo sapiens
  chrX.fa.O7frz.145270286
  Located on chromosome X
  Distance between a terminus base of telomere on chromosomal short arm and 5'-terminus of this base sequence : 136219764
  Distance between 3'-terminus of neighbour sequence of sequence listing upward to telomere on chrosomal short arm and 5'-terminus of this base sequence : 224178
acttgttctgtttactgagcaccatgctatatatatatatatatatatatatatatatatatatatatatacacacacagagagagagagagagagagagagagagagagggagagagagagatggaatttcactcttgttgcccaggctggagtgcaatggcgcaatcttggctcactgcaacctctgcctccccggttcaaacgattctcttgcctcagcctctcaagtagctgggattataggcatgcgccaccatgcccagctaattttgtgtttttagtagagacggggctcctccatcttggtcaggctggtcttgaactcccgacctcaggtgatctgcctgccttggcttcccaaagtgctgggattacaggcgtgagccaccgagcccggcccatgtaatatttttagtaaggattacagtagatgttgaatccaa

SEQ ID NO: 26584 - DNA, 106 bp, Homo sapiens
  DISO7_10004834
  Located on chromosome X
  Distance between a terminus base of telomere on chromosomal short arm and 5'-terminus of this base sequence : 136319290
  Distance between 3'-terminus of neighbour sequence of sequence listing upward to telomere on chrosomal short arm and 5'-terminus of this base sequence : 99081
gaaacagcctcttgccacccccatattacacacacacacacacacacacacacacacatacacactatctaaacataaaaaactctagctaactgaactggagcaa

SEQ ID NO: 26585 - DNA, 264 bp, Homo sapiens
  chrX.fa.O7frz.145106472
  Located on chromosome X
  Distance between a terminus base of telomere on chromosomal short arm and 5'-terminus of this base sequence : 136375960
  Distance between 3'-terminus of neighbour sequence of sequence listing upward to telomere on chrosomal short arm and 5'-terminus of this base sequence : 56564
acatatgcttgattctcagaatagaaatctacatgtatctttattaatatgatttctcaaagtttaatttaattatatatgtattatatataattactcaaaaagacattatatatttatcttttatattttatatatgtatatttatatatatacacatatacatatatattatatatatatatatttccgtttgagtgattttttatttaaagtcccttggaatgattcttctgtgtgctgtcttgctaccaacttatacat

SEQ ID NO: 26586 - DNA, 186 bp, Homo sapiens
  DXS1205
  Located on chromosome X
  Distance between a terminus base of telomere on chromosomal short arm and 5'-terminus of this base sequence : 136573706
  Distance between 3'-terminus of neighbour sequence of sequence listing upward to telomere on chrosomal short arm and 5'-terminus of this base sequence : 197482
cctacgcatgtggctcgccttctccacagatgactaaaatccttccacttgtcctcttgctacacagagcaataaaaagttattctgaaaattaacggtaaaattattatcttatttttgaaacacacacacacacacacacacacacacacacacagcagtgaaaaagtactctaagccattaat

SEQ ID NO: 26587 - DNA, 304 bp, Homo sapiens
  chrX.fa.O7frz.146295071
  Located on chromosome X
  Distance between a terminus base of telomere on chromosomal short arm and 5'-terminus of this base sequence : 136843050
  Distance between 3'-terminus of neighbour sequence of sequence listing upward to telomere on chrosomal short arm and 5'-terminus of this base sequence : 269158
tatgatcctagactgttgcaaggtttgtacattttatgtgaagtaatgtggtattaactgaaaattaactataaaaagtaaaggatgtatataagaatctctacaggagaattttcagaactgcaaagtatagctaaaatctcaataagaaaaataaaatacaattctgaaaataaaataaaaaatcttattaaaaggcaggaaaaaagtaacagggacgtaaaacaaaataaataaataaataaataaataaataaataaataaataaaagccaatagttaaaaggtaaactgaaacctactg

SEQ ID NO: 26588 - DNA, 174 bp, Homo sapiens
  DXS1227
  Located on chromosome X
  Distance between a terminus base of telomere on chromosomal short arm and 5'-terminus of this base sequence : 137113599
  Distance between 3'-terminus of neighbour sequence of sequence listing upward to telomere on chrosomal short arm and 5'-terminus of this base sequence : 270245
agaggtccgagtcttccacgatataaaaaatgtattaaaaatggatgattacctaacagagacagggttagtcatctatgaaatgattctccaaaataacactgaaacacgcacgcacgcacacacacacacacacacacaccacatacacattttgggggagtaaacccttat

SEQ ID NO: 26589 - DNA, 429 bp, Homo sapiens
  AL121881.35_3249
  Located on chromosome X
  Distance between a terminus base of telomere on chromosomal short arm and 5'-terminus of this base sequence : 137141675
  Distance between 3'-terminus of neighbour sequence of sequence listing upward to telomere on chrosomal short arm and 5'-terminus of this base sequence : 27902
aggatgactgatgtatgcaaagtatctattgtaaacactgacacatagtagatggtcaacaaatatttgctgaaatgaatttttccatttaatcatgtgaggatattgcaattcaatttaagtaactttctcaagatcatacagattttaataacagttatatatatatatgtgtgtgtgtgtgtgtgtgtgagcaatccagattccttatatattttatatataaaaaagggactttatataaatgtgtgtgtgtgtgtgtgtgtgtgtgtgtataaattaagcttatatgggctctcttttagttaatattgattgacatccatttctttctggagcacagtattattaattacaaaaataaattaactggcaaagttctcattaaggataaatgtgaactgggaagactgtatggataaatcgttg

SEQ ID NO: 26590 - DNA, 291 bp, Homo sapiens
  AL109852.13_51511
  Located on chromosome X
  Distance between a terminus base of telomere on chromosomal short arm and 5'-terminus of this base sequence : 137191569
  Distance between 3'-terminus of neighbour sequence of sequence listing upward to telomere on chrosomal short arm and 5'-terminus of this base sequence : 49465
aatgacgtctcagtgaagagtaacaaaggcttaaaggtgggaagatgattttatatatatatatacatatatatatgtagagagagagagagagataatctatctagagatataaagatgtataattgtatatatatatatatatatatatatatatatatagagagagagagagagagagagagagagagagagagagagagagagagagagagagagatcaaggccatgctgtaaaacatgctatgaatcttcttcccttagtgagtatgagcagtaaagcattaccat

SEQ ID NO: 26591 - DNA, 315 bp, Homo sapiens
  AL049177.5_25969
  Located on chromosome X
  Distance between a terminus base of telomere on chromosomal short arm and 5'-terminus of this base sequence : 137228174
  Distance between 3'-terminus of neighbour sequence of sequence listing upward to telomere on chrosomal short arm and 5'-terminus of this base sequence : 36314
ctctaacttcatctgctttcagacacttctgcacttactcccttatcacactgactgtttaattatttgaatgtgctggtggtttctggctaatttgggacagtcacacttgttacttactagctggtatattatttctctctctcactcactcattttctctcactctgtatctttctcatacacacacacacacacacacacacacacacacacacaccactgccttattacgtcccaactgaagaatgttctcagtttgtgtgttttttcttctgggaaattatcacggagactcctaacttggttaggttc

SEQ ID NO: 26592 - DNA, 327 bp, Homo sapiens
  AL023279.1_81984
  Located on chromosome X
  Distance between a terminus base of telomere on chromosomal short arm and 5'-terminus of this base sequence : 137292542
  Distance between 3'-terminus of neighbour sequence of sequence listing upward to telomere on chrosomal short arm and 5'-terminus of this base sequence : 64053
ggtatcaatacaggtccatcagttgttgcaaacatgccataataatacaaaatataaataataggagacactgtgtgtgtgtgtgtgtgtgtgtgtgtgtgtgtctgtgtgcgtgcatagggcagggcaggagggcaggaattgggggggggggcgtagatatgtgagaactctgtaactttgatgaagttttctctctgtatttttggattagcaatgctctaaaaatgatgtctattagtttttaaaaagacacaaatgatttgaagagaatataccaatcaggaaaaggcatataaaaagatgaccaacgtcatttgtcattag

SEQ ID NO: 26593 - DNA, 410 bp, Homo sapiens
  AL023279.1_34873
  Located on chromosome X
  Distance between a terminus base of telomere on chromosomal short arm and 5'-terminus of this base sequence : 137339524
  Distance between 3'-terminus of neighbour sequence of sequence listing upward to telomere on chrosomal short arm and 5'-terminus of this base sequence : 46655
ctgtcttccaaaccattatcacatcttgaaaaactgtgtttcaaactttaggtggcaatgcattagtgatttgagagatcagttttttggcgtgtggcttatattattttttcagttgaaatagaacagaaaaataccagagctcatcacacataggacaaatatcattccatgacatgtttggttcaactctgtgtgtgtgtgtgtgtgtgtgtgtgtgtgtgtgtgtgtgtttgtgtgcgtgcgcacgtgcgctaactcacaatttgaaacggattttatgccatgtgcacattttatctgtctcactaaaccagaggaaaaggaaaaacttcaatggagtctacagccatttacccagtcccaacaagcccaaggtgtatgtcactctagttgatacatgcgactcg

SEQ ID NO: 26594 - DNA, 147 bp, Homo sapiens
  DXS6751
  Located on chromosome X
  Distance between a terminus base of telomere on chromosomal short arm and 5'-terminus of this base sequence : 137339665
  Distance between 3'-terminus of neighbour sequence of sequence listing upward to telomere on chrosomal short arm and 5'-terminus of this base sequence : -269
gctcatcacacataggacaaatatcattccatgacatgtttggttcaactctgtgtgtgtgtgtgtgtgtgtgtgtgtgtgtgtgtgtgtgtttgtgtgcgtgcgcacgtgcgctaactcacaatttgaaacggattttatgccatg

SEQ ID NO: 26595 - DNA, 461 bp, Homo sapiens
  chrX.fa.O7frz.146915465
  Located on chromosome X
  Distance between a terminus base of telomere on chromosomal short arm and 5'-terminus of this base sequence : 137463273
  Distance between 3'-terminus of neighbour sequence of sequence listing upward to telomere on chrosomal short arm and 5'-terminus of this base sequence : 123461
tatggaatgtacataaccgaagttgccttaacatccaggatttaatttatcttgctttattcatttaaaatgttatgtaaggaccttgccaatgtttaagtagatcaactattgtcatcagttgggctagtttctatttgtgttattcctatcatgcgttcctttataattctctacaaaagaccattcttttaaaaatagacatataagattatttttagcaacagtaggaatgacaaatgagtttcacctattgtgcaaacttcaatcaattgatagtagttgccaagtgcacagtattgaggagaattctgaggcttcttcaaagcttactagaaaagatagccatgattttttaatgacacctattacaattggatgtgtgtatgtgtgtgtgtgtgtgtgtgtgtgtaagatagaagttatgtactttccattcctgaatgataattaacctagaa

SEQ ID NO: 26596 - DNA, 436 bp, Homo sapiens
  chrX.fa.O7frz.147032783
  Located on chromosome X
  Distance between a terminus base of telomere on chromosomal short arm and 5'-terminus of this base sequence : 137580925
  Distance between 3'-terminus of neighbour sequence of sequence listing upward to telomere on chrosomal short arm and 5'-terminus of this base sequence : 117191
ataattgacgtcttggatcaatccaaacttgtcatgcaggaatctttttactttttatttattttttattttatttatttatttatttatttaagatggagtctcgctctatcgcccaggttggagtgtaatggcgtgatctcggctcactacaacctccgcctcccgggttcaagcgattcttgtgcctcagcctcaggagtggctgcgattacaggtgcatgccaccacagctggctaatttttttttttttttgtatttttagtagagacggggtttcaccatactgaataggctggtcttgaactcctgacctctggtgatccgcctacctcagcctcccaaagtgctgggattacaggcatgagccaccgcgcctggccaggaatcttaacataaaaaggacaccatagctcggataactgaaataggagt

SEQ ID NO: 26597 - DNA, 439 bp, Homo sapiens
  chrX.fa.O7frz.147259888
  Located on chromosome X
  Distance between a terminus base of telomere on chromosomal short arm and 5'-terminus of this base sequence : 137807773
  Distance between 3'-terminus of neighbour sequence of sequence listing upward to telomere on chrosomal short arm and 5'-terminus of this base sequence : 226412
agaataccaggtagacttctgaagattttgactctagtcttggactcacagatggctctgctggacccactgtgtgcctagaggacctcactctcctaaagggaagaatacatgcctggctggctttgccaccagctgattgtagagcccatggccttgggtgaacatagtcagaagtcagggagtggtgacaacagaccttgggcaagggccagcactgtgctggcttcaggtctgacccagcacagtgatagtggtggaggccacagggctgcttgtgtcactccatccccagctgtaggtggctcaggagagagagagagagagagagagagagagagatatgctcgatatgtttgggaaaaagtaagggaagaggacaagagtctctgcctggtaatctagagaattctcttggatcttgtcctagaccatcaat

SEQ ID NO: 26598 - DNA, 338 bp, Homo sapiens
  AL080272.3_70386
  Located on chromosome X
  Distance between a terminus base of telomere on chromosomal short arm and 5'-terminus of this base sequence : 138030452
  Distance between 3'-terminus of neighbour sequence of sequence listing upward to telomere on chrosomal short arm and 5'-terminus of this base sequence : 222240
gtatacctatgtatcaaacctgcacattgtgcacatgcacccttgaacttaaagtatatatatatagatagatagatagatagatagatagatagatacacacacacatatacatatatatacacacatatatacatgtatgtatatacacatatgtgtatatatatatatatatatatagagagagagagagagagagagagaggcactgatttccaagcaggagggaaaacaaacaaacaaacaatgatattctgccttcaacagacccagacacatctaagatgcaatgacacacataggctaaaaataaacggatggaggtaaatctaccaagc

SEQ ID NO: 26599 - DNA, 458 bp, Homo sapiens
  chrX.fa.O7frz.147701718
  Located on chromosome X
  Distance between a terminus base of telomere on chromosomal short arm and 5'-terminus of this base sequence : 138274809
  Distance between 3'-terminus of neighbour sequence of sequence listing upward to telomere on chrosomal short arm and 5'-terminus of this base sequence : 244019
tcagtattcataagtaggttccagcttattacagaaagtaatttccataaccaggtctcatgtacaaaatagatgcaaatgcccttctagagggtctgtctcagcactcaaaaagttggattttcttaccttacagtttgccatcttgtgctttatagatgtaccaagccgatattaaatttattttatatatatatatatatatatatatatttatatatttgatacctattatgatttgaggggcctaggacatacctctttacaagagagatatggtaccttcctccatggaatttataatctagtgaaagaaagagataacatacagttgaataaataagatgattatttagagtgatataacttatggaaattataaaacaggtttcagcatgcaatgaagtgttacaaatacaaatgttacactcacagaccaactccttcataaagtactt

SEQ ID NO: 26600 - DNA, 353 bp, Homo sapiens
  AL137840.12_25072
  Located on chromosome X
  Distance between a terminus base of telomere on chromosomal short arm and 5'-terminus of this base sequence : 138404709
  Distance between 3'-terminus of neighbour sequence of sequence listing upward to telomere on chrosomal short arm and 5'-terminus of this base sequence : 129442
cagctatgcaatgttacagatcttcgacaccaagaactaagtcttaggtatcataaagacataattatcattatatagcaaaatatttaaaagtttctgctacttactagttctgtgaccttgggtaaaatccttaacctctttgaaactgagtttcttcactaataataataataataataataataataataataatatttttatgaaattgtaaaggttaaacaaaaatgatcacaaagcttagcatgtagtaaatattttgtaactagtaactcttattataaaagaacaaatgaattaatgaaaaatcagaaaaatacctttttataaggtcttcctagcagtaagat

SEQ ID NO: 26601 - DNA, 262 bp, Homo sapiens
  DXS8106
  Located on chromosome X
  Distance between a terminus base of telomere on chromosomal short arm and 5'-terminus of this base sequence : 138495306
  Distance between 3'-terminus of neighbour sequence of sequence listing upward to telomere on chrosomal short arm and 5'-terminus of this base sequence : 90244
cttgcacttgctgtgggtaaattcatctgctcctaatgcttcacttatgacctatacggtaatgacacaatctaaattatgttgccaaatctctcacctaagttccacatccgtatctacaactgtatacttggaatctccatctggatggcccatagccttctcaaagtcaacaggtataaaactgaactcatcagcaacacacacacacacacacacacacacacacacacacttgaaaacattcctcaactctacagct

SEQ ID NO: 26602 - DNA, 329 bp, Homo sapiens
  AL022720.1_30894
  Located on chromosome X
  Distance between a terminus base of telomere on chromosomal short arm and 5'-terminus of this base sequence : 138495347
  Distance between 3'-terminus of neighbour sequence of sequence listing upward to telomere on chrosomal short arm and 5'-terminus of this base sequence : -221
cacttatgacctatacggtaatgacacaatctaaattatgttgccaaatctctcacctaagttccacatccgtatctacaactgtatacttggaatctccatctggatggcccatagccttctcaaagtcaacaggtataaaactgaactcatcagcaacacacacacacacacacacacacacacacacacacttgaaaacattcctcaactctacagctttttaggctcttgtcccctgtattgtgaatagcagccattctgaattccttctctgtttttaccatgtatctaagtcagaaatctagacctttattcaaggaggtaga

SEQ ID NO: 26603 - DNA, 474 bp, Homo sapiens
  chrX.fa.O7frz.148246765
  Located on chromosome X
  Distance between a terminus base of telomere on chromosomal short arm and 5'-terminus of this base sequence : 138819647
  Distance between 3'-terminus of neighbour sequence of sequence listing upward to telomere on chrosomal short arm and 5'-terminus of this base sequence : 323971
ggcaaatagttattcttgcttcacttcatgcaaataatcagaccaagaatagtaagactaaaacgtattttgcaaataaattggtcccagtatgatttgtctgtagtaaaaatgaggggctggagagaggaaaaatatgattctgaagaaactgtagtatacctgttattaaattctagccttgtgcattgttttccatttttattatttgtctacaattttcctggactagatcctgaattctttcctgcctacaggcctccaaactaacattttcaattttttttctctcctattcttctgacttagaatcactaaaaattaaaactgtgctcttcttaaagtcctgcaagcttatgctagacaacttaaactttgagagaaataatagcaactgtgtgtgtgtgtgtgtgtgtgtgtgtgtgtgtctacctgctgatatatggatgtctcagtaatacagctgaaatcaat

SEQ ID NO: 26604 - DNA, 478 bp, Homo sapiens
  chrX.fa.O7frz.148354852
  Located on chromosome X
  Distance between a terminus base of telomere on chromosomal short arm and 5'-terminus of this base sequence : 138928009
  Distance between 3'-terminus of neighbour sequence of sequence listing upward to telomere on chrosomal short arm and 5'-terminus of this base sequence : 107888
cagttcttacatactcgtggaggtcccaccttgacggtcttggacatgatccaggagaagtctctgggttatcaggcagagactcttgttctctccccttactttctcccagacaaactgtctctctctctctctctctctctctctctctctctctctctctctctctctctctctctccatgttctgagccatctaaagctggggatggagtaacacaggcactcctctggccaccaacactatgaacactatgactgtgctgggtcaggcctgaagcaagcatagttctgggtcttgcccaaggccttctgtaaccactccctggctgctgcctttatttgctcaaacccctgaggctctataatcagcaggtggcaaagctatccaggcctgtgtctttcctttcagggcagtgagttcccccaggtgggttcagagatgccatcctggagtcaggaattagagttaaagatcc

SEQ ID NO: 26605 - DNA, 401 bp, Homo sapiens
  AL080239.11_51357
  Located on chromosome X
  Distance between a terminus base of telomere on chromosomal short arm and 5'-terminus of this base sequence : 139073623
  Distance between 3'-terminus of neighbour sequence of sequence listing upward to telomere on chrosomal short arm and 5'-terminus of this base sequence : 145136
atggtgaaactccaacttactaaaaatacaaaaattagctgggcgtggtggcacttgcctgtaatcccagctactcaggaggctgaggcaggagaatcgcttaaacccgggaggcggatgttgcggtgaaccgagatcctgccactgcactccaacctgggcaacaagagctagactccatctcaaaaaaaaaccaaaaacacaaaaacaaaacaaaacaaaacaaaacaaaacaaacaaaacaaaacttcatcttattgaccattttcataaaattaaatagcatatgtacagtataactaattttatttttgagttcatctttataaatgagtgatcatgttatttagagccctttaatcatgtcggtactgcaggtaggagacttcctaacatagcat

SEQ ID NO: 26606 - DNA, 311 bp, Homo sapiens
  DXS8084
  Located on chromosome X
  Distance between a terminus base of telomere on chromosomal short arm and 5'-terminus of this base sequence : 139084286
  Distance between 3'-terminus of neighbour sequence of sequence listing upward to telomere on chrosomal short arm and 5'-terminus of this base sequence : 10262
tacccagtcccaccattcaattaatgaattctggatttctgaaagaaatctattttcctctttatttttcccaattatatatgtaataaatattcattattgtaaacttattcattatttttcactacgacagtgaaatgtaaaaatagtaagaattgcatccccactgttaatattctgatgtgtaacacacacacacacacacacacacacacacacacacacacttactttaaagcaaatctaggataatactgtatattctggtttacattttgctttttttttcctgcttaatcttatgaatatct

SEQ ID NO: 26607 - DNA, 380 bp, Homo sapiens
  AL080239.11_20821
  Located on chromosome X
  Distance between a terminus base of telomere on chromosomal short arm and 5'-terminus of this base sequence : 139104243
  Distance between 3'-terminus of neighbour sequence of sequence listing upward to telomere on chrosomal short arm and 5'-terminus of this base sequence : 19646
tcatgtagatacatgcactctcacgttcattacagcattattcacaatagccaagatatggaaacaacttaaatgcccatcaatggatgaatggattttaaaatgtggtgtgtgtgtgtgtgtgtgtgtgtgtgtgtgtgtgtgtgtgtgtgtagttatttatagttgtacagaactaaatattattcagacttaaagaaaagagatcttggcatttgccacaatacggatgaacaagtatagagatctaatgtacagggggactaaagctgatgaaattgcatcatgaatttttgttaaataagtagattttagctgctattgtcacacacttaaaaactaagaagagaggtatgctaatctgcttcaccatagtaacc

SEQ ID NO: 26608 - DNA, 152 bp, Homo sapiens
  AL080239.11_17014
  Located on chromosome X
  Distance between a terminus base of telomere on chromosomal short arm and 5'-terminus of this base sequence : 139108082
  Distance between 3'-terminus of neighbour sequence of sequence listing upward to telomere on chrosomal short arm and 5'-terminus of this base sequence : 3459
acattcaacttccaaattcaacataatctaaaaaactttcttcaatgcaatggtaaataatctgaagtgctttgcttatctcctttcatgcctcactctctctctctctctctctctctctgccaatcttgttcaccttttcaaatcttcct

SEQ ID NO: 26609 - DNA, 348 bp, Homo sapiens
  chrX.fa.O7frz.148653793
  Located on chromosome X
  Distance between a terminus base of telomere on chromosomal short arm and 5'-terminus of this base sequence : 139259196
  Distance between 3'-terminus of neighbour sequence of sequence listing upward to telomere on chrosomal short arm and 5'-terminus of this base sequence : 150962
tcatccagtactgaagttctttagatacacaatttgaattaattccgtggtataaatcaaatttcctatgataacctattagttatcagtgctattcacctaaattggagaaacaactggtattcaaaaagacataagtccagtgttaagcataaactcttggagaaccacgacagctgccttgtttttactcactccttaaagatttccttattaagagttctgcattctaatgctcgtcttggaaaccacaaaatgatccaaattaaatatatatatgtgtgtgtgtgtgtgtgtgtgtgtgtgtgtgtgtgtgtgtgtgttgtgacttctacattgctgaaatag

SEQ ID NO: 26610 - DNA, 445 bp, Homo sapiens
  AL031312.1_34942
  Located on chromosome X
  Distance between a terminus base of telomere on chromosomal short arm and 5'-terminus of this base sequence : 139450520
  Distance between 3'-terminus of neighbour sequence of sequence listing upward to telomere on chrosomal short arm and 5'-terminus of this base sequence : 190976
atgtaagttatctgctcctacaacttatttttcctgctggatctgctcaagacatgccttataaatcatacttctctactcgggaggctgaggcgggagaatcgcttgaacccaggaggtggaggttgcagtgagctgagatcgtgccactgcactctagcccatctcaaaataataataataataataataataataatacttctacctgatggtaacttatttattgctgggcctgatttttatcacttcaagtttgaatagtacatagtttatggtggaaaaattagattacattgtcatataatgccctgtggtcaaactttcaatctccattaaaccccttaatatgccagcacctttttatgaaagaatagttatttggggaaatggtcataaccctgctgaacattcaagaggcctccaccttaattctattgagact

SEQ ID NO: 26611 - DNA, 168 bp, Homo sapiens
  DXS6806
  Located on chromosome X
  Distance between a terminus base of telomere on chromosomal short arm and 5'-terminus of this base sequence : 139744921
  Distance between 3'-terminus of neighbour sequence of sequence listing upward to telomere on chrosomal short arm and 5'-terminus of this base sequence : 293956
gtaggaatgcagtaggcctcctatctatctatctatctattatctatctatctattatctatctatctatctatctatctatctatcatctatctacatttaagtattaactcacatgatcacaaggtttcacaataggccatctgtaggctgaggattaaggagagg

SEQ ID NO: 26612 - DNA, 377 bp, Homo sapiens
  chrX.fa.O7frz.137749978
  Located on chromosome X
  Distance between a terminus base of telomere on chromosomal short arm and 5'-terminus of this base sequence : 139960680
  Distance between 3'-terminus of neighbour sequence of sequence listing upward to telomere on chrosomal short arm and 5'-terminus of this base sequence : 215591
actgtgctttgtatttcatgatatgaaaataccacaatttatccattctgctgttgttattggatatgtgggttgtttcctgttaccttcacaatcaacatgaatattcatatgcatgtcgcccagttcacacatggaaacactgagtgtagagtatgcacatgttcaatttgattgagtaatatcaactgctttccaaagaggttgagcgagcaaaaacgcagaatgttttattttaaccaacatgggattatgggcatgttcagattatagaaaaaagttctttaaaatagacataaatatgtgtatgtgtgtgtgtgtgtgtgtgtgtgtgtatctaccacaaaaaaaaggtgataggagttaacagcctcatc

SEQ ID NO: 26613 - DNA, 396 bp, Homo sapiens
  chrX.fa.O7frz.149398875
  Located on chromosome X
  Distance between a terminus base of telomere on chromosomal short arm and 5'-terminus of this base sequence : 140435916
  Distance between 3'-terminus of neighbour sequence of sequence listing upward to telomere on chrosomal short arm and 5'-terminus of this base sequence : 474859
ttaatttatgctaaggtgcaagctgtgttacttaccattggttttacaccatcagtacaaatgtctacacggtgaaaaaaaatagttttgatcttgcagactccctaaaagctttgtggggagccctagacgtgtatggagtaccaatgctatctatctatctatctatctatctatctatctatctatctatctatcagtatgtgtgtgtgtatatatatacatatatacatacacacacaatgtatgatgtatatcatacatgatatcttctgctacataattccaaatgcatagtatcttattaagccttaacctttactttaaaaagaaatacaaaaattgactcaaaattatggaaagagaaagcctttgtccttttatttctacctgcac

SEQ ID NO: 26614 - DNA, 273 bp, Homo sapiens
  chrX.fa.O7frz.149524869
  Located on chromosome X
  Distance between a terminus base of telomere on chromosomal short arm and 5'-terminus of this base sequence : 140562004
  Distance between 3'-terminus of neighbour sequence of sequence listing upward to telomere on chrosomal short arm and 5'-terminus of this base sequence : 125692
ggtataaacaaatcagctcagtaggctgaactgcgtgctactggcaacaatgtttatatatatatatatatttatatatatatatatttatatatatataaatatttatatatatatatatatatatatatttttttttaccaatctggccatactgtcaggcagaaagatgccagaaaactggtttattaaagggatgtccatctggggcaggacctgatgggcatttgaggggtgcattaaattagaacatgttgatgtccatcagtactc

SEQ ID NO: 26615 - DNA, 185 bp, Homo sapiens
  DXS8043
  Located on chromosome X
  Distance between a terminus base of telomere on chromosomal short arm and 5'-terminus of this base sequence : 140586097
  Distance between 3'-terminus of neighbour sequence of sequence listing upward to telomere on chrosomal short arm and 5'-terminus of this base sequence : 23820
aattattggcaaagagtacaggcaggactaaacaaatgcgaatttaaaaagaagagagagagagagagacagagagtgtgtgtgtgtgtgtgtgtgtgtgtgtgtgtgtgtgtgtgtgtgtctgtgtgtgtttccaggaatctgtttataatagaaattagcctaaccaaatgtttctgagaact

SEQ ID NO: 26616 - DNA, 216 bp, Homo sapiens
  DXS8028
  Located on chromosome X
  Distance between a terminus base of telomere on chromosomal short arm and 5'-terminus of this base sequence : 140800783
  Distance between 3'-terminus of neighbour sequence of sequence listing upward to telomere on chrosomal short arm and 5'-terminus of this base sequence : 214501
tgatgacactcggactgctctttgaaatttatgcagtttttctcacaatcatctcttcattttattctgtgtctctgtctcagttactgtttctctctctcttcctctctctctctctcacacacacacacacacacacacacacaccccgagagggagagagagagacagagagagagagagttataaaataggcaaggcaagtattattatttc

SEQ ID NO: 26617 - DNA, 175 bp, Homo sapiens
  chrX.fa.O7frz.149957419
  Located on chromosome X
  Distance between a terminus base of telomere on chromosomal short arm and 5'-terminus of this base sequence : 141006671
  Distance between 3'-terminus of neighbour sequence of sequence listing upward to telomere on chrosomal short arm and 5'-terminus of this base sequence : 205672
gagcatggtgacaatagttaacaatactttcttgtgtagttgaaatttgctaagaaagtagatcttaaatgttctcaccacacacacacacacacacacacacacacacacacacacaaaggaaaatgttaccatgtgagaagattgatatgttaattagcttcattgtgatcat

SEQ ID NO: 26618 - DNA, 181 bp, Homo sapiens
  Z67289
  Located on chromosome X
  Distance between a terminus base of telomere on chromosomal short arm and 5'-terminus of this base sequence : 141093366
  Distance between 3'-terminus of neighbour sequence of sequence listing upward to telomere on chrosomal short arm and 5'-terminus of this base sequence : 86520
aacactgcacgatgagaaataagttgcataagcctacattgtacccgatacacacacacacacacacacacacacacacacacacgcatatgtgtgtatgtataatttaggaatcttacttattagtagtaaactagttaagacatgtatctaagtgataagtaccaaattcaggatagct

SEQ ID NO: 26619 - DNA, 346 bp, Homo sapiens
  chrX.fa.O7frz.150110555
  Located on chromosome X
  Distance between a terminus base of telomere on chromosomal short arm and 5'-terminus of this base sequence : 141162475
  Distance between 3'-terminus of neighbour sequence of sequence listing upward to telomere on chrosomal short arm and 5'-terminus of this base sequence : 68928
agatacaacgatacatagctgaagatcagattatctggagcaggagacactggagctactaactggtggtacatttatttatttatttatttatttatttatttatttatttatttatttatttattttgagatggagtctcactctgtcgcccaggctggagtgcaatggcatgatctcggttcactgcaacctctgcctcccgggttcaagtgattcttccgcctcagcctcccgagtagctgggactacaggcgcccaccaccacacccggctaatttttgtatttctagtagagacggggtttcacccatattggccaggctggtctcgaactcctgacctc

SEQ ID NO: 26620 - DNA, 307 bp, Homo sapiens
  chrX.fa.O7frz.150194649
  Located on chromosome X
  Distance between a terminus base of telomere on chromosomal short arm and 5'-terminus of this base sequence : 141246550
  Distance between 3'-terminus of neighbour sequence of sequence listing upward to telomere on chrosomal short arm and 5'-terminus of this base sequence : 83729
gagaactcctgcaggatactacacaggaagacaatccctaagacacgtaatcatcagtttttctaaggtcaaaattatatatacatatatatatatacacacacacacacacacacacacacacacgtataagtatatacatatggcagctatacagaaggggccggtcacctacaaaggtaaccacatcaagctaacagcaggcctgttagcagaaaccctataagccagaaaatattgggggcctgtattcaccattctaaaagaaaagaatttctagccaataatttcatatgaagccaaacta

SEQ ID NO: 26621 - DNA, 448 bp, Homo sapiens
  chrX.fa.O7frz.150361041
  Located on chromosome X
  Distance between a terminus base of telomere on chromosomal short arm and 5'-terminus of this base sequence : 141353636
  Distance between 3'-terminus of neighbour sequence of sequence listing upward to telomere on chrosomal short arm and 5'-terminus of this base sequence : 106779
ctaggtttggtgaacaggagctcttatatttggctcctatcccaattcgacatatcctatcctttgtaggtttttatttccttaaatatatatatatttccttaaatatattatttccttaaatatatatatatatatatatagatcaggccatagtgatataaatatacaactgaataaaaaataagttagatttggtagaaaacctaaaattaaaatcaacgagggagaacaggcaaatctcctgtacataaacattccaaacaattcgtgtggacactctgctctcaaggagatctcgcataacttcccactccttgagtgtggattctgcatagtaacttccttccagagtacagtataaaaaggtgggggaaggaataattttatagtggagaaatctgacaaatacaatctcagccaagtaatcaaagtcaatgtcaacagt

SEQ ID NO: 26622 - DNA, 332 bp, Homo sapiens
  AL109653.14_135163
  Located on chromosome X
  Distance between a terminus base of telomere on chromosomal short arm and 5'-terminus of this base sequence : 141453922
  Distance between 3'-terminus of neighbour sequence of sequence listing upward to telomere on chrosomal short arm and 5'-terminus of this base sequence : 99838
tcactgagctaatcttgttcagattcttctctcaaactcaccagggagatcacttctttcttggagtcaggaggaggagaaggagaagggaggcagggaggaggaggaggaggaggaggaggaggaggaggaggaggaggaggaggaggaggaggaggaggaggaggaggaggaggaggcagaagaagagaaagtgagagaaagagagagagagacccactcttcctattatttccagaaggacggtattccctactctatggatcaagctaagaacacttggaggataatatgctttccttttcacctactaaatgctaggcactgtatga

SEQ ID NO: 26623 - DNA, 337 bp, Homo sapiens
  AL109653.14_158242
  Located on chromosome X
  Distance between a terminus base of telomere on chromosomal short arm and 5'-terminus of this base sequence : 141477042
  Distance between 3'-terminus of neighbour sequence of sequence listing upward to telomere on chrosomal short arm and 5'-terminus of this base sequence : 22788
gctgttcctggaagtcttaaactatttggtttgaatattttcagaattttatgagacacacacacacacacacacacacacacacacagagagacataccccatgaggatggcagagaagtgtagtaacacatagccaagatctaaagttaattacatgcaggcaggcctgattttttaagtgacacttcggtctgtccattgaacccaatgatttcattctagagttaaaagtagctttactgcagagcggtgagattgtcttgttattggcttttggaattgggacgttctgagttaagagaaaatgcagtctctgacgagcttgaatgataaat

SEQ ID NO: 26624 - DNA, 447 bp, Homo sapiens
  chrX.fa.O7frz.150728390
  Located on chromosome X
  Distance between a terminus base of telomere on chromosomal short arm and 5'-terminus of this base sequence : 141735824
  Distance between 3'-terminus of neighbour sequence of sequence listing upward to telomere on chrosomal short arm and 5'-terminus of this base sequence : 258445
acctcagaatggtacaatcactggcagcttgtaccctgtacctggaaaagccacagggactcaatgacagctcatgaaagtagtgcaggggctgaaccctgcaaagccacatgggtggagctgcccaagaccttgggagcccaaccctcacagcagtgtgccctggatgttggacatggcatcaaaggagattatttttgaactttaccattaaatgactgccctgctgggttttgaacttgtgtggggcctatagcgtatttcttttggctgatttcttccttgtggaacaggaatgtttacccaatgcccataaccccattgtatcttggaagtaactcacttatttatttatttatttatttatttatttatttatttattttacaggctcataggtggaaaagatttgccttgtctccaatgagacatcagactttggacttt

SEQ ID NO: 26625 - DNA, 231 bp, Homo sapiens
  chrX.fa.O7frz.150845205
  Located on chromosome X
  Distance between a terminus base of telomere on chromosomal short arm and 5'-terminus of this base sequence : 141793125
  Distance between 3'-terminus of neighbour sequence of sequence listing upward to telomere on chrosomal short arm and 5'-terminus of this base sequence : 56854
tttaatccatacaaattccataagcaaattgtcatttaaaaattgaaacccaatgttctgtgttattgtataaaattattgcccatgagtgtttattactgttagtctattagattgtcgttctgcacatatgtgggtgagcacacacacacacacacacacacacacacacacacacggttttgcatgtggttttggtcttgaaatctttattgcactaccatctacaat

SEQ ID NO: 26626 - DNA, 158 bp, Homo sapiens
  chrX.fa.O7frz.150925974
  Located on chromosome X
  Distance between a terminus base of telomere on chromosomal short arm and 5'-terminus of this base sequence : 141803122
  Distance between 3'-terminus of neighbour sequence of sequence listing upward to telomere on chrosomal short arm and 5'-terminus of this base sequence : 9766
tgtagttaatattcacttgaagcagtagttgggatgtatatgtgtgtgagagggagggagagagagagagattgagagagagagagagtaagtatgtgtacttgggttaaaagccatgcttcaccaattaggagctctaggaccttggatgagttatt

SEQ ID NO: 26627 - DNA, 434 bp, Homo sapiens
  AL109654.22_81407
  Located on chromosome X
  Distance between a terminus base of telomere on chromosomal short arm and 5'-terminus of this base sequence : 142037340
  Distance between 3'-terminus of neighbour sequence of sequence listing upward to telomere on chrosomal short arm and 5'-terminus of this base sequence : 234060
taacaatgcagttaaattgctccataaatgaaaaattttagccaaaaagtgttacatataaaagaatgctgagaattaatgtagtacacacaaaacatagaagaagtatagaagaagaagaagaagaagaagaagaagaagaagaagaagaagaagaagaagaagaagaaagtaaaactgaagaaaatagaaggaaaggaaaaatataaattactgaaattgatttttaaatatagttttctcgttagatcaggaaatcatcaaacctaaaagttgtttgtttgaaaataataaacatctgagaagatttctcaggaaaaaataatagagttggcaaaaagaaaataaaatgctagtttaaaaggtggtattgtagtgtggagattaaaaacatgataagattcaaaataataacctgtcaataaatttgaaag

SEQ ID NO: 26628 - DNA, 219 bp, Homo sapiens
  DXS8045
  Located on chromosome X
  Distance between a terminus base of telomere on chromosomal short arm and 5'-terminus of this base sequence : 142115202
  Distance between 3'-terminus of neighbour sequence of sequence listing upward to telomere on chrosomal short arm and 5'-terminus of this base sequence : 77428
actgcggtgctgactaggcatgttcgtccccgcattctcttgccactgctactgttttggttctttttatctgctactacactgactttgttctgcctgctaggctgtgtgtgtctgtgcatgcgtgcgtgtgtgtgtgtgtgtgtgtgtgtgtgtgtgtgtgtgcgtgcaacaaggaagaaatctccttacctgcagaacatttctcagatttacctg

SEQ ID NO: 26629 - DNA, 278 bp, Homo sapiens
  DXS1200
  Located on chromosome X
  Distance between a terminus base of telomere on chromosomal short arm and 5'-terminus of this base sequence : 142348495
  Distance between 3'-terminus of neighbour sequence of sequence listing upward to telomere on chrosomal short arm and 5'-terminus of this base sequence : 233074
tacacaccaaacaacagagcctcacattatgtaaagaaaaaaccaataatgctgaaaggagaaatacataacttcataattatacatataggaacttcaagcctccactcttagcaattgacagcagtactagcaaatcagcaaggatctagaataacaacatagttaatcaataggatccaattgtctacacacacacacacacacacacacacacacacacatgcatcattccacccaacgacaggaggacgcacattgttttcaagtgcccatag

SEQ ID NO: 26630 - DNA, 384 bp, Homo sapiens
  chrX.fa.O7frz.151473216
  Located on chromosome X
  Distance between a terminus base of telomere on chromosomal short arm and 5'-terminus of this base sequence : 142413068
  Distance between 3'-terminus of neighbour sequence of sequence listing upward to telomere on chrosomal short arm and 5'-terminus of this base sequence : 64295
atctgtaaagaatgactacaccatggcttaaaatgaaatgcaaaaatacttcatagaaaataccacttatttatttatttatttatttatttatttatgacagcatctcactttgttgcccaggctagagtgcagtggcacaatctcagctcactgcatcctctgcctcccaggttcaagtgattttcctgcctcagcctccgaagtagcttgactacaggcacgcgtcacgccgcatgggtaatttttgtatttttagtagagacggggtttcaccatgttggccagcctggtcttgaactcttgacttcagttgatccgcctgccttggcctcccagagtgctgagaaaataccacaattttaaataaggtcctttactgcc

SEQ ID NO: 26631 - DNA, 223 bp, Homo sapiens
  chrX.fa.O7frz.151597532
  Located on chromosome X
  Distance between a terminus base of telomere on chromosomal short arm and 5'-terminus of this base sequence : 142693651
  Distance between 3'-terminus of neighbour sequence of sequence listing upward to telomere on chrosomal short arm and 5'-terminus of this base sequence : 280199
agtttgcctgatttgtattagtactttcaacaactcacacacacactctctctctctctctctctctctctctctggattgacacatagtaggtacttagtaaatatttgttgaaagagctgtatatgctgtcagaggatcagaaagaggagcctacttcttatctcttctttgtccttttagtaactttcttcatgttttgtacatgacagaaacattccac

SEQ ID NO: 26632 - DNA, 404 bp, Homo sapiens
  chrX.fa.O7frz.151948553
  Located on chromosome X
  Distance between a terminus base of telomere on chromosomal short arm and 5'-terminus of this base sequence : 142951581
  Distance between 3'-terminus of neighbour sequence of sequence listing upward to telomere on chrosomal short arm and 5'-terminus of this base sequence : 257707
atagatttccagaatatctgagactcactgctgagcaaaaccctaaagaaaatactcacaaacaagcaaacaacaagtaaaatcaacaataaaaagaataaaagcaaactcaagcaaaagaatccccaaaacatataaagaaaatttaaaaaatacgaaaacaaatgactcagagaatctctctctctctctctctcacacacacacacacacacacacacacacacacagagtaaacccaaacaattataactacaacaagaaaaaaaatactgaaaattctaaacaatataaaaccctacatcagtgaaaacaaaatagcaaaccaacaaaagctgaacacacaaaataaagtgagacaagtggctgggaataaacaggaaaagtgacaaacatcagttgcc

SEQ ID NO: 26633 - DNA, 115 bp, Homo sapiens
  DXS998
  Located on chromosome X
  Distance between a terminus base of telomere on chromosomal short arm and 5'-terminus of this base sequence : 143233925
  Distance between 3'-terminus of neighbour sequence of sequence listing upward to telomere on chrosomal short arm and 5'-terminus of this base sequence : 281940
cagcaatttttcaaaggcaaagaaaaactgttgcgcatgcatgcacacacacacacacacacacacacacacgcacaaaaccctgaaagttcttttgaggttatatgaatgatct

SEQ ID NO: 26634 - DNA, 443 bp, Homo sapiens
  AL009048.1_7833
  Located on chromosome X
  Distance between a terminus base of telomere on chromosomal short arm and 5'-terminus of this base sequence : 143297480
  Distance between 3'-terminus of neighbour sequence of sequence listing upward to telomere on chrosomal short arm and 5'-terminus of this base sequence : 63440
aattagtacagccactatggaaagcagtatgaacatgcctcaaaaaactaaaaatagaactaccatacaatccagcaatctcactactggatatatatagccaaaaagaaatgtaatcagtatattaaagagatattggcactctcatgtctgttgcagcactactcacaataaccaagaagtggaagcaagctaagtgtccatcaatggatgaatggataaagaaaacattacatacacacacacacacacacacacacacacacacacacacacacacaatggaatactatgcagccataaaaagagttaaatcctgccatttgcaacaacatggatggactggaggtcattatgttaagtgaaataaagcaagaacggagagacaaatgtgggggctacaaatgtgggtcttgtggaggtagtgaatagaatggcggtta

SEQ ID NO: 26635 - DNA, 477 bp, Homo sapiens
  chrX.fa.O7frz.152352635
  Located on chromosome X
  Distance between a terminus base of telomere on chromosomal short arm and 5'-terminus of this base sequence : 143413136
  Distance between 3'-terminus of neighbour sequence of sequence listing upward to telomere on chrosomal short arm and 5'-terminus of this base sequence : 115213
ctcacttataagtggcaactaaacattgggtactaatggacataaagatggctacaatagaaattggggactactagatagaggagggaggtgatcaaaggtttaaaagctattaaggtactatgctccctacctgggtaacaggatgcaacatatcctaaaattcagcatcatgcagtgtagccatgcaacaaactggcacatgtatactgattctaatacaagttgaaattattaaaaataaaatagagatttcagagacttgatctataattatagatttgtacatgtttggcatctatatatatatatatatatatatatatatatatatatatatatgcaattttaagagaatttggacttttacagtgacacccttgtaactccaatttaaaatgaagaactaagtaattgactattaagtggagttttactgcattctttaacacttagaatgtctacgagaacttggtt

SEQ ID NO: 26636 - DNA, 194 bp, Homo sapiens
  AC016925.15_2296
  Located on chromosome X
  Distance between a terminus base of telomere on chromosomal short arm and 5'-terminus of this base sequence : 143631873
  Distance between 3'-terminus of neighbour sequence of sequence listing upward to telomere on chrosomal short arm and 5'-terminus of this base sequence : 218260
cggaagttgaatcctcagtatttttgcaaagtttgtctttcagtattttatttgtgtgtgtgtgtgtgtgtgtgtgtgtgtgtctatatatatatattttttttttttttttaaagacaggatctcactctgtcacctaggctggagtgcagtggcatgatcatggctcactgtaaccttgaactcctgagctt

SEQ ID NO: 26637 - DNA, 404 bp, Homo sapiens
  chrX.fa.O7frz.152701412
  Located on chromosome X
  Distance between a terminus base of telomere on chromosomal short arm and 5'-terminus of this base sequence : 143761870
  Distance between 3'-terminus of neighbour sequence of sequence listing upward to telomere on chrosomal short arm and 5'-terminus of this base sequence : 129803
atacagcctaaaatggaaatttacattttatctattttgtagaagttattctatagatggctctgtcttgaaagatgacattcattattggcagtgacatttcagccaaattccttcaactgagtttgtgaatcgcattttttctaaattaataaattgcttatgaaaaatagcttctttcagtgtatacgcaactgaatctgaattatatgtgaaatgttatcctattcattttgcttggggtgtgcatgtgcatgtgtgtttgtgtgtgtgtgtgtgtgtgtgtgtatttgtgcatgtggacactttctggagggctttattaagctaggatataaactggttatttccctgattgtccacacataggtcattcaagactaactttaacctgacaatgattc

SEQ ID NO: 26638 - DNA, 258 bp, Homo sapiens
  chrX.fa.O7frz.152789935
  Located on chromosome X
  Distance between a terminus base of telomere on chromosomal short arm and 5'-terminus of this base sequence : 143850483
  Distance between 3'-terminus of neighbour sequence of sequence listing upward to telomere on chrosomal short arm and 5'-terminus of this base sequence : 88209
atccaaactttctagattccacatataagtgagactatgtggtttttatttttctgtgcctgtattatttcacttaagttaatgtcctccaagttcatacatgtcacaaatgatggaatttgcttctttaaggctgaatagtattccattgtgtgtgtatgtgtgtgtgtgtgtatatatatatatatatatatatatatatatacacactaaaccttctttatcccttcatctgttgatggacacttagtttgatta

SEQ ID NO: 26639 - DNA, 248 bp, Homo sapiens
  DXS1215
  Located on chromosome X
  Distance between a terminus base of telomere on chromosomal short arm and 5'-terminus of this base sequence : 143944998
  Distance between 3'-terminus of neighbour sequence of sequence listing upward to telomere on chrosomal short arm and 5'-terminus of this base sequence : 94257
gggcaaaacattaaacctctctcatcctcatttttctcacctgtaaaataaagacaattatacacacacacatgcacgcacgcacacacacacacacacacacacacacatacctactggcacatagtgggcactctgcaaatagttgttattaacaatatgatcactattattatggtgtagagtcaaggaaaggaaggggtggcagaagaacaatcttattttgtcagcgtaatgacttagagggc

SEQ ID NO: 26640 - DNA, 402 bp, Homo sapiens
  chrX.fa.O7frz.144736929
  Located on chromosome X
  Distance between a terminus base of telomere on chromosomal short arm and 5'-terminus of this base sequence : 144073595
  Distance between 3'-terminus of neighbour sequence of sequence listing upward to telomere on chrosomal short arm and 5'-terminus of this base sequence : 128349
aaaggccttctatttgagtaaaatgatcacaatttaatatttagactcactctgttgcaatatttttattcctgtttagtattgtaaccattttggataccacatattttgaggtttttccaaaatgtccttaaagaaatttatgaacaattgactcttttggcacaggctgtttcttcatctctaatactcctgcttttatccaagacacagtaagctccaactttttcacatttctcctgctgtgaactccagtaccctatatttttacctagaatcacggttctgttgtgtcctctggttaccgatcccctgcacccctccccccgcctctctctctctctctctctctctctctctctctctctctcatttgaaatgtagtttccttctttcagtaca

SEQ ID NO: 26641 - DNA, 136 bp, Homo sapiens
  Z67035
  Located on chromosome X
  Distance between a terminus base of telomere on chromosomal short arm and 5'-terminus of this base sequence : 144263655
  Distance between 3'-terminus of neighbour sequence of sequence listing upward to telomere on chrosomal short arm and 5'-terminus of this base sequence : 189658
agaccaaacttgaagaaacctttttgagtgtgtgtgtctgtgtgtgtgtgtgtgtgtgtgtgtgtgtgttacctgtggtagaactcaacattatcattgctactataatttgagtgtttactctgtgccacaagct

SEQ ID NO: 26642 - DNA, 103 bp, Homo sapiens
  DXS8091
  Located on chromosome X
  Distance between a terminus base of telomere on chromosomal short arm and 5'-terminus of this base sequence : 144279073
  Distance between 3'-terminus of neighbour sequence of sequence listing upward to telomere on chrosomal short arm and 5'-terminus of this base sequence : 15282
cacattcaggttccacaggtacctgaaaagcacgtgcatgcacacacacacacacacacacacacacacacacacactcactgagacttttgcctggatcttg

SEQ ID NO: 26643 - DNA, 453 bp, Homo sapiens
  chrX.fa.O7frz.154007274
  Located on chromosome X
  Distance between a terminus base of telomere on chromosomal short arm and 5'-terminus of this base sequence : 144424298
  Distance between 3'-terminus of neighbour sequence of sequence listing upward to telomere on chrosomal short arm and 5'-terminus of this base sequence : 145122
ggtgacaaagctagactctgtctcaaaaataaataaataaataaataaataaataaataaataaataaataacaaaacttcatgtcatagagtttattaacattcctggcaacaacaacaacaaaatgctgatgtgttctgcagttgggtttagaagaattttctcggaactgcatctgaaaacagtaaaaggcctatttatatcaagtggaaactgagggttgcttgcagatggtgctttattaggaaatgaatttgttaataaacgtagctttatacatttctttacagaaatttttgttcatttttaccttaggataaaaatctgctggtgtagacagctctgcattttggtgcaatttgttattagtatagcttgccaagtaaataatcacatgcacatgaaaggattgatatcacatattaaatgtctccatcctaagtcagtaagct

SEQ ID NO: 26644 - DNA, 230 bp, Homo sapiens
  chrX.fa.O7frz.153900217
  Located on chromosome X
  Distance between a terminus base of telomere on chromosomal short arm and 5'-terminus of this base sequence : 144531316
  Distance between 3'-terminus of neighbour sequence of sequence listing upward to telomere on chrosomal short arm and 5'-terminus of this base sequence : 106565
gcaaacgatgagtatgctatagagatgtaaagctgctgttcaaaaaggaaggaaggaaggaaggaaaggagggagggaggaaggaaggaaggaaagaaggaaggaaggaaggaaagaaagaaagaaagaaagaaagaaagaaagaaagaaagaaagaaagaaagaaagaaagagaaagaaagaaggaaagaaagaaagaaaacattgtcaaaggtttagtggtagaatta

SEQ ID NO: 26645 - DNA, 336 bp, Homo sapiens
  AC006522.5_18556
  Located on chromosome X
  Distance between a terminus base of telomere on chromosomal short arm and 5'-terminus of this base sequence : 144602829
  Distance between 3'-terminus of neighbour sequence of sequence listing upward to telomere on chrosomal short arm and 5'-terminus of this base sequence : 71283
ccgatttaaggaccgaattatatgaaaacacaaaaatcaaaatcatctttgatgctgtatgttttagcttttccattaatcacattttgaattgccctcccccttgttattctaggaaacaatagatctaatcctccctgctttcactcctgcctcacttcatccccattaaaaagtcaataagattcacacacatacacatacacacacacacacacacacacacacactcacatgcatttaggaaatcaacacaagtttccaaacttgaaaaaaatataaaaatagattttcctatgtaaaattatcttactcctaaagcaagagtattaggct

SEQ ID NO: 26646 - DNA, 289 bp, Homo sapiens
  AC005731.2_116390
  Located on chromosome X
  Distance between a terminus base of telomere on chromosomal short arm and 5'-terminus of this base sequence : 144735473
  Distance between 3'-terminus of neighbour sequence of sequence listing upward to telomere on chrosomal short arm and 5'-terminus of this base sequence : 132308
ttagctacagtgttcctagaaacagtattttaccagcatttagacacacacacacacacacacacacacacacacacacactcacggtaattccacagcattgtcctaaggctcatgatttcactgctttctccagagttcaactctgtatttcacatgagtcctcttatgacatttttatcctcattttgtgtatgttttcggggaagcatgcttttgcccacatgtaccagtcagtcctcttgcccagaacaaatgtgggaataactcattcaggcaatcagaatac

SEQ ID NO: 26647 - DNA, 322 bp, Homo sapiens
  AC002523.1_126045
  Located on chromosome X
  Distance between a terminus base of telomere on chromosomal short arm and 5'-terminus of this base sequence : 144888909
  Distance between 3'-terminus of neighbour sequence of sequence listing upward to telomere on chrosomal short arm and 5'-terminus of this base sequence : 153147
ctgaaattaaaggctaagtgacatgttatcttgttgtcaagttgaacacgattgcaagagatttaacataaatcatactatcctcttcctgtatatagcattacccttaaaacacacacacacacacacacacacacacacacacacacacacacacagatgtatagattctgtttagaataggcctgcccttcccctatcctgctgaataaaatttgctacttgttttaaaatagcagctgtttttaatcagctcaatatagataaaagccaaacacccaaagaagcccacatggaaaagtttcctttgagttgtagctga

SEQ ID NO: 26648 - DNA, 126 bp, Homo sapiens
  Z66666
  Located on chromosome X
  Distance between a terminus base of telomere on chromosomal short arm and 5'-terminus of this base sequence : 144888996
  Distance between 3'-terminus of neighbour sequence of sequence listing upward to telomere on chrosomal short arm and 5'-terminus of this base sequence : -235
cctgtatatagcattacccttaaaacacacacacacacacacacacacacacacacacacacacacacacagatgtatagattctgtttagaataggcctgcccttcccctatcctgctgaataaa

SEQ ID NO: 26649 - DNA, 149 bp, Homo sapiens
  HUMUT587
  Located on chromosome X
  Distance between a terminus base of telomere on chromosomal short arm and 5'-terminus of this base sequence : 145025846
  Distance between 3'-terminus of neighbour sequence of sequence listing upward to telomere on chrosomal short arm and 5'-terminus of this base sequence : 136724
tagggtctggaaattgctgacacatagtaagaactcaaacgtgtaaaaaagagaaatgtgtgtgtgtgtgtgtgtgtgtgtgtgtatgtatgggtgagggaggtgtttaggtatctgtgtggctgagacagagagtgagtgagggagtg

SEQ ID NO: 26650 - DNA, 159 bp, Homo sapiens
  Z67274
  Located on chromosome X
  Distance between a terminus base of telomere on chromosomal short arm and 5'-terminus of this base sequence : 145025852
  Distance between 3'-terminus of neighbour sequence of sequence listing upward to telomere on chrosomal short arm and 5'-terminus of this base sequence : -143
ctggaaattgctgacacatagtaagaactcaaacgtgtaaaaaagagaaatgtgtgtgtgtgtgtgtgtgtgtgtgtgtatgtatgggtgagggaggtgtttaggtatctgtgtggctgagacagagagtgagtgagggagtgtatatgcacctctgtg

SEQ ID NO: 26651 - DNA, 337 bp, Homo sapiens
  AF011889.1_65380
  Located on chromosome X
  Distance between a terminus base of telomere on chromosomal short arm and 5'-terminus of this base sequence : 145056524
  Distance between 3'-terminus of neighbour sequence of sequence listing upward to telomere on chrosomal short arm and 5'-terminus of this base sequence : 30513
gcaagccttagagtgatgtagagggcggatgaacaacttttcattgcttaggaggatgcagcttcatctacctgcctcctagcaaggaaaaccttggtcctcagtactttaaattgtttttcatacttgttcttgtttatcggttgctgtgtgccaaggcatagaagacaacccaattctgactctggggcctccatgaattgttcatgcaactctcctctcctggcttcccatctgataccccccaacacacacacacacacacacacacacacacacacacacacacacacacacaccatactcaccttaaaataagtagcttggatgaaatggc

SEQ ID NO: 26652 - DNA, 144 bp, Homo sapiens
  DXS1193
  Located on chromosome X
  Distance between a terminus base of telomere on chromosomal short arm and 5'-terminus of this base sequence : 145056698
  Distance between 3'-terminus of neighbour sequence of sequence listing upward to telomere on chrosomal short arm and 5'-terminus of this base sequence : -163
aattctgactctggggcctccatgaattgttcatgcaactctcctctcctggcttcccatctgataccccccaacacacacacacacacacacacacacacacacacacacacacacacacacaccatactcaccttaaaataa

SEQ ID NO: 26653 - DNA, 447 bp, Homo sapiens
  chrX.fa.O7frz.153295036
  Located on chromosome X
  Distance between a terminus base of telomere on chromosomal short arm and 5'-terminus of this base sequence : 145136381
  Distance between 3'-terminus of neighbour sequence of sequence listing upward to telomere on chrosomal short arm and 5'-terminus of this base sequence : 79539
ccatgtttacattcaaagtcagaattctccttggatattgttcaaatcacaataagagaacaaaggtgcattctcttttctctggggcctctatgctgggattttgtaaatccaaggatgccagaatctatgttttccaccaagtgaaaaaagctcaactgcagtagaagagtttgaagccaggaataaatgagcagagctctctctctctctctctctctctctctctgtgtgtgtgtgtgtgtgtgtgtgtgtgtgtgtgcatgtgcgtgtgtgtgtgtgtgtttgaaagagagagagagagaactagtccatactagcatataagcacacagtcactggtgttatcaagtctccaattccccaaatcactgaggtctcctgagctgctttagttcctgaagctcttccacttgttctgggagctacaccagtattctgccaata

SEQ ID NO: 26654 - DNA, 163 bp, Homo sapiens
  DISO7_10004844
  Located on chromosome X
  Distance between a terminus base of telomere on chromosomal short arm and 5'-terminus of this base sequence : 145273781
  Distance between 3'-terminus of neighbour sequence of sequence listing upward to telomere on chrosomal short arm and 5'-terminus of this base sequence : 136953
cagcctgactatctttatctgggtagctttctctttctctctctctctctctcacacacacacacacacacacacacacacacacaactttcctttataggacgaaatctcatagtttaccaaaatctctaaagctcccttgccagcaatccctcagtggact

SEQ ID NO: 26655 - DNA, 172 bp, Homo sapiens
  DISO7_10019819
  Located on chromosome X
  Distance between a terminus base of telomere on chromosomal short arm and 5'-terminus of this base sequence : 145517862
  Distance between 3'-terminus of neighbour sequence of sequence listing upward to telomere on chrosomal short arm and 5'-terminus of this base sequence : 243918
ccttctgagcctcacctccccttccttcccctcccatcccttcccctcccctccccttccctctccccgcttcccttccctaccctaccctgcccccccaccccctgcccccaaccctgccctctcctgctctgtcctctccctccatggcaggctaacctccctggctaga

SEQ ID NO: 26656 - DNA, 152 bp, Homo sapiens
  DISO7_10004846
  Located on chromosome X
  Distance between a terminus base of telomere on chromosomal short arm and 5'-terminus of this base sequence : 145618627
  Distance between 3'-terminus of neighbour sequence of sequence listing upward to telomere on chrosomal short arm and 5'-terminus of this base sequence : 100593
ttcctgacaggagatggggaaattttaatgtaggctaattgtatatgtatatgtatgtgtatgtgtatatgtatatgtatatgtatatgtatatgtatatgtatgtgtatatgtatatgtacatacatatatcactccatgattcctgacat

SEQ ID NO: 26657 - DNA, 290 bp, Homo sapiens
  chrX.fa.O7frz.154490474
  Located on chromosome X
  Distance between a terminus base of telomere on chromosomal short arm and 5'-terminus of this base sequence : 145755331
  Distance between 3'-terminus of neighbour sequence of sequence listing upward to telomere on chrosomal short arm and 5'-terminus of this base sequence : 136552
gatacttagatacgcatgtttgtagcagcacaattcgcaattacaaagtcgttgaaccaacccaaatgcccatcaatcaacgagtggataaagaaactatgagatatatatatatatatctcatatatatctgatatatatgagatatatatagatatatagatgatagatagatagatagatagatagatagatagatatatgatggaatactactcagccataaaaaggaatgcattaacagcattcacagcaactgggatgagattggagactatcattctaagtga

SEQ ID NO: 26658 - DNA, 338 bp, Homo sapiens
  AL034384.1_10067
  Located on chromosome X
  Distance between a terminus base of telomere on chromosomal short arm and 5'-terminus of this base sequence : 145869867
  Distance between 3'-terminus of neighbour sequence of sequence listing upward to telomere on chrosomal short arm and 5'-terminus of this base sequence : 114246
gactggaatctacactgtcagttctctggctttcaggtgtttgaactacacccactagctttcctgggtctctgccttacaaacagcagattgtggggatatatgtactacacacacacacacacacacacacacacacgcatacacacacagtcacattccacatctgcagattcaaccaaccatggatcaaaagtatttggaaaaaaatgataaaaataacaatacaattacaaatgatacaagtaaaaacaatacagtataacaatatttatatagcatgtacattgtatgaggcattgtaagtaatcttgaggtgattcaaagtataccagaag

SEQ ID NO: 26659 - DNA, 332 bp, Homo sapiens
  AL034384.1_138979
  Located on chromosome X
  Distance between a terminus base of telomere on chromosomal short arm and 5'-terminus of this base sequence : 145998784
  Distance between 3'-terminus of neighbour sequence of sequence listing upward to telomere on chrosomal short arm and 5'-terminus of this base sequence : 128579
gaatctatgcctaccagtactgatggggataaccccaagcttaaagagggggcccttttcctccagggcttctagtgccatagtgctttccagaagagagagaaagagagagagagagagagagagagagtataccaactaatgagtggtatgttgtgtccctgcaatggacactggaacagcaccctccaacacacaccaactttggtggtcgactatggaaaagcttaagggaattaagcctgtaggcatttagctcatgagaaaactagcacggagatcacttgaattttcagtttggactgccactttaaatccaaggtatctttgaa

SEQ ID NO: 26660 - DNA, 168 bp, Homo sapiens
  DXS8069
  Located on chromosome X
  Distance between a terminus base of telomere on chromosomal short arm and 5'-terminus of this base sequence : 146044137
  Distance between 3'-terminus of neighbour sequence of sequence listing upward to telomere on chrosomal short arm and 5'-terminus of this base sequence : 45021
gaattgccagtcatcccaaataaatgaccactccaaattgttgggtataggttcttccaaattatttttgtgtacacatagcaatgtgtgagagtgtgtgtgtgtgtgtgtgtgtgtgtgtgtgtaaaaataaatggaacaatgaatacgatgcctacaatgactgtt

SEQ ID NO: 26661 - DNA, 135 bp, Homo sapiens
  DXS8011
  Located on chromosome X
  Distance between a terminus base of telomere on chromosomal short arm and 5'-terminus of this base sequence : 146273776
  Distance between 3'-terminus of neighbour sequence of sequence listing upward to telomere on chrosomal short arm and 5'-terminus of this base sequence : 229471
ctcgagcccaggaattcgagactagcctgggaaacatggcaaaaccctgtctacacgcgcgcgcacacacacacacacacacacacacacacacacacacacacacacaaaagccgggcctggtggcatgtgcct

SEQ ID NO: 26662 - DNA, 374 bp, Homo sapiens
  AF002223.1_128496
  Located on chromosome X
  Distance between a terminus base of telomere on chromosomal short arm and 5'-terminus of this base sequence : 146288961
  Distance between 3'-terminus of neighbour sequence of sequence listing upward to telomere on chrosomal short arm and 5'-terminus of this base sequence : 15050
ggaagtgcgttgatagagtaattagaaatatttaatatgatattgagttataaatcacagaatttaattagcaataagcaataagaaacagacatgtatatatatgtgtgtatacacacacacacacacacacacacacatacacatatatatataatctccagcatgtgatatatgcatgtgtgcagtggaattgatccctgagcaatgtaatatgaatacttactgtgtttaaaatacatgtctataaactgcctttgtattttggcttgactttgccctttaccagttttctgtggtatgctttattttctgtgagcacattatgtgcctgttattttgtttctttgctatatgctgtctattgcttggtt

SEQ ID NO: 26663 - DNA, 240 bp, Homo sapiens
  DXS8103
  Located on chromosome X
  Distance between a terminus base of telomere on chromosomal short arm and 5'-terminus of this base sequence : 146572355
  Distance between 3'-terminus of neighbour sequence of sequence listing upward to telomere on chrosomal short arm and 5'-terminus of this base sequence : 283020
gcccctggggtacacaagccagtgtgtgtgtgtgtgtgtgtgtgtgtgtgtgtgtgtgtgtgtgtgtgtgtgttcagggtgaccaggaattggccagtggggagatgctggcccacctggagcccaggctggttttgaacgcctgtgctcaagtgatcctcccaccttggcttcacaaagtgctcatattacaggcatgaaccaccacatccagcctgcctctctccatcccaagcaacg

SEQ ID NO: 26664 - DNA, 336 bp, Homo sapiens
  AF003626.1_38464
  Located on chromosome X
  Distance between a terminus base of telomere on chromosomal short arm and 5'-terminus of this base sequence : 146582802
  Distance between 3'-terminus of neighbour sequence of sequence listing upward to telomere on chrosomal short arm and 5'-terminus of this base sequence : 10207
gaagcaaatgagtggttacaagcaactcaggaacacacagcagcatggacagttaacacacacagggctcagtggaaaagcacccagtaagagactgaacacactctccaggccactaccacttatgtttactgaaaacacacacacacacacacacacacacacacacacacacacccctctacacagtttgacagagcacacacttgagtggttgccactgaggggaggagcattagagtggaaaacagtaattaaaaagactggagagatggatagattgattcagccagagaagaatctcacagaccaatgatggtgagatcatgaattgag

SEQ ID NO: 26665 - DNA, 323 bp, Homo sapiens
  chrX.fa.O7frz.156298530
  Located on chromosome X
  Distance between a terminus base of telomere on chromosomal short arm and 5'-terminus of this base sequence : 146687854
  Distance between 3'-terminus of neighbour sequence of sequence listing upward to telomere on chrosomal short arm and 5'-terminus of this base sequence : 104716
aagctttcatgaggtatcctacaaccttgttgaaattgttcactaattctgatagttttatagtggactccttaggattttctttatacattattatgtaatctgccaatggagatagtttcacttcttactttcaaatctggatccctttctttccttctttctttctttgtttctttctttgtttctttctttctttctttctttcttcctttctttctttctttctttctttctttctttctttctttctttttctttctttctttctttctttttttgcttaactgccctgtcgagaacttccagtacaatgttgaata

SEQ ID NO: 26666 - DNA, 265 bp, Homo sapiens
  U82694.1_26696
  Located on chromosome X
  Distance between a terminus base of telomere on chromosomal short arm and 5'-terminus of this base sequence : 146747966
  Distance between 3'-terminus of neighbour sequence of sequence listing upward to telomere on chrosomal short arm and 5'-terminus of this base sequence : 59789
tggtcgattctgctattaatacttgtaattatattttgaagttcttgaagagagtttttcagctctatcagatcagtttggatcttttctttttcctttcctttcctttcctttcctttcctttcctttcctttctctttccctttgctttcctttttttcttttcttttcttttttttctttcttttctttctttttttcttacagggtctatcatccagactggagtgcagtggtgcaaacatggttgactgcagtcttgacc

SEQ ID NO: 26667 - DNA, 322 bp, Homo sapiens
  AF035396.1_25790
  Located on chromosome X
  Distance between a terminus base of telomere on chromosomal short arm and 5'-terminus of this base sequence : 146869290
  Distance between 3'-terminus of neighbour sequence of sequence listing upward to telomere on chrosomal short arm and 5'-terminus of this base sequence : 121059
gctaggaatcatgtgaatcaattccttataatctctctctctctctctctatatatatatatatacacatacacacacacacacacacacacacacacacacacaaacactctctctctctttctctctctctctctctctctctctcgatcctattggttctgtttctctggagaagcctgacaaatataataggatattgtgaagagaaaatgggtaccatagcccctctcccggcatctgggacagactaggggctcaatatgaattccctcttattccctttccttctatttccctttacatcttcactgattagcct

SEQ ID NO: 26668 - DNA, 162 bp, Homo sapiens
  Z67417
  Located on chromosome X
  Distance between a terminus base of telomere on chromosomal short arm and 5'-terminus of this base sequence : 146997519
  Distance between 3'-terminus of neighbour sequence of sequence listing upward to telomere on chrosomal short arm and 5'-terminus of this base sequence : 127907
taacgcacccattacctcacattttgtgtgtgtgtgtgtgtgtgtgtgtgtgtgtgtgtgtgtgtgtgtgtgtggtgagaactttaaaaatccattctctggccacgcatggtggctcgcgcctgtaatcccaacactttgggaggctgaggcgagtggatc

SEQ ID NO: 26669 - DNA, 348 bp, Homo sapiens
  AF002992.1_59403
  Located on chromosome X
  Distance between a terminus base of telomere on chromosomal short arm and 5'-terminus of this base sequence : 147293726
  Distance between 3'-terminus of neighbour sequence of sequence listing upward to telomere on chrosomal short arm and 5'-terminus of this base sequence : 296045
ccagactcatagctactgtcacctactgcctgtggtagaacctcaaactcaatatgagaggcagccgaatgtagtgcttaaagagtctagactaatgggccctactgcctgaattgaaatacttgcttcttcactgattagctgtgatatctcaggcaaattactttatctctctggaactcagttacctcacttataaattaaaatcatcatcatcatcatcatcatcagcagcagcagcagcagcagcagcagcagcagcagcatcctctacttgatagggttggaggaggagtgaggtaacacatgtaaaatgcagagacggggtcctgtaataccgtatgctct

SEQ ID NO: 26670 - DNA, 349 bp, Homo sapiens
  chrX.fa.O7frz.158503490
  Located on chromosome X
  Distance between a terminus base of telomere on chromosomal short arm and 5'-terminus of this base sequence : 147434887
  Distance between 3'-terminus of neighbour sequence of sequence listing upward to telomere on chrosomal short arm and 5'-terminus of this base sequence : 140813
tacttcatttcaaggcttataaactaacaatgatcagtatagtgtgggactgtcataattacagcaatatatcaacagaagagaataaactccaggaatgaatcaacatgtatatgcatctatagataactatttattgataaagatgcaaatgaagattagaggggagaaatgatagtgtattcaacaattgggtctggaacaattggatatccatatgcaaaactaaatttcaatccatactttatctatctatctatctatctatctatctatctaaaaagggagagagaaaaataaaggtattttaaggaattgtctcaggtgattatgaggtctgatacatcca

SEQ ID NO: 26671 - DNA, 426 bp, Homo sapiens
  chrX.fa.O7frz.158633499
  Located on chromosome X
  Distance between a terminus base of telomere on chromosomal short arm and 5'-terminus of this base sequence : 147565013
  Distance between 3'-terminus of neighbour sequence of sequence listing upward to telomere on chrosomal short arm and 5'-terminus of this base sequence : 129777
cattaccatatctcagctaggacaaattgctgctatttcagaagggtagccattgctttttcagtttggcctggctaggaaaaaggtggccttgttatgtaaataaagtccctttgtaataaaaataaaaaatctttcctcttttttttgtctttttgctggccgtctttctccttgcaccacaccaccgtgtgtgtgtgtgtgtgtgtgtgtgtgtgtgtgaatttaactccttccgaggtcttgttccccataatttggaacttccttgggatttgatcaagtcacatagagctgatcaaacccaatgtgaaaaagactgaaacaacaacaaaaacagaaacaactaatgacaacagcaaaaaacagttaagcaaaataaacaattgcacaacttatatgattactgagcactctaatggtaag

SEQ ID NO: 26672 - DNA, 315 bp, Homo sapiens
  chrX.fa.O7frz.158714084
  Located on chromosome X
  Distance between a terminus base of telomere on chromosomal short arm and 5'-terminus of this base sequence : 147703517
  Distance between 3'-terminus of neighbour sequence of sequence listing upward to telomere on chrosomal short arm and 5'-terminus of this base sequence : 138078
  misc_feature (1)...(315): n = A,T,G or C
ggaaacagtcaagtactcagtaaggtnacaacaaaatagagaggaagtattttggatttatctctcctgtgacactcagcactttgtcctatatcagtgctctgtctgtatatgtgtgtatatatatatggatatatgccttacttttcttagaccatcaggtcctgagtactgggaccatgtagtttagttttgcaaaccacaggtattccagaaataattgccgtgtgtgcgtctatgtgtgtgtgtgtgtgcgtgtgtgtgtgtgtgtgtttcaatcgagactatgattactgctaggccacttatacctac

SEQ ID NO: 26673 - DNA, 246 bp, Homo sapiens
  chrX.fa.O7frz.158833770
  Located on chromosome X
  Distance between a terminus base of telomere on chromosomal short arm and 5'-terminus of this base sequence : 147747136
  Distance between 3'-terminus of neighbour sequence of sequence listing upward to telomere on chrosomal short arm and 5'-terminus of this base sequence : 43304
ggttaatgttagtctatgtcctgtgtaagcagtctctaccttttccaagatcatggagatactctcttatgctttcttctattaataaaagctggattgttttatctttcactctttcacatttagatgtggaaaccatctggaatttatttttgtttatcatgtgatgtaagagtcaagaagaatctctctctctgtctctctctctctcgttctctctctctcttctattctgttccatgagta

SEQ ID NO: 26674 - DNA, 216 bp, Homo sapiens
  AF274857.1_109734
  Located on chromosome X
  Distance between a terminus base of telomere on chromosomal short arm and 5'-terminus of this base sequence : 147930722
  Distance between 3'-terminus of neighbour sequence of sequence listing upward to telomere on chrosomal short arm and 5'-terminus of this base sequence : 183340
cagtacaggtagtctgaggtgatgattccctcctctgtggacagagcactggcagaggctgagtgaggagtttagaccccaaaccctttcaaccaggagaagcaggagagccaggaagtcattttttattattattattattattattattattattattattattattattggttctcagtgtctaaggaaatttctgtcaaatcactagctaag

SEQ ID NO: 26675 - DNA, 151 bp, Homo sapiens
  DISO7_10004863
  Located on chromosome X
  Distance between a terminus base of telomere on chromosomal short arm and 5'-terminus of this base sequence : 148118555
  Distance between 3'-terminus of neighbour sequence of sequence listing upward to telomere on chrosomal short arm and 5'-terminus of this base sequence : 187617
tcaacactcacctgaaccccacctcttgcattccccatcccctacattcttgcgcatgcacacacacacacacacacacacacacacacacacacacacacacaacacacacacaaaacacataaccctatacttcttcacctagggttaa

SEQ ID NO: 26676 - DNA, 305 bp, Homo sapiens
  chrX.fa.O7frz.157371406
  Located on chromosome X
  Distance between a terminus base of telomere on chromosomal short arm and 5'-terminus of this base sequence : 148406525
  Distance between 3'-terminus of neighbour sequence of sequence listing upward to telomere on chrosomal short arm and 5'-terminus of this base sequence : 287819
ctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctact

SEQ ID NO: 26677 - DNA, 141 bp, Homo sapiens
  DXS8061
  Located on chromosome X
  Distance between a terminus base of telomere on chromosomal short arm and 5'-terminus of this base sequence : 148406584
  Distance between 3'-terminus of neighbour sequence of sequence listing upward to telomere on chrosomal short arm and 5'-terminus of this base sequence : -246
agaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagc

SEQ ID NO: 26678 - DNA, 407 bp, Homo sapiens
  chr6.fa.O7frz.119864073
  Located on chromosome X
  Distance between a terminus base of telomere on chromosomal short arm and 5'-terminus of this base sequence : 148717496
  Distance between 3'-terminus of neighbour sequence of sequence listing upward to telomere on chrosomal short arm and 5'-terminus of this base sequence : 310771
aacaaagtatgctggtagttgtgtgtctcctgtgcaaacatctatctatcatctatctatctatctatctaatctatctatctatctatctatctatctatctatctatctatctatctatctatctctatgcctgtctatctatctagctatctatctacctgcctacctatctacctgtctgtgtacctattatatatatacagaaacactatctctgcttctttgattcagttagctactgcttcatctgcctcattgatttaaaaagacactcttcaatatttgtgtctcctatttctgtttctccctcattaatgtctgctttatatattaacattattacttgttcgtgctttcttttaactttgttttatgtctagcccttgagctagaaatgtcactga

SEQ ID NO: 26679 - DNA, 264 bp, Homo sapiens
  chrX.fa.O7frz.157756649
  Located on chromosome X
  Distance between a terminus base of telomere on chromosomal short arm and 5'-terminus of this base sequence : 148791746
  Distance between 3'-terminus of neighbour sequence of sequence listing upward to telomere on chrosomal short arm and 5'-terminus of this base sequence : 73843
cctatagtgacagaaagcagatcattggttgcctggggacaggagaggagaagagaaagggatagtcatgggcatgaggaaactttgaaggtgatggaaatccttattgccttgattgtggtgatggtttcatacgtgtgtgtgtgtgtgtgtgtgtgtgtgtgtgtgtgtgaaagcttatcaagttgtttagctgaaacatgacaaattcacagtttattgtctgtcaaatatatctcagtgtaaacagacaacctacagaat

SEQ ID NO: 26680 - DNA, 124 bp, Homo sapiens
  chrX.fa.O7frz.158187097
  Located on chromosome X
  Distance between a terminus base of telomere on chromosomal short arm and 5'-terminus of this base sequence : 149054849
  Distance between 3'-terminus of neighbour sequence of sequence listing upward to telomere on chrosomal short arm and 5'-terminus of this base sequence : 262839
cactaggacaactccagaaataatgttatacacacacacacacacacacacacacacacacacacacacgatatatatagttttatgaaaacttctagagttcttgtaagttgcacttataccg

SEQ ID NO: 26681 - DNA, 321 bp, Homo sapiens
  chrX.fa.O7frz.158155982
  Located on chromosome X
  Distance between a terminus base of telomere on chromosomal short arm and 5'-terminus of this base sequence : 149085870
  Distance between 3'-terminus of neighbour sequence of sequence listing upward to telomere on chrosomal short arm and 5'-terminus of this base sequence : 30897
ccacgtacctagactcatgacggagctgctgccaccccagcagatctgctcgccttgctgcttcttcacggtctccacggccttcgcagaggtgtcagcaactgccatgaccacttgcagcagctggggagggagggagggagggagggagggagggagggagcgagcaggcactaaatgccgctggtctcacgtagcgacggcatctcctgcttcccacccccactcacactgatcaggtggcattcacctgaaagacagccaagggtgagggacagaactcccagcggggaagtcaccaatcagagttctcggacctaa

SEQ ID NO: 26682 - DNA, 326 bp, Homo sapiens
  chrX.fa.O7frz.158039519
  Located on chromosome X
  Distance between a terminus base of telomere on chromosomal short arm and 5'-terminus of this base sequence : 149202389
  Distance between 3'-terminus of neighbour sequence of sequence listing upward to telomere on chrosomal short arm and 5'-terminus of this base sequence : 116198
ggccactctgtcctttaaggaagggaggaggcccatcctgtcccccttgggaacagagcacgtgcgcgcgtacacacacacacacacacacacacacacacacacactccttctccaaaccacaggccacgtacacctccagcttgctccacactcatcatggggccacctacccttgtcacaaatattggctgacaccgtggcagttgggctgaaaagcagtcggcgcctccagtgccctagacgtgggcccaaaggggcctcgccgccactccacccagagaggcggacaggaggctctgccaagtcagttaaagccagaaatg

SEQ ID NO: 26683 - DNA, 281 bp, Homo sapiens
  DXS8087
  Located on chromosome X
  Distance between a terminus base of telomere on chromosomal short arm and 5'-terminus of this base sequence : 149260361
  Distance between 3'-terminus of neighbour sequence of sequence listing upward to telomere on chrosomal short arm and 5'-terminus of this base sequence : 57646
aaggccagcagcatcaggctggcaaggacgcatacatgagcacacactcggaacacgcgggagtgcctgcctgtgtgcctgcaggcaggagtgtgcaggaggccgtgtgagagcctggggagggctgcgccagtgaacaaggcaggcccatgtgtgtgtgtgtgtgtgtgtgtgtgtctgtctgtctgtctgtctgcctgtgcatgtctgtgtctgtgtacacacataagtgcatttgtgcatgacccaggggagcaagtgcgccctgcctcagggactcc

SEQ ID NO: 26684 - DNA, 480 bp, Homo sapiens
  chrX.fa.O7frz.160343882
  Located on chromosome X
  Distance between a terminus base of telomere on chromosomal short arm and 5'-terminus of this base sequence : 149604728
  Distance between 3'-terminus of neighbour sequence of sequence listing upward to telomere on chrosomal short arm and 5'-terminus of this base sequence : 344086
tagttcatgcagttggaagtatccatttgagaagggacaaagagaagaattcttgcctgtctgtgccaccacctgctctttgtgaccttggctagttacctcacatatgtccccaagtcccccacccatggtaaataagaaaactaaggcctgatgcgttggctcatgcctgtaatcccaacactttggaaggctgaggtgggaggattgcttgagcctagccggggcaacatagcgagacccggaggcatggtggcacacgcctgtggtcccaggtacttggaacgctgaggtgggaggatggcttgagccagggagttcagggctgcagtgagctgagatcgcgccactgctccagcctgggcgacagagcaagaccctgtctcaaaaacacacacacacacacacacacacacaaaagcagctgctggtttccaagggccttgcctggaatcagtccagaagctaaattaatgttaa

SEQ ID NO: 26685 - DNA, 276 bp, Homo sapiens
  HUMUT2234
  Located on chromosome X
  Distance between a terminus base of telomere on chromosomal short arm and 5'-terminus of this base sequence : 149732692
  Distance between 3'-terminus of neighbour sequence of sequence listing upward to telomere on chrosomal short arm and 5'-terminus of this base sequence : 127484
gttgcagtaagccgagatcgtgccattgcactacagcctgggtgacagagcgagactccatctcgaaatagatggatggatggatggatggatggatggatagacagatagatagatagatagacagacagacagacagacagatagatagatagataaaataaaaggttaggagagggcaaaaaacctgaatagacatttctcaaaagaaaacatttaaatgaccaacaggtatatgggaaaaatctcgccaggcaccttggctcacacctgtaa

SEQ ID NO: 26686 - DNA, 221 bp, Homo sapiens
  DXS1073
  Located on chromosome X
  Distance between a terminus base of telomere on chromosomal short arm and 5'-terminus of this base sequence : 150120275
  Distance between 3'-terminus of neighbour sequence of sequence listing upward to telomere on chrosomal short arm and 5'-terminus of this base sequence : 387307
ccgagttattacaaagaagcacagaatcccagcccagtctctgtgtgtgtgtgtgtgtgtgtgtgtgtgtgtgtgtgtgtggtggcggggcaaggggagcagtgtttcaaaggccaccaatctcaggccccattgcccactttacatgtctctctagcaaggcgtggtcacggaattccacccaagccaaccctctaagtttctggcctctggagtcagcc

SEQ ID NO: 26687 - DNA, 479 bp, Homo sapiens
  chrX.fa.O7frz.159975239
  Located on chromosome X
  Distance between a terminus base of telomere on chromosomal short arm and 5'-terminus of this base sequence : 150362130
  Distance between 3'-terminus of neighbour sequence of sequence listing upward to telomere on chrosomal short arm and 5'-terminus of this base sequence : 241634
ttctatttatccacatgctgacttttttgctgttgtcatatgttctaaattttcacacgcacacctggcttaaacaatagaaatttattttctcacagttctggaggctacaagtccaagatcaaggggtaggcaggcttgttttgtgtgtgtgtgtgtgtgtgtgtgtgtgtgtgtgtgtattttttttttgtctgtttgttttttgagatggagtctccctctgtagtccaggctggaatgtgatggcgcgatctgggctcactgcaacttctgcctcctgggctcaagcaattcttgtgcctcagcctcccgagtagctgggattacaagcgcatgccagcatgtccagctaatttttgtatttttagtagaggggggtttcaccatgttgggcaggctggtcttgaactcctgacctcagatgatcttcctgcctcagccttccaaagtgctgggattacaggcatgagttacca

SEQ ID NO: 26688 - DNA, 398 bp, Homo sapiens
  chrX.fa.O7frz.159829360
  Located on chromosome X
  Distance between a terminus base of telomere on chromosomal short arm and 5'-terminus of this base sequence : 150384674
  Distance between 3'-terminus of neighbour sequence of sequence listing upward to telomere on chrosomal short arm and 5'-terminus of this base sequence : 22065
tagaacttatccaatcagttgaaggcctaaatataacaaaaaggcttactgtcctcttagtaagagacagttccttctatttgactacctttaaactgggacttcagtttttttcctgcctttgggctcgaactaaaacattttaactctttctgggtctgtagcctgctggtctttgaactggaactacgaatcagctctctggggtctctaggctgccaactcaccctgcagatcttgagacttggcagactccataatcacatgagctaattccttgtgtgtgtgtgtgtgtgtgtgtgtgtgtatgtatctcctcttggttctggttttgtttctttgggaaccatgactaatacagattttcacaccaagagtgattctaaaggaacagaatt

SEQ ID NO: 26689 - DNA, 111 bp, Homo sapiens
  DISO7_10004864
  Located on chromosome X
  Distance between a terminus base of telomere on chromosomal short arm and 5'-terminus of this base sequence : 150407201
  Distance between 3'-terminus of neighbour sequence of sequence listing upward to telomere on chrosomal short arm and 5'-terminus of this base sequence : 22129
gctgagaatgatgctttgcaaacatatatatatatatatatatatatatatatatatatatatatatgaaattaatctctatttaacttagtaacttgctgtaacacatgc

SEQ ID NO: 26690 - DNA, 107 bp, Homo sapiens
  DID22N_0036400
  Located on chromosome X
  Distance between a terminus base of telomere on chromosomal short arm and 5'-terminus of this base sequence : 150714773
  Distance between 3'-terminus of neighbour sequence of sequence listing upward to telomere on chrosomal short arm and 5'-terminus of this base sequence : 307461
ctggagaggtgggtatggtggggccacattttgggtaggacacacacacacatacacacacacccacacacttcttggcttttagcacatctatgttgtaaaggcaa

SEQ ID NO: 26691 - DNA, 218 bp, Homo sapiens
  AF003627.2_121469
  Located on chromosome X
  Distance between a terminus base of telomere on chromosomal short arm and 5'-terminus of this base sequence : 150815322
  Distance between 3'-terminus of neighbour sequence of sequence listing upward to telomere on chrosomal short arm and 5'-terminus of this base sequence : 100442
caatcaactatggattggttatttttaaaaacaaaaaataacaatacaacaataaaaatggatcatgcctgtaatcccagcactttaggatgccaaggcaggaggacctcaggagttcgcaattagcctgggcaatatagggagaccctgtctctacaaaataataataataataataataataataataataataaagtagctgagtataatggtgc

SEQ ID NO: 26692 - DNA, 130 bp, Homo sapiens
  Z66976
  Located on chromosome X
  Distance between a terminus base of telomere on chromosomal short arm and 5'-terminus of this base sequence : 150836942
  Distance between 3'-terminus of neighbour sequence of sequence listing upward to telomere on chrosomal short arm and 5'-terminus of this base sequence : 21402
ctgccaacatattaaaagggttatataacatgacaagtgggatttagtccggaatgcaatgattatatatatatggatgtgtgtgtgtgtgtgtgtgtgtgtgtgtatgtattgtctacactaccctgat

SEQ ID NO: 26693 - DNA, 104 bp, Homo sapiens
  DISO7_10000368
  Located on chromosome X
  Distance between a terminus base of telomere on chromosomal short arm and 5'-terminus of this base sequence : 151107463
  Distance between 3'-terminus of neighbour sequence of sequence listing upward to telomere on chrosomal short arm and 5'-terminus of this base sequence : 270391
ctggtatcagtgtctcagtgtgacacactgagtgtgacacacacacacacacacacacacaaagccagcattgccattttactctggtattgcaaccagttgct

SEQ ID NO: 26694 - DNA, 152 bp, Homo sapiens
  DISO7_10000372
  Located on chromosome X
  Distance between a terminus base of telomere on chromosomal short arm and 5'-terminus of this base sequence : 151116965
  Distance between 3'-terminus of neighbour sequence of sequence listing upward to telomere on chrosomal short arm and 5'-terminus of this base sequence : 9398
gaaatgtgacacatgcacatactacacacacacacacacacacacacacacatacacacacacacactgggtgaaatgacacgcaaaatgaaatgaaagggtactttgtatacctgggggaaactgacccaaaagtcctttgagcatccagg

SEQ ID NO: 26695 - DNA, 348 bp, Homo sapiens
  chrX.fa.O7frz.162418268
  Located on chromosome X
  Distance between a terminus base of telomere on chromosomal short arm and 5'-terminus of this base sequence : 151274067
  Distance between 3'-terminus of neighbour sequence of sequence listing upward to telomere on chrosomal short arm and 5'-terminus of this base sequence : 156950
agtgcattagcttgtacagaaggaagtaactctaacagcttctttggctagttgactaaaatttggactgaatggcagcctacatttaaatcagttgagatgttagaactttcgtgacataatgtagaggaaggaatatgaaagcttagggagataggaatgatgggtgaattcatcatatgtgatttccacagccaccacacacacacacacacacacacacacacacacacacacgcacacacacactgtatcccccaagatggcccagaaaatattcctttcactaaggttttgagaaatatattagtgagaagagcaccactgtattagtcgcctagtgctaca

SEQ ID NO: 26696 - DNA, 295 bp, Homo sapiens
  AJ271735.1_216344
  Located on chromosome X
  Distance between a terminus base of telomere on chromosomal short arm and 5'-terminus of this base sequence : 151490446
  Distance between 3'-terminus of neighbour sequence of sequence listing upward to telomere on chrosomal short arm and 5'-terminus of this base sequence : 216031
ttcaacttaaagtcctaaccagagcaattaggcaataaaaacaaataaaaagaatccaaataagaaaggaagaaatgaaattatctgtttgctgatgacatgatattatatgtagaaaatcctaaagactacacacacacacacacacacacacacacacacacacacacacacacacacaaactattagaataataaatgaattcaggccgggtgtggtggctcacacctgtaatcccagcactttgggaggccgaagcgggaggatcacttgaggtcaggagttcgagaccaa

SEQ ID NO: 26697 - DNA, 443 bp, Homo sapiens
  MX_151501720
  Located on chromosome X
  Distance between a terminus base of telomere on chromosomal short arm and 5'-terminus of this base sequence : 151501668
  Distance between 3'-terminus of neighbour sequence of sequence listing upward to telomere on chrosomal short arm and 5'-terminus of this base sequence : 10927
agggaaaagggactacataaagggtctcctatatttttctccatttcttttgtttatttatttatttatttatttatttatttattttatttatttttttgagacagagcttctctcttgttgcccagactggagtgcaatggcgcgatctcaggtcactgcaacctccacctcccgggttcaagcgattcccctgcctcagcctcccaagtaggtgggattatgggcatgtgccaccacacctggctaattttttgtatttttagtagagatggggattcaccatgttggccaggctggtcttgaactcctgacctcaggggacccacccgcctcggcctcccaaagtgctgggattacaggtgtgagccaccgtggccgacctcttttactttctttttttatgtttaactattttttccacctgtagtgtattttgatgt

SEQ ID NO: 26698 - DNA, 117 bp, Homo sapiens
  DYS395
  Located on chromosome Y
  Distance between a terminus base of telomere on chromosomal short arm and 5'-terminus of this base sequence : 3038879
  Distance between 3'-terminus of neighbour sequence of sequence listing upward to telomere on chrosomal short arm and 5'-terminus of this base sequence : 0
gtggtcttctacttgtgtcaatacagatagatagatagatagatagatagatagatagatagatagatagatatgtatgtcttttctatgagacatacctcattttttggacttgag

SEQ ID NO: 26699 - DNA, 460 bp, Homo sapiens
  chrY.fa.O7frz.782890
  Located on chromosome Y
  Distance between a terminus base of telomere on chromosomal short arm and 5'-terminus of this base sequence : 3335997
  Distance between 3'-terminus of neighbour sequence of sequence listing upward to telomere on chrosomal short arm and 5'-terminus of this base sequence : 297001
actaggcttaatacctgagtgataaactaatctatacaacatacctccataacacgagtttacctatataagaaacctgaacatgtactcctgaatttaaaataaatgtttaaaaaatagttgtgctttgatatttgcagttcatatatatatataatatatacatatacatatatatacacatatacatatatatatatatatatatattttttaagtgtggccaatcgtacacctttaacattgggtatggcagctggaatattgcagataacacaaaaactgataacacatcaaggccacaaattaagaagatgaactttctcaaatgagggagtgatttttcttaccatggttttcactaatgtcaaattgaatggtaagatgtggggccattgcaatgtttttcttatggcgaaatcacatgcattttaccctaacctgttaagcaaatgtaaac

SEQ ID NO: 26700 - DNA, 439 bp, Homo sapiens
  chrY.fa.O7frz.896150
  Located on chromosome Y
  Distance between a terminus base of telomere on chromosomal short arm and 5'-terminus of this base sequence : 3449244
  Distance between 3'-terminus of neighbour sequence of sequence listing upward to telomere on chrosomal short arm and 5'-terminus of this base sequence : 112787
cgttgtaaggttaagtttgattttaatatttcattattgggaataaaaaaattttaaaacatgtattaatttacccaggaaatgtattaattttatataacacagtcatcattcaattacaaatatataaatcagtagagaaaccaagattgcaggtgatacacacacacacacacacacacacacgtgtgtgtgtgtatataaagaatctttgaagcctcgattgagttacatttttgtgtacgtaattggaaatttttcttacatattaagcagaccaccaatgacatcttttgaaactaagttcaacatcgtcaaatatttatgaacactccctatatgcaaagcactatactagctactggagataaaaagagtcataaggcctatacctaatatttttatgccttgagaggagaccataatttagacctttcat

SEQ ID NO: 26701 - DNA, 388 bp, Homo sapiens
  chrY.fa.O7frz.1016945
  Located on chromosome Y
  Distance between a terminus base of telomere on chromosomal short arm and 5'-terminus of this base sequence : 3569923
  Distance between 3'-terminus of neighbour sequence of sequence listing upward to telomere on chrosomal short arm and 5'-terminus of this base sequence : 120240
gagtaaacagacaacctacagaatgggaaaaaatatttgcaaactgcacatctgacaaaggtctaagttctagcatctataaggagtttaaacaaaattacaagagaaaaacaagccccattaaaaagtaggcaaaggatatgaacagacacttctcaaaagaaggtagacatgcagccaagaagtatatgaaagaaagttcaatatcaatgatcattagagaaatgctatcaaaatgacgagataccatttcacaccagtcagaatagctactgttaataataataataataataataataataataataacagatgctggcaatgttttggagaaaagggaacacttatacactgttggtgagagtgtaaattggtttaaccattg

SEQ ID NO: 26702 - DNA, 311 bp, Homo sapiens
  chrY.fa.O7frz.1115143
  Located on chromosome Y
  Distance between a terminus base of telomere on chromosomal short arm and 5'-terminus of this base sequence : 3668237
  Distance between 3'-terminus of neighbour sequence of sequence listing upward to telomere on chrosomal short arm and 5'-terminus of this base sequence : 97926
gcaagataagactattggcttaagagattgaaaagaaaggatggagtttcccattttatttagaattcagattctttttgagccattactgtccatttctcttggtgtctacccaatggcctaatgtttaactatgcgagacattccaagtctattttatacacacacacacacacacacacacacacacacaatagtgctgtgttctgaatgtgtgtgtccctgaaaaattcatatattaaaatttaatcctcaatgcaataatattaagaggtatggactttgggagttgattagatcatgaggactct

SEQ ID NO: 26703 - DNA, 101 bp, Homo sapiens
  DID22N_0036436
  Located on chromosome Y
  Distance between a terminus base of telomere on chromosomal short arm and 5'-terminus of this base sequence : 4041399
  Distance between 3'-terminus of neighbour sequence of sequence listing upward to telomere on chrosomal short arm and 5'-terminus of this base sequence : 372851
acaatgcaagaactctggcaaaaaacaaacaaacaaacaaacaaacaaacaaacaggttgtccccttacctccaaataaacccactagatccagagcaatg

SEQ ID NO: 26704 - DNA, 187 bp, Homo sapiens
  chrY.fa.O7frz.1526775
  Located on chromosome Y
  Distance between a terminus base of telomere on chromosomal short arm and 5'-terminus of this base sequence : 4079903
  Distance between 3'-terminus of neighbour sequence of sequence listing upward to telomere on chrosomal short arm and 5'-terminus of this base sequence : 38403
cctacatgattacaacctaatcaccctttatctcagcattgaaaaagtagatgtctaatccaaacatttctatatgtctctctattttcctgcttctctcttccttcttctttcaaagagacagacagagagagagagagagagagagagagagagagagagagataaagctagtcaatcctagctt

SEQ ID NO: 26705 - DNA, 183 bp, Homo sapiens
  DID22N_0036443
  Located on chromosome Y
  Distance between a terminus base of telomere on chromosomal short arm and 5'-terminus of this base sequence : 4510680
  Distance between 3'-terminus of neighbour sequence of sequence listing upward to telomere on chrosomal short arm and 5'-terminus of this base sequence : 430590
ttataaacacaggcatggatggacacacacacacacacacacacacaaacactcacacaaaattatcataccttaatctactatttttgtccacaccacactaaagttaaactaagtcaaaatcttagaatcatattttgctatttattctcctttattctctatatccagttgatatcgctt

SEQ ID NO: 26706 - DNA, 401 bp, Homo sapiens
  chrY.fa.O7frz.2062796
  Located on chromosome Y
  Distance between a terminus base of telomere on chromosomal short arm and 5'-terminus of this base sequence : 4615878
  Distance between 3'-terminus of neighbour sequence of sequence listing upward to telomere on chrosomal short arm and 5'-terminus of this base sequence : 105015
gtaccaagatttataaagcaagttcttggagactttaaaagagacttaaggctcccacacaataatagtgggtgactttaacaccccacaggcaatattagatagatcattgagacagaaaattaacaaagatattcaaaacctgaactcagaactggatcaaatggacctgatatatatatatatatatatatatatatatatatatatatatatatatacacacacacacacacaactctccatcccaaaacaactgagcctcccaagtagctgggatttcatacttctcatcaccacatgatatgtactctaaaatagatcacataatcagaagtaaaacactcctcagcaaatgcaaaaacactgaaattataataaacagtttattggacctcatt

SEQ ID NO: 26707 - DNA, 209 bp, Homo sapiens
  DID22N_0036447
  Located on chromosome Y
  Distance between a terminus base of telomere on chromosomal short arm and 5'-terminus of this base sequence : 4791873
  Distance between 3'-terminus of neighbour sequence of sequence listing upward to telomere on chrosomal short arm and 5'-terminus of this base sequence : 175594
tcctctaaacaataattgaattcagaataatataaatcatgttaaagaaatataacataaataattaaaattataagacagcagttcaaaagttcaaatacctattatatatatatatatatatatatatatatatatatatatatatacacacacatgccttaggagataaaattattttattcttcaatgaaatattcattgttctt

SEQ ID NO: 26708 - DNA, 102 bp, Homo sapiens
  DID22N_0036461
  Located on chromosome Y
  Distance between a terminus base of telomere on chromosomal short arm and 5'-terminus of this base sequence : 5076904
  Distance between 3'-terminus of neighbour sequence of sequence listing upward to telomere on chrosomal short arm and 5'-terminus of this base sequence : 284822
catgtaggtgtttgcatgtgtacacacacacatacacacacattgcccattgaaaatgaaaaagaacagtctcattgcctgtgttctaggcacactacacct

SEQ ID NO: 26709 - DNA, 124 bp, Homo sapiens
  DID22N_0036462
  Located on chromosome Y
  Distance between a terminus base of telomere on chromosomal short arm and 5'-terminus of this base sequence : 5135770
  Distance between 3'-terminus of neighbour sequence of sequence listing upward to telomere on chrosomal short arm and 5'-terminus of this base sequence : 58764
gcctcattcctgttatctgcttatattaaatgtttcaaaaaagaaggaaggaagggaggaaggaaggaaggaaggaaggaaggaaggaaggaaggaaggaagcacagacatcaattgcaaacaa

SEQ ID NO: 26710 - DNA, 154 bp, Homo sapiens
  DID22N_0036467
  Located on chromosome Y
  Distance between a terminus base of telomere on chromosomal short arm and 5'-terminus of this base sequence : 5207304
  Distance between 3'-terminus of neighbour sequence of sequence listing upward to telomere on chrosomal short arm and 5'-terminus of this base sequence : 71410
ggaaacattgacatacatgtgtacttatatgtttatatatatatatatgtgtgtatatatacacacacacacacacacacacacacacacacataaatgttttttggagtgaaaatctggatcttagaaagttaatgctatatctggctttgtg

SEQ ID NO: 26711 - DNA, 366 bp, Homo sapiens
  chrY.fa.O7frz.2827612
  Located on chromosome Y
  Distance between a terminus base of telomere on chromosomal short arm and 5'-terminus of this base sequence : 5380585
  Distance between 3'-terminus of neighbour sequence of sequence listing upward to telomere on chrosomal short arm and 5'-terminus of this base sequence : 173127
tacagtatggaagcaaattgacacgtgcctgtcctttcataatcaaaaagcattagtgatgtgacttgtgaagcagtgtgaaaaggttctgaacacacagtagccttcctataagcagaataccaaaagcaaactcactttgcctagagtaagctacttacttgggatccaagggggattattacaattcaaggtcaggtccattatattattttttcatcttctaagatcaaaaagcataagcacaagatccttatagatgtattttaacctaaattttatctatctatctatctatctatctatctatctatgtatctatcttcctatttaacagattttctatttgtacattcatgccatagt

SEQ ID NO: 26712 - DNA, 101 bp, Homo sapiens
  DID22N_0036505
  Located on chromosome Y
  Distance between a terminus base of telomere on chromosomal short arm and 5'-terminus of this base sequence : 6104544
  Distance between 3'-terminus of neighbour sequence of sequence listing upward to telomere on chrosomal short arm and 5'-terminus of this base sequence : 723593
tcatctacattcactgggatgttcgtgtgtgtgtgtgtgtgtgtgtgtgtgtgtgtgtatattttaacttaccaaatgatgttgcattctttcatgtgtca

SEQ ID NO: 26713 - DNA, 124 bp, Homo sapiens
  DID22N_0036517
  Located on chromosome Y
  Distance between a terminus base of telomere on chromosomal short arm and 5'-terminus of this base sequence : 6252515
  Distance between 3'-terminus of neighbour sequence of sequence listing upward to telomere on chrosomal short arm and 5'-terminus of this base sequence : 147870
tcctttaagctgactccacttacaggcacacacacacaaacacacacagacacaaacacacatgcagacatccaacacttgcaacactcctacagaaacacacagcccagcagctctagaggct

SEQ ID NO: 26714 - DNA, 403 bp, Homo sapiens
  chrY.fa.O7frz.3810963
  Located on chromosome Y
  Distance between a terminus base of telomere on chromosomal short arm and 5'-terminus of this base sequence : 6363995
  Distance between 3'-terminus of neighbour sequence of sequence listing upward to telomere on chrosomal short arm and 5'-terminus of this base sequence : 111356
agcatacttgttagaattactggttctccaggtctcattttagatgattgaaccaggattttgaaggaaaatagctagaagtatctggacatatattttatgacccacataattatttggggttatttgtgaaactttggtctcacacataagagaaagtaaaaaaataacaaaacaaaacaaaaaaaacccaaaaaacaaacaaacaaaaaacaataaaacacacacacacacacacacacacacacacacacacacacacacacaaaagaacatcaagtcaggagtcaggaataaataccttatccttccctcactccaggcttctcaagttgtatgcccctaaatgcattttcattcttggcaaatactactccaactatctagcacttcagagtggtaa

SEQ ID NO: 26715 - DNA, 361 bp, Homo sapiens
  chrY.fa.O7frz.3991795
  Located on chromosome Y
  Distance between a terminus base of telomere on chromosomal short arm and 5'-terminus of this base sequence : 6560574
  Distance between 3'-terminus of neighbour sequence of sequence listing upward to telomere on chrosomal short arm and 5'-terminus of this base sequence : 196176
attcctgtagctgactaggtaatcaatacaatatgaaaaaagtgccatatcctcaatcttttctgatatatttctttgttctatgctttaatagaagtgagttaccataactagtgtcaaaatctcttcagtgatttctcagatcattcagggtgaaaccaagggttagtttcatgaatcggagaaaaatacccaaaggaagtatgtgaaaaatacctctctctctctctctctctctctctctctctcacacacacacacacacacacacacacacaaagacacttgacattttttttttctcgtaaaaggcacaattgtctattcttataacccacttcaaagtaaatagcaatgattg

SEQ ID NO: 26716 - DNA, 129 bp, Homo sapiens
  DID22N_0036537
  Located on chromosome Y
  Distance between a terminus base of telomere on chromosomal short arm and 5'-terminus of this base sequence : 6826781
  Distance between 3'-terminus of neighbour sequence of sequence listing upward to telomere on chrosomal short arm and 5'-terminus of this base sequence : 265846
aatcctggctgtgtcctccaagttccttttctttctttctttctttctttctttctttctttctttctttctttctttctttctttctttctttctttttgtagatagggaatatctgcatttcagctt

SEQ ID NO: 26717 - DNA, 108 bp, Homo sapiens
  DID22N_0036541
  Located on chromosome Y
  Distance between a terminus base of telomere on chromosomal short arm and 5'-terminus of this base sequence : 6907011
  Distance between 3'-terminus of neighbour sequence of sequence listing upward to telomere on chrosomal short arm and 5'-terminus of this base sequence : 80101
ccctgcactaggatataactaggttaagaaatcattcattcataaggtctttctctctctctctctctctctctctctgtctctcgttaactcatccagtactgccca

SEQ ID NO: 26718 - DNA, 429 bp, Homo sapiens
  chrY.fa.O7frz.4671366
  Located on chromosome Y
  Distance between a terminus base of telomere on chromosomal short arm and 5'-terminus of this base sequence : 7240235
  Distance between 3'-terminus of neighbour sequence of sequence listing upward to telomere on chrosomal short arm and 5'-terminus of this base sequence : 333116
atcttatttcactagatgtgcaagctcttctatgaattaactctttaaaccacaaaagcacattcctagttttcagaaaactgggacaatgattgaatacagatggaataaaaggacttcccctattgagactcatagcaggtaaaagtgaaatctgacatttatttatttatttatttatttatttatttatttatttattttgagacagagtatttctctgtcctacaggctgccatgcagtggtgcaatctcggctcactgcaaccacagcctcccaggttcaagcgattctcatgcctcagcctcctgagtagctgggattacagtcatgtgccaccaggcctggctaattattttgttcttttagtagagatgggatttcactatgttggccaggttggcctctaactcctaagtgtgaacaaa

SEQ ID NO: 26719 - DNA, 119 bp, Homo sapiens
  DYS288
  Located on chromosome Y
  Distance between a terminus base of telomere on chromosomal short arm and 5'-terminus of this base sequence : 7623185
  Distance between 3'-terminus of neighbour sequence of sequence listing upward to telomere on chrosomal short arm and 5'-terminus of this base sequence : 382521
ttgctttgcttgtcatttcagagaatcacacatagtcagtaaattacacacacacacacatgcacacacacacacaccccactgtgctgtaaaaattcagtgtccaggtatttgtaatg

SEQ ID NO: 26720 - DNA, 388 bp, Homo sapiens
  chrY.fa.O7frz.5263862
  Located on chromosome Y
  Distance between a terminus base of telomere on chromosomal short arm and 5'-terminus of this base sequence : 7833173
  Distance between 3'-terminus of neighbour sequence of sequence listing upward to telomere on chrosomal short arm and 5'-terminus of this base sequence : 209869
cttatgcctgcaatatcagtactttgggaagctgaggcaggcaaatcacctgaggtgagaaattcaagacaagccagattaacatggtgaaacattgtctctttaaaaaattcaaaaatttggcagccatcatggcagctgcctctaatgtgagctgctcaggaggctggggctggagaatcacctgaacctgggtggtggaggttactgtgagtcaagattgagccattgcactgcagactgagcaacaggaatgaaactccaatgaaagaaagaaaaggaaggaaagaaagaaagaaagaaagaaagaaagaaagaaagaaagaaagaaagaaagaaagaaagaaaggagggtgggcgtggtggctcatgcttgtaatgccagaac

SEQ ID NO: 26721 - DNA, 347 bp, Homo sapiens
  chrY.fa.O7frz.5620140
  Located on chromosome Y
  Distance between a terminus base of telomere on chromosomal short arm and 5'-terminus of this base sequence : 8189461
  Distance between 3'-terminus of neighbour sequence of sequence listing upward to telomere on chrosomal short arm and 5'-terminus of this base sequence : 355900
tcatgtaacctagatgattggtccagatgtatgttacaatccttcctgaggatattgtcacatcatctggatgctggtttcagttacatcaaatctccctgtgtaagcaggacttcagcaagagaggaggttcatttcacctaggcaattggcctagatatatgtcacaatgacccttttgtgcagtaggaaggctggagactgacctcacattgttgttaagcccagcaacatatcacaatctccctgtggtcggggcacaggcaaaagcaaaataaataaataaataaataaataaataaataaataaataaataacctaggtgctaatccaagtgatatgttac

SEQ ID NO: 26722 - DNA, 335 bp, Homo sapiens
  AC064829.5_11946
  Located on chromosome Y
  Distance between a terminus base of telomere on chromosomal short arm and 5'-terminus of this base sequence : 8378496
  Distance between 3'-terminus of neighbour sequence of sequence listing upward to telomere on chrosomal short arm and 5'-terminus of this base sequence : 188688
caatagtcagacagcccacaccacaccccaagcctgttagttaaaaatcaatccctcacataactgcttgtattattatagattccagacaatgtatgagcaagcattgtgaaactttctgttctgttctgttctgttctgttctgttctgttctctcttgattaccaacgtatgcagccccaaccatgtaccacatgtttgctcaatcaattacgaccctttcacatggacccccttagagttgtaagcctttaaaatgggcaggaatctccctctcaaggagcttgatttttgaaatgcaaatatgccaaaactgcctgcctaataaagccaa

SEQ ID NO: 26723 - DNA, 288 bp, Homo sapiens
  AC064829.5_25281
  Located on chromosome Y
  Distance between a terminus base of telomere on chromosomal short arm and 5'-terminus of this base sequence : 8391833
  Distance between 3'-terminus of neighbour sequence of sequence listing upward to telomere on chrosomal short arm and 5'-terminus of this base sequence : 13002
gtgagagtgttgcgagagttagatgtctatgtgtgtgtgatattctgtttgtgtgtgtgtgtgtctgtccctttaagaggagtctgctaaaaggaatgtggctaacgctgttcagcatgctgcttcttcttcttcttcttcttcttcttcttcttcttcttcttcttcttcttcttcttcttcttcttttttgagtcttgcaaccttctggtgagctgtctgtgtggctcttcttgggttgtggggctctgtgttctgatttttttctgtggaccaagaatctgcaat

SEQ ID NO: 26724 - DNA, 294 bp, Homo sapiens
  AC064829.5_65074
  Located on chromosome Y
  Distance between a terminus base of telomere on chromosomal short arm and 5'-terminus of this base sequence : 8431715
  Distance between 3'-terminus of neighbour sequence of sequence listing upward to telomere on chrosomal short arm and 5'-terminus of this base sequence : 39594
tctatagttaattgtgtgctgagacccactggcattcaaatcctctcccactgcaaaaaataaataaataaataaataaataaataaataaataaataaataaaataaaaagcctttcgtctacaaagaaagggagcactcttctccaaaaaacagacatctccatcatttcattttcgtgtggtcaacccaggaagagacactggctgtcctgtccgcagggcccttgaatgtatctgtaattcagttcccaaccaatcaggtgcttcacatcatgagggagaactcttccat

SEQ ID NO: 26725 - DNA, 480 bp, Homo sapiens
  chrY.fa.O7frz.6062759
  Located on chromosome Y
  Distance between a terminus base of telomere on chromosomal short arm and 5'-terminus of this base sequence : 8587576
  Distance between 3'-terminus of neighbour sequence of sequence listing upward to telomere on chrosomal short arm and 5'-terminus of this base sequence : 155567
ataatttagatgctggcagatcttggccagcctctgaattcatggcagattcacaatttacagaaaattaaagaacacgaagccccactgctgaagcagagcttcacagagaggccactgaaatgctggggaactaaaaaataataataataatcattaaagtgcattagccaaattcctttaacctgactgcacttatggacacacacacacacacacacacacaaacacaatgccacacacaaaagcagatatccaacactcacaacactcccagacaaacacacagtccagctgcttctgaggctgcttgtttctgcaggatgccccatttgggagagagaaaccccagggaatggggagcacaggcaggcttgttcctaaaaatctcagagggacaaatttcaaaaaggctcacccttaaaatgtctatgtgcttgctcatgtctgtcctctcataggatcacgagactatcacat

SEQ ID NO: 26726 - DNA, 107 bp, Homo sapiens
  DID22N_0036603
  Located on chromosome Y
  Distance between a terminus base of telomere on chromosomal short arm and 5'-terminus of this base sequence : 8599933
  Distance between 3'-terminus of neighbour sequence of sequence listing upward to telomere on chrosomal short arm and 5'-terminus of this base sequence : 11877
ttcctgtaagcagactccacttacatacacacacacacacacacacacacacacacacacacacacacacaaaatgttgaacacccatgcagccatccaacattcac

SEQ ID NO: 26727 - DNA, 432 bp, Homo sapiens
  chrY.fa.O7frz.6698868
  Located on chromosome Y
  Distance between a terminus base of telomere on chromosomal short arm and 5'-terminus of this base sequence : 9035356
  Distance between 3'-terminus of neighbour sequence of sequence listing upward to telomere on chrosomal short arm and 5'-terminus of this base sequence : 435316
aaggaatacaatctgaaatttcttattttcttttaaataaacttcagtattccttaaaagtgtcagccaggagcagcagctcaggcttgtaatcccagcattttgggaggctgaggtgcatggatcaccagagatcaggaattcgataccagccttgccaacatgacgaaacctcgtctctactaaaaatacaaaaattagccaggcaggatggcaggcacctgtaatcccagctactcgggaggctgaggcagggaaattgcttgaaccttggagacagaggttgcagtgagctgaggtggtgccactgaactccagcctgagtgacagagcaagataccatctcaataataataataataataataataataatataaaataaaaatgtctagttttcacattttgtttatcgctacaatttaagaactt

SEQ ID NO: 26728 - DNA, 126 bp, Homo sapiens
  DID22N_0036632
  Located on chromosome Y
  Distance between a terminus base of telomere on chromosomal short arm and 5'-terminus of this base sequence : 9102166
  Distance between 3'-terminus of neighbour sequence of sequence listing upward to telomere on chrosomal short arm and 5'-terminus of this base sequence : 66378
gctgaaagtcaagtacatgagtgtttttgtgttgaggttttgaagacaaatgtagagagatattaagaaccaaagacattttatatatatatatatatatatatgctaaagcttcatccttgtagg

SEQ ID NO: 26729 - DNA, 242 bp, Homo sapiens
  DID22N_0036664
  Located on chromosome Y
  Distance between a terminus base of telomere on chromosomal short arm and 5'-terminus of this base sequence : 9276489
  Distance between 3'-terminus of neighbour sequence of sequence listing upward to telomere on chrosomal short arm and 5'-terminus of this base sequence : 174197
tgcatgttctcctcatgtgggggaaaagcagcatcagcaggcagaggaatcctttgaagctggagggagaggttgcagtgatctgagagtttgccacttgactgcagcctggatgacacagtgagactccaactgaaaagaaacaaacacacacacacacacacacacacacacacacacccccaaaattgataagtaaaaaaaaaatccatattcgaaaacatgctcacaggctatctccc

SEQ ID NO: 26730 - DNA, 124 bp, Homo sapiens
  DID22N_0036670
  Located on chromosome Y
  Distance between a terminus base of telomere on chromosomal short arm and 5'-terminus of this base sequence : 9335672
  Distance between 3'-terminus of neighbour sequence of sequence listing upward to telomere on chrosomal short arm and 5'-terminus of this base sequence : 58941
agcaatttacaatcagtgaagagaatacttttctcaggctccaatattattattattattattattattattattattattattatcattattattattttaaacatatactgctgggcagaac

SEQ ID NO: 26731 - DNA, 119 bp, Homo sapiens
  DISO7_10000046
  Located on chromosome Y
  Distance between a terminus base of telomere on chromosomal short arm and 5'-terminus of this base sequence : 9556446
  Distance between 3'-terminus of neighbour sequence of sequence listing upward to telomere on chrosomal short arm and 5'-terminus of this base sequence : 220650
cagcaggtggaattctgagtttgtgtgtgtgtgtgtgtgtgtgtgtgtgtgtgtgtgtgtgtgtgtatgtgtgttcccgtaagtggagtctccttaaaagaatgtggctaatgcacttc

SEQ ID NO: 26732 - DNA, 185 bp, Homo sapiens
  DISO7_10000047
  Located on chromosome Y
  Distance between a terminus base of telomere on chromosomal short arm and 5'-terminus of this base sequence : 9819501
  Distance between 3'-terminus of neighbour sequence of sequence listing upward to telomere on chrosomal short arm and 5'-terminus of this base sequence : 262936
atccgggatgaacatacccacacacacagatacacagacacacacacacacacacacacacacacacagagtcacacatccttaatagtgtttatttttcattccataaaatccaagtttaacccctcttcctgtctgcgtttttttgtgcctggatctgtttttcctttaggtcgtgtgcataa

SEQ ID NO: 26733 - DNA, 101 bp, Homo sapiens
  DID22N_0036709
  Located on chromosome Y
  Distance between a terminus base of telomere on chromosomal short arm and 5'-terminus of this base sequence : 9932608
  Distance between 3'-terminus of neighbour sequence of sequence listing upward to telomere on chrosomal short arm and 5'-terminus of this base sequence : 112922
ccacttccaggtcctcacggtgggattggtctctctctctcacacacacacacacacacacacacacacacaggcaatttccacatctagttcacaaacca

SEQ ID NO: 26734 - DNA, 194 bp, Homo sapiens
  chr5.fa.O7frz.73599940
  Located on chromosome Y
  Distance between a terminus base of telomere on chromosomal short arm and 5'-terminus of this base sequence : 13136979
  Distance between 3'-terminus of neighbour sequence of sequence listing upward to telomere on chrosomal short arm and 5'-terminus of this base sequence : 3204270
ggaatggaatggaatcgaatggaataaaatcgaaggcaatggcatcaaatggatggaatggaatagaatggaacggacttcaatggaatagaatcgaatggaagggcatcaaatggaatggattggaattgaaaggaatgtaatggaatggacccaaatgtaatggactcgaatagaatggattcaaatagaat

SEQ ID NO: 26735 - DNA, 322 bp, Homo sapiens
  chrY.fa.O7frz.7843108
  Located on chromosome Y
  Distance between a terminus base of telomere on chromosomal short arm and 5'-terminus of this base sequence : 13170057
  Distance between 3'-terminus of neighbour sequence of sequence listing upward to telomere on chrosomal short arm and 5'-terminus of this base sequence : 32884
ctgatggaatagaattgaacagaatggcatccaaaggaatggaaaggaatggaatggagtggaatggaatggaatgacatggagtggaatggaatggaatggaatggaatggaatggaatggaatggaatggaatggaatggacacaaaattaatggaatagaatggaatggactcgaaaggaatggtctcgaatggaatttattcagaaagaatggaatagaaagcaatgcaatactatggaatggaatcgaatggaatggaccagaatgaaatggacaggaatagaacagattcgaatgtaatggattgcaatgtaattg

SEQ ID NO: 26736 - DNA, 245 bp, Homo sapiens
  "DXYS230X,DXYS230Y"
  Located on chromosome Y
  Distance between a terminus base of telomere on chromosomal short arm and 5'-terminus of this base sequence : 13309382
  Distance between 3'-terminus of neighbour sequence of sequence listing upward to telomere on chrosomal short arm and 5'-terminus of this base sequence : 139003
cactaacttgagaggtcctttgtatcccaatggacatttggatctctctgtgtgtgtgtatgtgtttgtgtatgggtgtgggtgggtagatgttatgtcttgagttctagggagcaaagatgataacatggatggtgaaggaacttattatgggctgaattctgtccctagaaattcatatgctgaagtcgtaattcctcgtgccatggaagatagttgtatctggggattgggtctttcacgag

SEQ ID NO: 26737 - DNA, 181 bp, Homo sapiens
  DID22N_0036714
  Located on chromosome Y
  Distance between a terminus base of telomere on chromosomal short arm and 5'-terminus of this base sequence : 13390740
  Distance between 3'-terminus of neighbour sequence of sequence listing upward to telomere on chrosomal short arm and 5'-terminus of this base sequence : 81113
atcagccagtccttggtggagccttctaaaaagtgtggggctgatgcagatatatatatatatatatatatatatatatatatatatatatatatatatatatatatggcggtgcttcctgcacagcaggtttgggtgtttgtgttgtgtgttgggaagggggataccaggctggaaatga

SEQ ID NO: 26738 - DNA, 114 bp, Homo sapiens
  DYS434
  Located on chromosome Y
  Distance between a terminus base of telomere on chromosomal short arm and 5'-terminus of this base sequence : 13777239
  Distance between 3'-terminus of neighbour sequence of sequence listing upward to telomere on chrosomal short arm and 5'-terminus of this base sequence : 386318
cactccctgagtgctggattataggcgtgactgcatatcagtcactctaattaatctatctatctatctatctatctatctatctatctataatccatccattcattcatctcc

SEQ ID NO: 26739 - DNA, 192 bp, Homo sapiens
  DYS437
  Located on chromosome Y
  Distance between a terminus base of telomere on chromosomal short arm and 5'-terminus of this base sequence : 13777725
  Distance between 3'-terminus of neighbour sequence of sequence listing upward to telomere on chrosomal short arm and 5'-terminus of this base sequence : 372
gactatgggcgtgagtgcatgcccatccggtctatctatctatctatctatctatctatctatctatctatctgtctgtctatctatctatctatcatctatcatctgtgaatgatgtctatctacttatctatgaatgatatttatctgtggttatctatctatctatatcatctgtgaatgacagggtct

SEQ ID NO: 26740 - DNA, 210 bp, Homo sapiens
  DYS435
  Located on chromosome Y
  Distance between a terminus base of telomere on chromosomal short arm and 5'-terminus of this base sequence : 13806959
  Distance between 3'-terminus of neighbour sequence of sequence listing upward to telomere on chrosomal short arm and 5'-terminus of this base sequence : 29042
agcatctccacacagcacactggcaactgaaggacagtaagtacacactgtccacagccagggttgtccagagaaacagccaataagatgtgtggatgtgtggatggatggatggatggatggatggatggatggacagacagctatagaaatacagatagataaaccaatgagtagattatagatagacgagaggagggggagagagaa

SEQ ID NO: 26741 - DNA, 252 bp, Homo sapiens
  DYS439
  Located on chromosome Y
  Distance between a terminus base of telomere on chromosomal short arm and 5'-terminus of this base sequence : 13825920
  Distance between 3'-terminus of neighbour sequence of sequence listing upward to telomere on chrosomal short arm and 5'-terminus of this base sequence : 18751
tcctgaatggtacttcctaggttttcttctcgagttgttatggttttaggtctaacatttaagtctttaatctatcttgaattaatagattcaaggtgatagatatacagatagatagatacataggtggagacagatagatgataaatagaagatagatagatagatagatagatagatagatagatagatagatagatagatagaaagtataagtaaagagatgatgggtaaaagaattccaagccaggc

SEQ ID NO: 26742 - DNA, 247 bp, Homo sapiens
  DYS389
  Located on chromosome Y
  Distance between a terminus base of telomere on chromosomal short arm and 5'-terminus of this base sequence : 13922832
  Distance between 3'-terminus of neighbour sequence of sequence listing upward to telomere on chrosomal short arm and 5'-terminus of this base sequence : 96660
tcttatctccacccaccagatgcgagaacacccatcccagtgcaactgccaaaattgtttccagacattgccaagtgttacttgaggaacacaattatccctgagtagcagaagaatgtcatagatagatgatggactgctagataaatagatagattgatagagggagggatagatagatagatagatagatagatagatagatagacagacagacagatacatagataatacagatgagagttgg

SEQ ID NO: 26743 - DNA, 127 bp, Homo sapiens
  DYS388
  Located on chromosome Y
  Distance between a terminus base of telomere on chromosomal short arm and 5'-terminus of this base sequence : 14057630
  Distance between 3'-terminus of neighbour sequence of sequence listing upward to telomere on chrosomal short arm and 5'-terminus of this base sequence : 134551
ccagatcgcaccactgcgctccagcctgggcgacagagcgagagtccgtctcaaataataataataataataataataataataataatgtttcataatatgtatatatcgctaaacggctaactca

SEQ ID NO: 26744 - DNA, 216 bp, Homo sapiens
  DISO7_10000281
  Located on chromosome Y
  Distance between a terminus base of telomere on chromosomal short arm and 5'-terminus of this base sequence : 14220036
  Distance between 3'-terminus of neighbour sequence of sequence listing upward to telomere on chrosomal short arm and 5'-terminus of this base sequence : 162279
ggtattgtgttggtctctactttccccttccctccttcccttcctttctccttccctttttcttcccttttgcttcccttctccttcccttccccttcccttcccctttcccttccctcccccttcccctccctctctccctccctccttccttccttccgtccttccttctttcgaaaaaatatttgtctagctttgttaggtgaatagtattgg

SEQ ID NO: 26745 - DNA, 119 bp, Homo sapiens
  DISO7_10000278
  Located on chromosome Y
  Distance between a terminus base of telomere on chromosomal short arm and 5'-terminus of this base sequence : 14573888
  Distance between 3'-terminus of neighbour sequence of sequence listing upward to telomere on chrosomal short arm and 5'-terminus of this base sequence : 353636
actggcccatgacttctcctgtgtgggtgggtgtgtgtgtgtgtgtgtgtgtgtgtgtgtgtgtgtgtgtgtgtgtgtgacgggagaggggttgaaggggagtgcagtatgtatcctaa

SEQ ID NO: 26746 - DNA, 414 bp, Homo sapiens
  chr3.fa.O7frz.68705650
  Located on chromosome Y
  Distance between a terminus base of telomere on chromosomal short arm and 5'-terminus of this base sequence : 14623684
  Distance between 3'-terminus of neighbour sequence of sequence listing upward to telomere on chrosomal short arm and 5'-terminus of this base sequence : 49677
gaatgttccatgtgagtatgagaagaatgtggctgacagcagtggctcacacctgtaatcttagcactttgggaggatgaagtgggcagactgctttagcctaggagtttgagattagcctgagcaacaagaggagaccctgcctgcacaaaaaattaaaaattagccatgtgtgctgcatgcctgtagtcccagctacttgggaggctgaagcgggaggatcactataatcctggaattcaggactgatctcattactgcactccagcctaggcaacacagcgagagcctatccccgccccatgcaaaataataataataataataataataataataataataataataataatagagagagagagagagagagaggaatgtatattctggtaaactgttctgtgtaagtta

SEQ ID NO: 26747 - DNA, 101 bp, Homo sapiens
  DID22N_0036739
  Located on chromosome Y
  Distance between a terminus base of telomere on chromosomal short arm and 5'-terminus of this base sequence : 14866980
  Distance between 3'-terminus of neighbour sequence of sequence listing upward to telomere on chrosomal short arm and 5'-terminus of this base sequence : 242882
tgcaagcctttagagaaggaaactaggaagcaaaagagacacacacacacacacacacacacacacacacacacatcttacaggctcctttggagaagcta

SEQ ID NO: 26748 - DNA, 193 bp, Homo sapiens
  DID22N_0036740
  Located on chromosome Y
  Distance between a terminus base of telomere on chromosomal short arm and 5'-terminus of this base sequence : 15070760
  Distance between 3'-terminus of neighbour sequence of sequence listing upward to telomere on chrosomal short arm and 5'-terminus of this base sequence : 203679
cacaggttcagaggtttgcctcctcctcctcctctttcttcttcttctccttcttcttcttcttcttcttcttcttcttcttcttcttcttcttcttcttcttcttcttcttcttcttcttcttctgtcacttttccaaattattttcttttgccttccctcagttccctttttggctctagatacccatggc

SEQ ID NO: 26749 - DNA, 195 bp, Homo sapiens
  DID22N_0036758
  Located on chromosome Y
  Distance between a terminus base of telomere on chromosomal short arm and 5'-terminus of this base sequence : 15560717
  Distance between 3'-terminus of neighbour sequence of sequence listing upward to telomere on chrosomal short arm and 5'-terminus of this base sequence : 489764
ggcagatacacataagggtgtataaagaggggcatacatagatctatctatctgtctatctatctatctatctgtctatctatttttctatctatctatctatctatctatctatctatctatctatctttaaaaatatgcatatccctaaaaacttaattaataatatatagatggcgtgataacctttacctg

SEQ ID NO: 26750 - DNA, 202 bp, Homo sapiens
  DID22N_0036768
  Located on chromosome Y
  Distance between a terminus base of telomere on chromosomal short arm and 5'-terminus of this base sequence : 15832451
  Distance between 3'-terminus of neighbour sequence of sequence listing upward to telomere on chrosomal short arm and 5'-terminus of this base sequence : 271539
gtaagaccagggaatcttgctaaatgtgtgtgtgtgtgtgtgtgtgtgtgtgtgtgtgtgtagctatctatctatatttatacacacggacacacatatctttgagatatttatgtatcttcaggaaatagtgactttcctgaagatatgtaaattgcttatatatattttttaccctttgataaatgcctattgctccttc

SEQ ID NO: 26751 - DNA, 115 bp, Homo sapiens
  DID22N_0036776
  Located on chromosome Y
  Distance between a terminus base of telomere on chromosomal short arm and 5'-terminus of this base sequence : 16028868
  Distance between 3'-terminus of neighbour sequence of sequence listing upward to telomere on chrosomal short arm and 5'-terminus of this base sequence : 196215
agtgatggagacattgatggttctattagtcagggttctctggagggacagaactaataggagatgtatatatatatatatatatatatatatatcgctaacccttaccataaca

SEQ ID NO: 26752 - DNA, 193 bp, Homo sapiens
  DID22N_0036793
  Located on chromosome Y
  Distance between a terminus base of telomere on chromosomal short arm and 5'-terminus of this base sequence : 16363682
  Distance between 3'-terminus of neighbour sequence of sequence listing upward to telomere on chrosomal short arm and 5'-terminus of this base sequence : 334699
ctggattatattgacatttgagtgtgggtgatataaattatcagtgttaaccaggaattttaagaaaatgtattgataattaggagtcacacacaggcccccccaacacacacacacacacacacacacacacacacacacacacacacacacaccatttactctatagccccattgtggaagaacttacatc

SEQ ID NO: 26753 - DNA, 110 bp, Homo sapiens
  DID22N_0036796
  Located on chromosome Y
  Distance between a terminus base of telomere on chromosomal short arm and 5'-terminus of this base sequence : 16434819
  Distance between 3'-terminus of neighbour sequence of sequence listing upward to telomere on chrosomal short arm and 5'-terminus of this base sequence : 70944
ttctattactgtgcatagagaccccttaaaacacacacacacacacacacacacacacacacacacacacacacacgtcccagtttcaaaggcatgtgacccacagcaac

SEQ ID NO: 26754 - DNA, 215 bp, Homo sapiens
  DYS390
  Located on chromosome Y
  Distance between a terminus base of telomere on chromosomal short arm and 5'-terminus of this base sequence : 16529580
  Distance between 3'-terminus of neighbour sequence of sequence listing upward to telomere on chrosomal short arm and 5'-terminus of this base sequence : 94651
tgacagtaaaatgaaaacattgcaatgtgtatactcagaaacaaggaaagatagatagatgatagatagatagatagacagatagatagatagatagatagatagatagatagatagatagatagacagacagacagacagacagacagacagacagatagatagaatatattatggggtaccaaaatgcagggcccaaaaatgtgtaaaatata

SEQ ID NO: 26755 - DNA, 147 bp, Homo sapiens
  DISO7_10000400
  Located on chromosome Y
  Distance between a terminus base of telomere on chromosomal short arm and 5'-terminus of this base sequence : 16851467
  Distance between 3'-terminus of neighbour sequence of sequence listing upward to telomere on chrosomal short arm and 5'-terminus of this base sequence : 321672
tcaagtctaaacctatgtcttgctttattgctttggcaatctctctctctctctctctctttctctctctctctccccctccctccctccctctctctctttctctctctgtctcttcctctggaatatctaatagctaagattggg

SEQ ID NO: 26756 - DNA, 109 bp, Homo sapiens
  DISO7_10000402
  Located on chromosome Y
  Distance between a terminus base of telomere on chromosomal short arm and 5'-terminus of this base sequence : 17060163
  Distance between 3'-terminus of neighbour sequence of sequence listing upward to telomere on chrosomal short arm and 5'-terminus of this base sequence : 208549
gaacacagcttgacaagggttaatttgcaagaacaaaatgtacacagacctgcagagtgtgtgtgtgtgtgtgtgtgtttgtgtgtgtgtggtggagaggaacattggc

SEQ ID NO: 26757 - DNA, 406 bp, Homo sapiens
  chrY.fa.O7frz.14188531
  Located on chromosome Y
  Distance between a terminus base of telomere on chromosomal short arm and 5'-terminus of this base sequence : 17071969
  Distance between 3'-terminus of neighbour sequence of sequence listing upward to telomere on chrosomal short arm and 5'-terminus of this base sequence : 11697
tcagttatagatggcagatcatgagaattttcagcctcctcaatttcatgagccagtttcttaataattatctatctatctatctatctatctatctatctatctatctatcttcatcataatcattatctatctattatctatcatctatctattatctatctatttatctagctctctctatccagttggaaaagcaatctccaattggctctgtttctctgaagaaccctgactaataatttatactatccatgcaatggcctgtcaccagcatggaaaatctggaaaaaaatgcaagtaattatagacctacctgataaatgcacattctttagatttctcttagcaaagttgcttggacaattgacccaagccctctgtgtagtttacggcatactagcca

SEQ ID NO: 26758 - DNA, 142 bp, Homo sapiens
  DISO7_10000405
  Located on chromosome Y
  Distance between a terminus base of telomere on chromosomal short arm and 5'-terminus of this base sequence : 17166958
  Distance between 3'-terminus of neighbour sequence of sequence listing upward to telomere on chrosomal short arm and 5'-terminus of this base sequence : 94583
ggaagacctgactttgcccccaccaagggttttcagaaaaacaaatagtaattaataataataataataataataacaataataataatagcagataagataaaattgtgtgggaaacatcattctgataccctcaacatct

SEQ ID NO: 26759 - DNA, 124 bp, Homo sapiens
  DISO7_10000406
  Located on chromosome Y
  Distance between a terminus base of telomere on chromosomal short arm and 5'-terminus of this base sequence : 17250774
  Distance between 3'-terminus of neighbour sequence of sequence listing upward to telomere on chrosomal short arm and 5'-terminus of this base sequence : 83674
ctactagaagcctgcttccttacaaaagcaattatctggttaaatgcatacacacacacacacacacacacacacacacacacacacacgttatacaaattaatagggccctcagtaacctcaa

SEQ ID NO: 26760 - DNA, 178 bp, Homo sapiens
  DISO7_10000407
  Located on chromosome Y
  Distance between a terminus base of telomere on chromosomal short arm and 5'-terminus of this base sequence : 17304684
  Distance between 3'-terminus of neighbour sequence of sequence listing upward to telomere on chrosomal short arm and 5'-terminus of this base sequence : 53786
tctctgaggatgatgctaagtagaaaacagtttcaaacatggcatgattatttaaatagaatatatatatatatatatatatatatatatatatatatttatgtttctagactctgagactagtatacaccttctcttggatatattggtttccaaatgctgacagttaggtggtgag

SEQ ID NO: 26761 - DNA, 438 bp, Homo sapiens
  chrY.fa.O7frz.14438533
  Located on chromosome Y
  Distance between a terminus base of telomere on chromosomal short arm and 5'-terminus of this base sequence : 17321784
  Distance between 3'-terminus of neighbour sequence of sequence listing upward to telomere on chrosomal short arm and 5'-terminus of this base sequence : 16922
cttctgagtaaagtgagaatgaagataagatagacttgaaacaggatatttcgagaaaattgaaatgcaaaagtgaatcctttcctttgacttatttataatagaaaacaaaataaagagaatcttagaaatcttgaatattcacatttagtttaagtaaataataaaatattttccagaaacttgtaaataacatagaaacataacatagcattttctctctgtctttctctctctgtatccctgtctctctgtttctctctgtatttctatctctctttctctaacacacacctgtccatttaatataggtagaaagaaagaaagaaagaaagaaagaaagaaagaaagaaagaaagaaagaaagaaagaaaggaaggaaggaagaaagaaaggttgagtggggtatttacaatgtggtacatttgattttgactg

SEQ ID NO: 26762 - DNA, 116 bp, Homo sapiens
  DISO7_10000408
  Located on chromosome Y
  Distance between a terminus base of telomere on chromosomal short arm and 5'-terminus of this base sequence : 17350397
  Distance between 3'-terminus of neighbour sequence of sequence listing upward to telomere on chrosomal short arm and 5'-terminus of this base sequence : 28175
tgaacatatgtgccagttactaaactatatatatacatatatatatagtatatataatatatatatatatagcgacctctctggtttggttttatgcttattgctatctccatggt

SEQ ID NO: 26763 - DNA, 403 bp, Homo sapiens
  chrY.fa.O7frz.14763928
  Located on chromosome Y
  Distance between a terminus base of telomere on chromosomal short arm and 5'-terminus of this base sequence : 17647165
  Distance between 3'-terminus of neighbour sequence of sequence listing upward to telomere on chrosomal short arm and 5'-terminus of this base sequence : 296652
cttactgtccattcagtactgaacactgtacgtggactttttcacaactgggtggtaatgagtctgattatctatccatttcataatgtggtcatttaagaactggaaataaaaaagtaaacaaataaacttggctgcctgaaaaaatagtttagcctatgtgtatccttttttaaaagtgattcatgggaaatcataatgcacagttactattctcaacaaatttatgtttctcaaacccctactcattcaaaacatactttaggggaatttttttttctttctgaaaactagctgagttttttatggattgtgttctattatcagtatctatctatctatctgtctatctatctatctatctatctatctatctattgtctatcattgtctaccattcact

SEQ ID NO: 26764 - DNA, 193 bp, Homo sapiens
  AC053516.9_105613
  Located on chromosome Y
  Distance between a terminus base of telomere on chromosomal short arm and 5'-terminus of this base sequence : 17669001
  Distance between 3'-terminus of neighbour sequence of sequence listing upward to telomere on chrosomal short arm and 5'-terminus of this base sequence : 21433
agcatacagcgtaatcacagctcactgcagcattgacatcttgggctcaagtaatcctttcacctcaacctcctgagaaggaaggaaggaaggaaggaaggaaggaaggaaggaaggaaggaaggaaggaaggaaggaaagaaggaaagaaggatggaaggaaggaaatgcccctcaactgggctttgtctga

SEQ ID NO: 26765 - DNA, 255 bp, Homo sapiens
  DISO7_10000414
  Located on chromosome Y
  Distance between a terminus base of telomere on chromosomal short arm and 5'-terminus of this base sequence : 17811208
  Distance between 3'-terminus of neighbour sequence of sequence listing upward to telomere on chrosomal short arm and 5'-terminus of this base sequence : 142014
gatttgtatgtatatccttgtcctgtatttttgcatgtgtgctctgtgtgtgtgtgtgtgtgtgtgtgtgtgtgtatgtacatgttccatacatttttctatcatatatatcctcatacatatgtatattcctgtcatatttacgttctttctttacttatgcgtctttttctttttaaaatataaacttcagtcatatttattttaaaaattttatttacattgttttatatcttcacttcctcttgtgtcatt

SEQ ID NO: 26766 - DNA, 119 bp, Homo sapiens
  DISO7_10000415
  Located on chromosome Y
  Distance between a terminus base of telomere on chromosomal short arm and 5'-terminus of this base sequence : 17848211
  Distance between 3'-terminus of neighbour sequence of sequence listing upward to telomere on chrosomal short arm and 5'-terminus of this base sequence : 36748
tttgatgactgtcttcattgcataaaacattattgaatgctctatatatattcaagattatatatgtgtgtgtgtgtgtgtgtgtgtgtgtgtatttagtgaaactccatgcaagtatg

SEQ ID NO: 26767 - DNA, 170 bp, Homo sapiens
  DISO7_10000416
  Located on chromosome Y
  Distance between a terminus base of telomere on chromosomal short arm and 5'-terminus of this base sequence : 17852624
  Distance between 3'-terminus of neighbour sequence of sequence listing upward to telomere on chrosomal short arm and 5'-terminus of this base sequence : 4294
ggcttctattatctttctatcatcctacttatatctatctgtcatctattatctaccatctgtctttctatcatcctatctctctctctctctatgcatccatcatgcatctatctatgtatctattatctatctacctaatctttaacccacttcacttgtaatggctt

SEQ ID NO: 26768 - DNA, 217 bp, Homo sapiens
  DISO7_10000418
  Located on chromosome Y
  Distance between a terminus base of telomere on chromosomal short arm and 5'-terminus of this base sequence : 17867408
  Distance between 3'-terminus of neighbour sequence of sequence listing upward to telomere on chrosomal short arm and 5'-terminus of this base sequence : 14614
gaactattccatgataccatatgcatatatatgtgtatgtgtgtgtgtatatatatatatatatatatatatatatatgtgtgtgtgtgtatatatatatgtatacgtagttttttgatgtaagtgatggcttttgtttcattacattatcatatgaaaatgcaagtgattataaatatggactataatttagtagagggggcactatgaggaagga

SEQ ID NO: 26769 - DNA, 116 bp, Homo sapiens
  DISO7_10000420
  Located on chromosome Y
  Distance between a terminus base of telomere on chromosomal short arm and 5'-terminus of this base sequence : 17898031
  Distance between 3'-terminus of neighbour sequence of sequence listing upward to telomere on chrosomal short arm and 5'-terminus of this base sequence : 30406
gaattaatccttcccttcctctctcagcctctctcgatcttacacacacaaacctggacacacacacacacacacacacacacacacacttcatgacagttctgattatctagctg

SEQ ID NO: 26770 - DNA, 116 bp, Homo sapiens
  DISO7_10000422
  Located on chromosome Y
  Distance between a terminus base of telomere on chromosomal short arm and 5'-terminus of this base sequence : 17940293
  Distance between 3'-terminus of neighbour sequence of sequence listing upward to telomere on chrosomal short arm and 5'-terminus of this base sequence : 42146
ctcatcataggttcctggggaggtgttctctgtgtgtgtgtgtgtgtgtgtgtgtgtgtgtgtgtttaacttaacaattttgcattatcaagtgtggctggctcacaagacactac

SEQ ID NO: 26771 - DNA, 197 bp, Homo sapiens
  DISO7_10000424
  Located on chromosome Y
  Distance between a terminus base of telomere on chromosomal short arm and 5'-terminus of this base sequence : 17998166
  Distance between 3'-terminus of neighbour sequence of sequence listing upward to telomere on chrosomal short arm and 5'-terminus of this base sequence : 57757
ccacttgttaaacaacttaacaggataaatcacctatctatgtatctatctatctatctattcatccatctaatctatccattctatctatctatctatctatctatctatctatctatctatctatctacctacctacctatctatctatagatctatctatctatcttaaatttggaaattctcctcagcataac

SEQ ID NO: 26772 - DNA, 246 bp, Homo sapiens
  DISO7_10000425
  Located on chromosome Y
  Distance between a terminus base of telomere on chromosomal short arm and 5'-terminus of this base sequence : 18014815
  Distance between 3'-terminus of neighbour sequence of sequence listing upward to telomere on chrosomal short arm and 5'-terminus of this base sequence : 16452
agagcttacaacagagggttaagtaaaaatttaagattgcaaaactgacagttaaaaaatgatcttagtgtgcttttaaataatttctcttttaattgattattagtgtacttttaattaatttctctctctctctctctctctctctctctctctctctctctctctctctctctctattagtcttttggagattagtcctttgcaaagtgattggtaaacattttccaagatgattggtttggt

SEQ ID NO: 26773 - DNA, 189 bp, Homo sapiens
  DISO7_10000427
  Located on chromosome Y
  Distance between a terminus base of telomere on chromosomal short arm and 5'-terminus of this base sequence : 18059103
  Distance between 3'-terminus of neighbour sequence of sequence listing upward to telomere on chrosomal short arm and 5'-terminus of this base sequence : 44042
cctccataacagagggtcccagttgtggcattattgagagagagaaagagagacagaggagagagaaagagagagagagagagagagagagagagagagagagagagagagagagagagccatcttatctgggactttctcacatcttatgtgggactttctgaaaccaaagagctttcttggttgcct

SEQ ID NO: 26774 - DNA, 101 bp, Homo sapiens
  DID22N_0036845
  Located on chromosome Y
  Distance between a terminus base of telomere on chromosomal short arm and 5'-terminus of this base sequence : 18588515
  Distance between 3'-terminus of neighbour sequence of sequence listing upward to telomere on chrosomal short arm and 5'-terminus of this base sequence : 529223
acgcagttcctgacatctagtaagcattcagtgaatgcttcctacaatcagttattcaatcaatcagtcaatcaatgcttgaatagataacaggcttcaat

SEQ ID NO: 26775 - DNA, 101 bp, Homo sapiens
  DID22N_0036851
  Located on chromosome Y
  Distance between a terminus base of telomere on chromosomal short arm and 5'-terminus of this base sequence : 18750478
  Distance between 3'-terminus of neighbour sequence of sequence listing upward to telomere on chrosomal short arm and 5'-terminus of this base sequence : 161862
ccaagtgttaactgtggctccactatttttgggtggacacacacacacacgcacacacacacaatcatgatcctactcatcccacatctctgtctccagaa

SEQ ID NO: 26776 - DNA, 114 bp, Homo sapiens
  DID22N_0036852
  Located on chromosome Y
  Distance between a terminus base of telomere on chromosomal short arm and 5'-terminus of this base sequence : 18821171
  Distance between 3'-terminus of neighbour sequence of sequence listing upward to telomere on chrosomal short arm and 5'-terminus of this base sequence : 70592
tggagaggttagattatattcaagggaaaaaacttaagacaaaacaattcaaatgttcactcttgtgtgtacacacacatacacacacacacccctttacagagatggtccaag

SEQ ID NO: 26777 - DNA, 193 bp, Homo sapiens
  DID22N_0036902
  Located on chromosome Y
  Distance between a terminus base of telomere on chromosomal short arm and 5'-terminus of this base sequence : 20029142
  Distance between 3'-terminus of neighbour sequence of sequence listing upward to telomere on chrosomal short arm and 5'-terminus of this base sequence : 1207857
aaggcagagacctacaatgagctgaagtgtggtgtgtgtgtgtgtgtgtgtgtatatatatatccatatatacccatatgtgtatatatatccatattatccatatatatatcgatatatatgcatatatatccatatctatctatctatatatatatatgtaaaaaagaggcttcttaggctatgataggga

SEQ ID NO: 26778 - DNA, 103 bp, Homo sapiens
  DID22N_0036920
  Located on chromosome Y
  Distance between a terminus base of telomere on chromosomal short arm and 5'-terminus of this base sequence : 20322812
  Distance between 3'-terminus of neighbour sequence of sequence listing upward to telomere on chrosomal short arm and 5'-terminus of this base sequence : 293477
tcaggagatggtaaatcaaggggtcatgttacctgtacacacacacacacacacacacacacacacacacacacacacacagaaacctagacagaccttgaca

SEQ ID NO: 26779 - DNA, 436 bp, Homo sapiens
  chrY.fa.O7frz.18232012
  Located on chromosome Y
  Distance between a terminus base of telomere on chromosomal short arm and 5'-terminus of this base sequence : 20724629
  Distance between 3'-terminus of neighbour sequence of sequence listing upward to telomere on chrosomal short arm and 5'-terminus of this base sequence : 401714
ttgtcctagccagtacacataccaatgaaccccaccacaagccatttttgaaacagaaattaacaaataacagtacacttcagagaactagaaaagaaaagtgtaagccaaacccaaatatagcagaagaaaagaaataaccaaattcagggatgtactgaatgacattaagatgtaaagaactataaaaagattaatacaacaaaaatttggtaatctgaaataataaggtagacatagcaattaggtaggtaaagaggaagatgatagatgattagaaagatgatagatagatagatagatagatagatagatagatagatagatagatagatagaaaaaatctacataaacaaaatcacaaatggaaaaggggacattaccacttatgccaccaaaaaaaacctttagagactattctgaacacctctatgca

SEQ ID NO: 26780 - DNA, 154 bp, Homo sapiens
  DISO7_10000436
  Located on chromosome Y
  Distance between a terminus base of telomere on chromosomal short arm and 5'-terminus of this base sequence : 20962823
  Distance between 3'-terminus of neighbour sequence of sequence listing upward to telomere on chrosomal short arm and 5'-terminus of this base sequence : 237758
ctctggatgtgggatatgcgagtgtgtgtgtgtgtgtgtgtgtgtgtgtattaagctttctgtttctgatgaaattttcatatgaaatttactggagataagattaaattagtggaaaaacaagataattttgctttctatgtagtggtcacca

SEQ ID NO: 26781 - DNA, 212 bp, Homo sapiens
  DISO7_10000437
  Located on chromosome Y
  Distance between a terminus base of telomere on chromosomal short arm and 5'-terminus of this base sequence : 20971127
  Distance between 3'-terminus of neighbour sequence of sequence listing upward to telomere on chrosomal short arm and 5'-terminus of this base sequence : 8150
catggcatatttgattcagatcagttttttgacaatatttgtatgactttccaaattgatgtgactgtaaactttgaattcctcaaaattgacagaatatatatatatatatatatatatatatatatatatatgtatgtacacacacacagagagatcatttaaatgtaaatgatgttaagaaaaaccaaaacagtagcatatgcaggcaa

SEQ ID NO: 26782 - DNA, 220 bp, Homo sapiens
  DID22N_0036936
  Located on chromosome Y
  Distance between a terminus base of telomere on chromosomal short arm and 5'-terminus of this base sequence : 21134115
  Distance between 3'-terminus of neighbour sequence of sequence listing upward to telomere on chrosomal short arm and 5'-terminus of this base sequence : 162776
ccacaataacagaaagtgctgtaatattgtaataatatatatatatatagtattgtaataaaatatatatataaaaatataacgtatatgtaataaaatatatattgtagatgtataattacatgttatatattaaagtatacatatacattatatgtgtgtgtgtgtgtgtgtgtatatatatatatatatatatatatccttgtcccagacacgtgtt

SEQ ID NO: 26783 - DNA, 136 bp, Homo sapiens
  DID22N_0036938
  Located on chromosome Y
  Distance between a terminus base of telomere on chromosomal short arm and 5'-terminus of this base sequence : 21297785
  Distance between 3'-terminus of neighbour sequence of sequence listing upward to telomere on chrosomal short arm and 5'-terminus of this base sequence : 163450
tcatacctgggaatatgtaattgataaaatactgaaataaactgtattaacctttctctagattttctgtttgtgtgtgtgtgtgtgtgtgtgtgtgtgtgtgtgtgtgtgtgtgcatatgtctgcatctgtttcc

SEQ ID NO: 26784 - DNA, 254 bp, Homo sapiens
  DYS392
  Located on chromosome Y
  Distance between a terminus base of telomere on chromosomal short arm and 5'-terminus of this base sequence : 21788447
  Distance between 3'-terminus of neighbour sequence of sequence listing upward to telomere on chrosomal short arm and 5'-terminus of this base sequence : 490526
agacccagttgatgcaatgtaaattcctacagtcaaagtggaaagtagtctggaaatatctcaaagaagtcaaaacagagggatcattaaacctaccaatcccattccttagtaaataataataataataataataataataataataataataaataaatggtgatacaagaaaaaaatttgttttccttcttggcttttaaataacaaacacttgaaatcaaattagttgtttttaaaagctagattaatga

SEQ ID NO: 26785 - DNA, 136 bp, Homo sapiens
  DISO7_10000443
  Located on chromosome Y
  Distance between a terminus base of telomere on chromosomal short arm and 5'-terminus of this base sequence : 22039736
  Distance between 3'-terminus of neighbour sequence of sequence listing upward to telomere on chrosomal short arm and 5'-terminus of this base sequence : 251035
tccttgctagaaatgcataggaaacaaagtaactattcacagaaccaaataaaagccttccactaagaactaaaaatgtcatggttttatatatatatatatatatatgcacacccaagcaaagccagaggagaat

SEQ ID NO: 26786 - DNA, 151 bp, Homo sapiens
  DISO7_10000446
  Located on chromosome Y
  Distance between a terminus base of telomere on chromosomal short arm and 5'-terminus of this base sequence : 22218335
  Distance between 3'-terminus of neighbour sequence of sequence listing upward to telomere on chrosomal short arm and 5'-terminus of this base sequence : 178463
aattggatttaactgccagctgaacataaaactgtagaaattattaaaaaccttttatttatttatttatttatttatttatttatttatttattgagagttcatcttgacttttattacatactagacatatgaactaaccagaaatgtg

SEQ ID NO: 26787 - DNA, 137 bp, Homo sapiens
  DISO7_10000447
  Located on chromosome Y
  Distance between a terminus base of telomere on chromosomal short arm and 5'-terminus of this base sequence : 22429107
  Distance between 3'-terminus of neighbour sequence of sequence listing upward to telomere on chrosomal short arm and 5'-terminus of this base sequence : 210621
aatatggttgaggaacaaacagaaagttagagattttatttgaaagagagtgaggagagaggagaagagagagagagagagagagagagagaaaggagagaggagagatattacatattgttcaagaaagttcactg

SEQ ID NO: 26788 - DNA, 255 bp, Homo sapiens
  DISO7_10000448
  Located on chromosome Y
  Distance between a terminus base of telomere on chromosomal short arm and 5'-terminus of this base sequence : 22448112
  Distance between 3'-terminus of neighbour sequence of sequence listing upward to telomere on chrosomal short arm and 5'-terminus of this base sequence : 18868
gaactggtgccagtgagagattctttttcccattaatgactgcttatatatatgtatgtgtgtgtgtgtgtgtgtgtgtgtgtgtatacacacatatacatatatatacacacacatatacacatatatatataagtgtgtgtgtgtgtgtgtgtgtgtgtgtgtgtgtgtgtgtgtatatatatatatatatatatatatatatatatatatatatgactctagatttccaggagggacaatgcaacaatatga

SEQ ID NO: 26789 - DNA, 125 bp, Homo sapiens
  DISO7_10000449
  Located on chromosome Y
  Distance between a terminus base of telomere on chromosomal short arm and 5'-terminus of this base sequence : 22705882
  Distance between 3'-terminus of neighbour sequence of sequence listing upward to telomere on chrosomal short arm and 5'-terminus of this base sequence : 257515
ataccagaggccagcttggcatttccactgcagctttttgagagaacatgaaacataggtgtctgcgtttgcgtgtgtgtgtgtgtgtgtgtgtgtgtgtaagcatacatacagaacctgttgaa

SEQ ID NO: 26790 - DNA, 277 bp, Homo sapiens
  DISO7_10000451
  Located on chromosome Y
  Distance between a terminus base of telomere on chromosomal short arm and 5'-terminus of this base sequence : 22727088
  Distance between 3'-terminus of neighbour sequence of sequence listing upward to telomere on chrosomal short arm and 5'-terminus of this base sequence : 21081
tgttagatatgtgagtttgactgtgagtactttttctagtacaaattttttattttcatttgttagttttgtgtgtttctgtgtgcgtgtgtgtgtgtgtgtgtgtgtgtgtttttagaaggagtcttgctctgtcacctaggctggagtgaagtggcaggatcttggctcacctcaacctccgcctgccagcttcaagcgattcccctgcctcagcctcctgtaacagaaaacgatgggcctcggagagccattttgggaggacatagagatgggc

SEQ ID NO: 26791 - DNA, 199 bp, Homo sapiens
  DISO7_10000455
  Located on chromosome Y
  Distance between a terminus base of telomere on chromosomal short arm and 5'-terminus of this base sequence : 22916187
  Distance between 3'-terminus of neighbour sequence of sequence listing upward to telomere on chrosomal short arm and 5'-terminus of this base sequence : 188822
tgcagattcagatccacagaaaaataaagaacatggagccctgcagtccaagcagagccacacagactggcaaccaaaaggtttggagactcacaaaaagaagaagaagaaaagaagaagaagaagaagaagaagaagaagaagaagaagaagaagaagaagaagaagaagaagaagaagcagaagcagtgctgaagtg

SEQ ID NO: 26792 - DNA, 248 bp, Homo sapiens
  chrY.fa.O7frz.20559726
  Located on chromosome Y
  Distance between a terminus base of telomere on chromosomal short arm and 5'-terminus of this base sequence : 22916385
  Distance between 3'-terminus of neighbour sequence of sequence listing upward to telomere on chrosomal short arm and 5'-terminus of this base sequence : -1
gcattagccatattcctttaagcaggctccacttacaggcaaacacacccacacacataagcactcacaaacacataatgccacacacacacacacacacacacacgcagacatccaacactcaaaataattccagagaaattcacaacctggcagctgctgaggctgtgaggtctgcaggaagccataccagggagagaacaaccccagggaacacaggtgtgctgtacctagaaatcatagtggag

SEQ ID NO: 26793 - DNA, 101 bp, Homo sapiens
  DISO7_10000456
  Located on chromosome Y
  Distance between a terminus base of telomere on chromosomal short arm and 5'-terminus of this base sequence : 22921193
  Distance between 3'-terminus of neighbour sequence of sequence listing upward to telomere on chrosomal short arm and 5'-terminus of this base sequence : 4560
aaagcagactccacttacaggcatacacatacagacacacacaaacacacacacacaaaacacacacacacacagccactcgcacaggcagatatccaaca

SEQ ID NO: 26794 - DNA, 198 bp, Homo sapiens
  DISO7_10000457
  Located on chromosome Y
  Distance between a terminus base of telomere on chromosomal short arm and 5'-terminus of this base sequence : 22998164
  Distance between 3'-terminus of neighbour sequence of sequence listing upward to telomere on chrosomal short arm and 5'-terminus of this base sequence : 76870
gagattaggtgacccaatgcaaatgccagtgagccgaggtcacaccactgcacaccagcctgggtgacacagtgagactgtgacacacacacacatacacacagatacacacacacaatttatctatctatctatctatctatctatctatctatctatctatgtatctatatctcaaattgtaggacactcaattat

SEQ ID NO: 26795 - DNA, 474 bp, Homo sapiens
  chrY.fa.O7frz.20687259
  Located on chromosome Y
  Distance between a terminus base of telomere on chromosomal short arm and 5'-terminus of this base sequence : 23043788
  Distance between 3'-terminus of neighbour sequence of sequence listing upward to telomere on chrosomal short arm and 5'-terminus of this base sequence : 45426
agttaaagtcacatgaactgaaagctaccacagcctttatttttccttttcataatattttggtcaagtggctatcttttcttaagctaatgaattagagatcttttaataaaaataatgtatacataaccaaacaaaccaacagaaaatatactagttatacaattttttgttttccatttttctcatcagattattcacctatggaggggtgtgtgtgtgtgtgtgtgtgtgtgtgttttgagatggagtcttgctctgtcactgaggctggagtacaatggcagaatcttggctcattgcaacctctgcctcctgggctcaattaattttcctgcctcagcctcccaagtagctgagactacaggcacccacccagataatttttgtatttttagtacagatggggtttcaccatgttgcccagcctggtcttgaactcctgaccttaagtgatctacttgccttaggatc

SEQ ID NO: 26796 - DNA, 102 bp, Homo sapiens
  DISO7_10000458
  Located on chromosome Y
  Distance between a terminus base of telomere on chromosomal short arm and 5'-terminus of this base sequence : 23121615
  Distance between 3'-terminus of neighbour sequence of sequence listing upward to telomere on chrosomal short arm and 5'-terminus of this base sequence : 77353
gtgttgggagtggtcatgtctgagtgtgtgtgtgtgtggcattgtgtgtgtgtgtgtgtgtgggaagggcaggggggaatgtgcctgtaaatggagtaggct

SEQ ID NO: 26797 - DNA, 125 bp, Homo sapiens
  DISO7_10000459
  Located on chromosome Y
  Distance between a terminus base of telomere on chromosomal short arm and 5'-terminus of this base sequence : 23124306
  Distance between 3'-terminus of neighbour sequence of sequence listing upward to telomere on chrosomal short arm and 5'-terminus of this base sequence : 2589
cactaaatcacctccacctgaaaaaaaaagccacccttctagaaagaaaaggagcataacacacacacacacacacacacacacacacacacacacacagacatttcccagtgtttcactgtccg

SEQ ID NO: 26798 - DNA, 150 bp, Homo sapiens
  DISO7_10000469
  Located on chromosome Y
  Distance between a terminus base of telomere on chromosomal short arm and 5'-terminus of this base sequence : 23532409
  Distance between 3'-terminus of neighbour sequence of sequence listing upward to telomere on chrosomal short arm and 5'-terminus of this base sequence : 407978
tgtagccatttgaggaagagagagagagagtgggggagagggagagagagaaagaaagagagaaagagagagagagagagaagatggaggaagaaggggcaagggagggttggggagcaaaatacccattgtgcatggtcagaggtggat

SEQ ID NO: 26799 - DNA, 116 bp, Homo sapiens
  DISO7_10000464
  Located on chromosome Y
  Distance between a terminus base of telomere on chromosomal short arm and 5'-terminus of this base sequence : 23628458
  Distance between 3'-terminus of neighbour sequence of sequence listing upward to telomere on chrosomal short arm and 5'-terminus of this base sequence : 95899
agctgcatcatattccattgtgtgggtgatcctagtttgttcaacaggttttgtatgtatgcttacacacacacaaacacacacacacaaacgcacacacctatgttgcatgttct

SEQ ID NO: 26800 - DNA, 101 bp, Homo sapiens
  DISO7_10000462
  Located on chromosome Y
  Distance between a terminus base of telomere on chromosomal short arm and 5'-terminus of this base sequence : 23676815
  Distance between 3'-terminus of neighbour sequence of sequence listing upward to telomere on chrosomal short arm and 5'-terminus of this base sequence : 48241
tctttccagactgtcaggaagtttatctctatctttgcctatctctctctctctctctctctctctctctttctatcttgctgtctctatctctaatctcc

SEQ ID NO: 26801 - DNA, 179 bp, Homo sapiens
  DISO7_10000472
  Located on chromosome Y
  Distance between a terminus base of telomere on chromosomal short arm and 5'-terminus of this base sequence : 26397615
  Distance between 3'-terminus of neighbour sequence of sequence listing upward to telomere on chrosomal short arm and 5'-terminus of this base sequence : 2720699
cagaagtctcatatgccgtcaaaagggtaaaagttttttctttctttctttctttctttctttctttctttctttctttctttctttctttctttctttctttctttcttttctttttctttctttcttttattttttcctgttgggcttttggcctccctctacctatgcaaactggt

SEQ ID NO: 26802 - DNA, 128 bp, Homo sapiens
  D10S1700
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(128): n = A,T,G or C
tgtgttggagtaggacgtgagaactcaactctgcatctgcttttnttacactgtgtgcacgtntgtccccaggtgtgcacgcgcacacacacacacacacacacacacgcatctgtacacgcatctgt

SEQ ID NO: 26803 - DNA, 100 bp, Homo sapiens
  D10S1708
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ccatccagccaagtcagacctggactatgcagtttctgcaaacacacacacacacacacacacacacaccactcatgcgtgtcatttgtgtatttatagc

SEQ ID NO: 26804 - DNA, 181 bp, Homo sapiens
  D10S199
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
aacatccatttggagaattaaaatccagagagttttacacacacacacacacacacacacacacacacacacacaccccccatagggtgggatcagcacatcgaagacatttttttgtttgtttcagacaggatctttctctgttgcccaggctggcgtgcagtcgtgcaatcacactgta

SEQ ID NO: 26805 - DNA, 233 bp, Homo sapiens
  D10S555
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(233): n = A,T,G or C
tccaagggactcccactggccactggatatggaatggagtatcaaacaagtaatgacagtcatagaatataactcatagaaaagaatcaatgaaattntatagaacacacacacacacacacacacacacacacatgcagaaatgagggagaagagaaagcccttcctgttagtagaatcctattagtagaggtgggagtgagttatggaatagaaaatcattgcttgtcaac

SEQ ID NO: 26806 - DNA, 248 bp, Homo sapiens
  D11S1363
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(248): n = A,T,G or C
gaaaatggtatttagaaaccaagatctggacattgggtgtggtagttactactggggtgncatttttttttggtagaccttctcaggggagaatactagaaagcatctgtatataccctaatccatgnacacacacattaacacacacacacacacacacacacacgtgcgcacacacatttctacctatctcttctatctctctatccgtctatcanccatgaaacacantgttgtaagcccttggg

SEQ ID NO: 26807 - DNA, 245 bp, Homo sapiens
  D11S1758
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(245): n = A,T,G or C
gtcaaggtagcccaggaaataacttgaaacacattcttacaatgggcctggagtgttatcttggtataataggaagataattactgtcaacaaatgggagggcanataaaagttaaccctccaatactaggacagagtcttccatcagtaaaaccccaaatctctctctctctctctctctctcacacacacacacacacacacacacacacacacacacattactcagtttgtgagaacactgg

SEQ ID NO: 26808 - DNA, 188 bp, Homo sapiens
  D11S1763
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(188): n = A,T,G or C
aggatggctttggcctaaataactttttaaatgttgtgaatgataaataatattataacacacatacanacacacacacacacacacacacacacaatcttaagagagagagcctgaccccaggtcaggggtctattgaatatccttagcctttacagatcccatcattaaccctccttggggataag

SEQ ID NO: 26809 - DNA, 100 bp, Homo sapiens
  D11S4133
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tattctatcagtaaggtcatttttctttacacacacacacacacacacacacacacatacatgtctgagacaggtttgaatagacctttgtgagtggcta

SEQ ID NO: 26810 - DNA, 215 bp, Homo sapiens
  D11S4181
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(215): n = A,T,G or C
gggcacctgtaatcccagttactcgggaggcagaggcaggagaatcacttganccagagaggtggaggttgcagtgagctgagattgtgccattgcactccagcctgggcaacaagagtaagtctctgtcacacacacacacacacacacacacacacacacacacacacacacacaanggctatacattggaataatgttcttggtctcagttc

SEQ ID NO: 26811 - DNA, 204 bp, Homo sapiens
  D11S4190
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(204): n = A,T,G or C
gataatggtttgtggttgcgatttntgtattggaatacacacacacacacacacacacacacacacacacacacacacacacgttgcatttgcaattatagaattacacatacatatatatagatagatatctagtcaagctttttctaggtcttatgataccattnagtacaacatgatcattttgggggttccatagagagt

SEQ ID NO: 26812 - DNA, 210 bp, Homo sapiens
  D11S4194
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(210): n = A,T,G or C
ccctgcctgtactgcctgantcanctctgtnctccaggcctgttttnatcaaaatcacacacacacacacacacacacacacacacacacacacacacacaccacagagtacctagtggcatcttgtaagaatagccatcatataatactaataatccactgtgtgtcaggcactgctaaggcctttgcattcaaacctcacaataaccc

SEQ ID NO: 26813 - DNA, 119 bp, Homo sapiens
  D11S4198
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
acttggaccgaatgctgttttggtctaacacacattttctgggactgcacacttacacacacacacacacacacacacacacacacacacacattacatggcaagtcttctggattagc

SEQ ID NO: 26814 - DNA, 207 bp, Homo sapiens
  D12S101
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
caaaaaaatgttttactaagcaggacagaatacacacacacacacacacacacacacacacacacacacacacacatcttcttcttccatacatttttgtagtctatatttttttcttctatctctaaaaatatgtctctaaaagtgtagagtgacagtctaccacacaaaaacatacatatgggctggccgcggtgagtcatgcct

SEQ ID NO: 26815 - DNA, 264 bp, Homo sapiens
  D12S1627
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(264): n = A,T,G or C
tacttgatgggtgggcttcagatatattttgangattaaatcaataggaattggagacatatttgatgtgaattataaggaagaaaaggaaatcaaagacaattttnagatcttccctcaaatattagtttctcaacanggccttccctcactacatctgantctgtctctgtctctatctctgtctctgccacacacacacacacacacacacacacacacacacacacacacttatatacttacatgctcacacagtctccc

SEQ ID NO: 26816 - DNA, 120 bp, Homo sapiens
  D12S1638
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(120): n = A,T,G or C
ccaggagttttaagttggttaccaaatgccattctnatgttgaagtacagatacacacacacacacacacacacacacacacaaaaagaatcacatgtatgcaaaataatagcaatttct

SEQ ID NO: 26817 - DNA, 94 bp, Homo sapiens
  D12S1667
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cccaggatatgtaagtaaatccaacaactcaacatacacacacacacacacacacacacacacacacacaaataacctgattaaaaaatgggga

SEQ ID NO: 26818 - DNA, 120 bp, Homo sapiens
  D12S1676
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gatcccacaatcgcataaagtcaagtacttgggaccaattgctccttttcaccacacacacacacacacacacacacacacacacacacacacagtttctgcttctctgatggaatgctg

SEQ ID NO: 26819 - DNA, 141 bp, Homo sapiens
  D12S1682
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(141): n = A,T,G or C
gggacaagagtgagacttggtctcaaacacacacacacacacacacacacacacacacacacacacacagaaaaaaatgtctcctaatngccttaaaacatgaagatgttttattngcttcacagtttacttcaataaagg

SEQ ID NO: 26820 - DNA, 164 bp, Homo sapiens
  D12S1685
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(164): n = A,T,G or C
cacgccctgttcaatctgcatatcatccgnccactcctaattttccaaacacacatagacacacgtagacacacacacacacacacacacacacacacacacacactctctctctctctctctctctctcccctcactcttccttagcatgtgaggcatattgc

SEQ ID NO: 26821 - DNA, 203 bp, Homo sapiens
  D12S1711
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gtgccctgatgttggtgagatatatatatatatatgtatatgtgtatgtgtatatatatatatatatatatatatacacacacacacacacacacacacacacacacaccaatgctatacctcttggtgaattgatttctttatcattatagtgactatattttgtctcttgtgacagtttttgacttcaggtctattttgcc

SEQ ID NO: 26822 - DNA, 116 bp, Homo sapiens
  D12S76
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gggctacatgatgagaccctgtcattcccccaccacacacacacacacacacacacacacacacacacacacacacacacagaattatgcagatttcaacagaaaagaagctccgc

SEQ ID NO: 26823 - DNA, 134 bp, Homo sapiens
  D13S1312
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(134): n = A,T,G or C
tcttcccagaatatatgggacttcacaccacacacacacacacacacacacacacacacacacacacacacacacacacacacaccagtttggccactcatcanggnatacatcaaacaaacacttttacagct

SEQ ID NO: 26824 - DNA, 96 bp, Homo sapiens
  D13S1322
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
caaataagcgagactccatcctcagaggaaaacacacacacacacacacacacacacacacacacacagaaacagtcttgtagtcctttgggtata

SEQ ID NO: 26825 - DNA, 124 bp, Homo sapiens
  D14S1007
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(124): n = A,T,G or C
agctcctatatgtcttcacacagattcctcaattgtaaacatttcacctnaccattctctacacacacacacacacacacacacacacacacacacgcgtgtnantggacgtatgggaatggag

SEQ ID NO: 26826 - DNA, 142 bp, Homo sapiens
  D15S1000
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(142): n = A,T,G or C
cattggcaaacaaagtggcatccgaaatntcacacacacacacacacacacacacacacacacacacaccccaaatcctgtttcctccacataccttaaaatggaagcagtgccattggaagaagcactgctctcaggctca

SEQ ID NO: 26827 - DNA, 192 bp, Homo sapiens
  D15S1014
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tgagacctgaggtagaggacaaagacaatagaagattttagagtgtaatctgaatctttgtaatatcacaaaaaattccagatataattttatgttatggggatacacacacacacacacacacacacacacacacacacacacacgtcttgttgctctatttctattttatctacttccagtttgcctctt

SEQ ID NO: 26828 - DNA, 278 bp, Homo sapiens
  D15S1023
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(278): n = A,T,G or C
ggtattgttttggaccacatcttagtacatgangtatatgctttaggccctaaaaccataaaccaaagccacactatagttatganttctcaacaggagatttttttnccctggttgccaggggctgggaggaactatgangaaaatggtataaaattaggtagtggtggtgattacacacacacacacacacacacacacacacatactaaaaaccattgaattgtacaatttaaacagtttattcaatctaatcctcgaaactgtctcagcctccc

SEQ ID NO: 26829 - DNA, 198 bp, Homo sapiens
  D15S1027
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(198): n = A,T,G or C
ctgaaaaccagcccactctgccctagcccatcaaacacacacacacacacacacacacacacacacacangnaaacangcantcatgcagtgggaggaggggaaggcccctganccaggcctgtctccctgccatggccttgacctactgtctgttgcttccggacctccccacttcctctgggctctccagggactc

SEQ ID NO: 26830 - DNA, 138 bp, Homo sapiens
  D15S1041
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(138): n = A,T,G or C
gtgtttcaacaggctactganactggnaaattatctgtttctgtgggnccctcactttacacacacacacacacacacacacacacggncaaanacatacacatttcanacagatgaccctagggcagtgagatgctg

SEQ ID NO: 26831 - DNA, 200 bp, Homo sapiens
  D15S152
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(200): n = A,T,G or C
atttcctggaccttaaaccccactattttcccacaccctatcccatggatggtgttctcactcaacttgcctcccaagtgggaccctgacaccaatcacaaaacacactcacactccaccacacacacacacacagacacacacacacacacacacacacacacttccctntttcccctctgaatcccttgtactgcatc

SEQ ID NO: 26832 - DNA, 226 bp, Homo sapiens
  D15S208
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(226): n = A,T,G or C
tcttagcagtaattgtcactccttaaacaatagatatttggtaaatcttgccccttcaggcaacctctgaaagttttacttttgataactctactttctcagacattgatattctctctctctctctctgacacacacacacacacacacacacanacatatacacacacacagtataagnagatagagtctnaaaggnnaagnacataaccatgggatggtatgt

SEQ ID NO: 26833 - DNA, 250 bp, Homo sapiens
  D15S966
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(250): n = A,T,G or C
tgctgctcacgaacttttctccttcttttcctaggcatccccaagtctgatgaaaactgggacatgctcaagccacactctaggtgttgtaaatggggctgtgactacacatatgcaggacacagtgcagaatgatgcaggctgtctctctccctctctcatacacacacacacacacacacacacacacacacacacacacacacactcacactcacccacannnaaatactacacagttcccaagagg

SEQ ID NO: 26834 - DNA, 189 bp, Homo sapiens
  D16S3017
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(189): n = A,T,G or C
tgtcttattggaagtgtcacctcttcgtagatgtgacaactgancctagtaaatagagggccccgctgcctgccccatccccataacacacataaacacacacatacacacacacacacacacacacacacacacacacacctatgtactccactgttggcctccctggaacatttgccagaggctgta

SEQ ID NO: 26835 - DNA, 134 bp, Homo sapiens
  D16S3033
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(134): n = A,T,G or C
atgggcaaatgaattgaacaggcacttnacacacacacacacacacacacacacacacacaaaattcaaaagaccaatcagtgcaattaaggaaatgcaaattaaaatcataacgagggaccattcccgcaact

SEQ ID NO: 26836 - DNA, 111 bp, Homo sapiens
  D16S3078
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(111): n = A,T,G or C
caactcttgtccaccctcccaccccacnactnacacacacacacacacacacacacacagagaatggcagtttgtaggctcttagcaacacgttcgttgattgaagaatgg

SEQ ID NO: 26837 - DNA, 213 bp, Homo sapiens
  D16S3083
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(213): n = A,T,G or C
ttccagcagcaaatcctcttgccaatnaagagtgaatggtccttgcagtttctagaaactcatttnatggataaaatacacacacacacacacacacacacacacacacacacacacacacacacatctatctaaaatatttttattttnattttaaataattttgcttttattaaaaatactnttttaaantcttgctggctgttgtggtca

SEQ ID NO: 26838 - DNA, 175 bp, Homo sapiens
  D16S3099
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(175): n = A,T,G or C
gagtagcatctcacaacatctcacaattaaaaatgtttctatcctagttcagtgaccatggtgttgttcccctgtacacacatacacacacacatgcacacacaaacaaacacacacacacacacacacacacacacacacacacctgggnagaggagagccctaagggtaaagt

SEQ ID NO: 26839 - DNA, 233 bp, Homo sapiens
  D16S3103
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(233): n = A,T,G or C
gctttgagtctccacatctatgaaatgaaggatatntctctctctctctctctctctctctctctctctctctcacacacacacacacacacacacacacaccccttacctccagagagccagacattcactctcaagacacttttgaaaatactggtctttccaaagaccatcatttgtatttgtatttgaaagattgcttaggctgaattctgtaggaagacctgctggcc

SEQ ID NO: 26840 - DNA, 101 bp, Homo sapiens
  D16S3124
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(101): n = A,T,G or C
ctggntgacagagtgagaccttgtcttgcatacacacacacacacacacacacacacacacacacacacacaaccatacacaaaaattaatagaaaatggg

SEQ ID NO: 26841 - DNA, 242 bp, Homo sapiens
  D16S3141
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(242): n = A,T,G or C
ggcgttcagattctttatcaaangaatttngagagcgcatgtgacacacacacacacacacacacacacacacacggtctccctntctcttcacacatacacacacacacacanggtctccctctctntacacacacacacacacacacacacacacacacacacacanggtctcccttctctctncaccctncctttttncaggngccattttggcctaaaacacacaanagctgaggctt

SEQ ID NO: 26842 - DNA, 201 bp, Homo sapiens
  D16S500
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(201): n = A,T,G or C
aggttcccagcctgatttttccccttgggttagtgatttgggggccacaagattttattttccttttgtgccttctanacacacacacacacacacacacacacacacacacacacacaccctatcttgcatccattgtcccactgcctgcaattttttgaaacgcaatttgaattttatgtctttcgtattgctcatccc

SEQ ID NO: 26843 - DNA, 252 bp, Homo sapiens
  D17S1294
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(252): n = A,T,G or C
tggcatgcaattgtagtctcggctacgcaggaggctgaggtgggaggntnacctgaacctcaggaggttgagcctgcaataagccatgattgcaccactgcactccatctagcctaagcaacaaagtgagaccctatnaagaaagaaagaaagaagagagagagagaggaaggaaggaaggaaggaaggaaggaaggaaggaaggaaggaaggaaggaaggaaggttcgttctcaacttagtaaggaaagaa

SEQ ID NO: 26844 - DNA, 173 bp, Homo sapiens
  D17S1351
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(173): n = A,T,G or C
ccaaagtcctaaaggtgggttacaagcccttntnactctccttcaactcacaatgtttcacacacacacacacacacacacacacacacacttgctgtattaaagcaactctctttttttcaaataaaatggtaatatggctataaagaaacacctgccttatttgcctgaaa

SEQ ID NO: 26845 - DNA, 196 bp, Homo sapiens
  D17S1815
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(196): n = A,T,G or C
gacaaacagttgggctactcttgcttccttccagacacacacacacacacacacacacacacacacacacagagagagagagaganaagaaaatgcangcattcccagtnacanacatggtnataggcagaaggaaaacanagcanacacccaggaagggttgtnanagttnagganacacctggagcctcagcct

SEQ ID NO: 26846 - DNA, 249 bp, Homo sapiens
  D17S1823
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(249): n = A,T,G or C
gtggtcagatgagagaggctccagcactaacactagagggcctgacctctagggcttttatgtgagttgcacacacaccttcctgctgtactcagacaggctcgtgactaactgttaacctgcacacaaggctgtgtgggaatcatacacanacaaanacatacatgcatgtgcatgcacacacacacacacacacacacacacatattttagnaganacattagaccccanacattagactctgtata

SEQ ID NO: 26847 - DNA, 159 bp, Homo sapiens
  D17S1833
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(159): n = A,T,G or C
aaagcagggctatccgggcctgtcaaaanccatctactggnaaaagccaccatatatcatgccatacctgtaactacaaacacacacacacacacacacacacacacacacactctctctctctctcttgctttctctctttctaaggttgccagatga

SEQ ID NO: 26848 - DNA, 203 bp, Homo sapiens
  D17S1848
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(203): n = A,T,G or C
tcttgagccaggccatacccacacacaagaaagggctgttcctcaagacagcccctggtgtgttgaatgaagtgcgcgcacacacacacacacacacacacacgnacacacacctatncnnaaacacactagacccagatggtattaatagtgttaaaaaaattaantgaaacactattaggctgagatgaccctagtgcctt

SEQ ID NO: 26849 - DNA, 179 bp, Homo sapiens
  D17S1866
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tggattctgtagtcccagggagctggaagtacctgggatttttgaaatgtaaagctaatagaagccaacacacacacacacacacacacacacacacacacacacacacacacacacacacacacacacgccggaaaggactgtttagagacaaggaaggggggagttgtctttgaacc

SEQ ID NO: 26850 - DNA, 149 bp, Homo sapiens
  D17S808
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(149): n = A,T,G or C
accctagacaggatgccatcccattgcagggcgggtanacacacacacacacacacacacacacacaccccatgtgggtatgccggtgaacccaacacatgtgcctttgggatgtgggaggaaagcagaataacctgagaaaacccaca

SEQ ID NO: 26851 - DNA, 159 bp, Homo sapiens
  D17S925
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cacatggtaggtgcctaataaaaggtggtccccttccttcaacaggagactagacatcacaagaggtggtcttcaccacacacacacacacacacacacacacacacacacacacacacacggttcagccttagttggcccacttcaccagagcctgcc

SEQ ID NO: 26852 - DNA, 223 bp, Homo sapiens
  D17S927
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tgtctgacatgacacccctcctccacatgccctcctccaaggaaagaactgaagttagaagagggagaagaacctgaagtcgggtacctggttttgacctacctctccccaaactagaaaacccgtgagacacacacacacacacacacacacacacacacacacacgcacacaaccaagtttcaaaccagacaatagaagacaaactggccttcaggttgga

SEQ ID NO: 26853 - DNA, 279 bp, Homo sapiens
  D18S1141
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(279): n = A,T,G or C
tcttttgacaaataacccctaacggtttatttaaatatatgtatgcgtgtgtgtatatatatatgcgtgtataatataatatatgtctctaaaatctctaaaattaacctcaattgtttagttatttncctttaggaatagttgttttaatattntcatatttnatttncatatttnattttatacacacacacacacacacacacacacacacacacacacacagggggagacagagacagacagncagacagagacagaaaaggtctcgcactgtcc

SEQ ID NO: 26854 - DNA, 184 bp, Homo sapiens
  D18S1150
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(184): n = A,T,G or C
ggcacaggaaacgtgaatttttaaaaacaataacaacaacaccaccagacacacacacacacacacacacacacaccccagncaacagaagaaaacancattgttatcgaaangtgacctgngtngaatgganccacatgggtcttgtgggtgcacgngccccaggntggctggcatccttgtg

SEQ ID NO: 26855 - DNA, 94 bp, Homo sapiens
  D18S1161
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gtccgtccaacgtccaagcaaaggcagtcaagcttacacacacacacacacacacacacacacacacacacacacaggataggtgtggctctcc

SEQ ID NO: 26856 - DNA, 93 bp, Homo sapiens
  D18S451
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
aattacaggctttaaacctgcacacacacacacacacacacacacacacacacacacacacacttggcatctggtagttcccattgcctccat

SEQ ID NO: 26857 - DNA, 137 bp, Homo sapiens
  D18S452
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(137): n = A,T,G or C
ataaaagttgcttcctggggcatacatagtgcaaacctatcctgaagttcacctttagggnaacacacacacacacacacacacacacacacacacacacacacacacacacacagagccagcggttatttaggaga

SEQ ID NO: 26858 - DNA, 244 bp, Homo sapiens
  D18S477
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(244): n = A,T,G or C
ggacatccttgatttgctcataatacactcattcctttcaccattgagtgtgcacatatttctctgattggaaagaactacagaggaggttttacnttttactttccagtttgctattaaagagagaaaactaacagagngaaatcaagcaactcaaaacaaccttacacacacacacacacacacacactcacaaagatattttgttcaccatatgtattgatgtgcctgttttcagtcaatc

SEQ ID NO: 26859 - DNA, 294 bp, Homo sapiens
  D18S479
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(294): n = A,T,G or C
aatgcccagcagagtgttgangatatgcccaacacacacacacacacacaccacaccacacacatacacacacacacaccacacacatacacacaccccaacacacacccccacaccacaccacacacatacacacacacacacacaccncacacatacacacacaccccaccacacacacacacacacacacacacacggagagaaannganacacacagcccatctgcaaaggctgggagtttttctctggttttggctgcaggcntttcatgcactctctgtcaaaccact

SEQ ID NO: 26860 - DNA, 144 bp, Homo sapiens
  D18S55
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gggaagtcaaatgcaaaatcaattcagtttgtcaatattgattctctattctagcctggcgtggtttttcctcgtcacacacacacacacacacacacacacacacacacacacacacacacagcataagattactcagaagct

SEQ ID NO: 26861 - DNA, 195 bp, Homo sapiens
  D18S62
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
caccaaattcattgatggacggagggaaactgtttttatcaaaagtatattcccctttttttcccttaaatatatcacacttctttttttgtaccagttaatgctgtctattctaaatcctcaacaccatttttcacacacacacacacacacacacacactcatttaccatgtatctgttctcaacccttcaca

SEQ ID NO: 26862 - DNA, 148 bp, Homo sapiens
  D18S827
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tgtgatactttaatgatactgtgcctatatttaaacacacacacacacacacacacacacacacatgcgcacgtgcacacaaggtcatgctgaagtactgacactatagagcactcgtaaaacatatactattaccgccacaaacatg

SEQ ID NO: 26863 - DNA, 227 bp, Homo sapiens
  D19S406
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(227): n = A,T,G or C
aatatgtagaaacacagaaacccaggcggacaccaaaaccacctcatagatactagaaacagatctccccaagacacagatgagtcatgtagttaaatctgacctcacggataccaatgggctttacacacacacacacacacacacacacacacacacacacacacacagacaatnacagagacacttttaaaactatctagataatcaaatacacccccacattg

SEQ ID NO: 26864 - DNA, 79 bp, Homo sapiens
  D19S413
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gtttattttaaatgctcttaccacacacacacacacacacacacacacacacacacacgataagtaggtgagttgatgg

SEQ ID NO: 26865 - DNA, 126 bp, Homo sapiens
  D19S567
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(126): n = A,T,G or C
ggaccacagctaggcagaggtcagaggacggctggggttggggtggagcaaatnagagggtggggggagacacacacacacacacacacacacacacactccaatncccaccatcaggagaatagc

SEQ ID NO: 26866 - DNA, 229 bp, Homo sapiens
  D19S865
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(229): n = A,T,G or C
gctatttggggtctctatcaatggataaatggataaagaaaatgtgtgtgtatatatatatatncacacacacacacacacacacacacacacacacacacacgatggaatactatacagccttaaagaagaaggaaatactgtcatttttgaccacacggacgaacctgggggacattgtgcgaagtgaaataagccaggcacagtgagacaaatactgtgcgatttc

SEQ ID NO: 26867 - DNA, 248 bp, Homo sapiens
  D19S916
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(248): n = A,T,G or C
ccactacacttcagcctgggcgacagagtaagacaccgtntcacaacacacacacacatacacacacacacacacacagagagagagagagagagagagagagagagagagagagagagagagagagagattacacccagccaggnctgcccctcttggncccattgtcttcctttgctacccagcaactgggnagaaaggtaactctctctccnggnttggnggaaacagtaagcaaacctttctgc

SEQ ID NO: 26868 - DNA, 235 bp, Homo sapiens
  D1S1636
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(235): n = A,T,G or C
atgtgccaccttgtttttgtttttattattattattattattattattattattattattattatactttaagntttagggtacatgtgcacaatggtgccgggttaggtaacaanatggtatacatgtgccatgctggtgtgctgcacccattaactcgntcatttagcattaggtatatctcctaatgctatccctcncncctccccccaccccacaacagtccccagagttt

SEQ ID NO: 26869 - DNA, 114 bp, Homo sapiens
  D1S213
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(114): n = A,T,G or C
cattatccaaggtcaggaggggcaaggaacatacatanacacacacacacacacacacacacacacacacacacacactcttacacgtacacatcatagattggattaacagct

SEQ ID NO: 26870 - DNA, 113 bp, Homo sapiens
  D1S225
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tggcctgaatagaccataaaaatcagaactatgttttattacattgcatgcacacacacacacacacacacacacacacatttagagatggagtcttgctttgtcacccaggc

SEQ ID NO: 26871 - DNA, 234 bp, Homo sapiens
  D1S234
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcccaggaggttgaggctgcagtgagcaagatcctgccactacactccaccctgggtgacagagggagaccctgtcacacacacacacacacacacacacacacacacacacacacacacacaaaagtacaaaattagtaattcatctcagagggacaacagggcatattacaagaattacactgtatgtatgaatgatgaatatataaatgatctgtaattcaagcctgcctt

SEQ ID NO: 26872 - DNA, 149 bp, Homo sapiens
  D1S2345
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(149): n = A,T,G or C
caagctccgtctcaaacactcacacacacacacacacacacacacacacacacacacacacacacacaatactttgcagggaaaattaaaaacctgaaaggaaaaacgtggtaggagggnaaagtaagggcctgtagattgggaagatg

SEQ ID NO: 26873 - DNA, 149 bp, Homo sapiens
  D1S2657
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(149): n = A,T,G or C
ggaagatttcataccccccccacaaaaaaaacaagaaaacacacacacacacacacacacacacacacacacacacaaacatatattgaatanttatttatctatttattttttagtaacagagtctcacnctgttgctcagcctggag

SEQ ID NO: 26874 - DNA, 192 bp, Homo sapiens
  D1S2662
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(192): n = A,T,G or C
agctggttgttctatgcagacatgaaatatcanggngaacacacacacacacacacacacacacacacacacacacatgctttggccctggntcagtctgattgattatggattaattttctctttccggaagtagatctagatgaatgttccttataggaatatgactcttaagtacggcaagcaccagtt

SEQ ID NO: 26875 - DNA, 219 bp, Homo sapiens
  D1S2686
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(219): n = A,T,G or C
gggacttttgtattgactgacttattgattgangtaatcttcatggttacacataccaatgtggtttatttagaatgcccactgtaaaataaagtatccacaactctttctgataaatncacacaggaaggtacacacacacacacacacacacacacacacacgggctggtcacttgcctgttgtctttaggtccctttcctctgctcagcaaactac

SEQ ID NO: 26876 - DNA, 127 bp, Homo sapiens
  D1S2701
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(127): n = A,T,G or C
ggtgtgagccaccatgactggctgcaattggtatttttntaagccgtttaaatgttattggagaactaggggcacagtgtacacacacacacacacacacacacgcacacataaatatcccagatgg

SEQ ID NO: 26877 - DNA, 152 bp, Homo sapiens
  D1S2715
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(152): n = A,T,G or C
cacaggattctgcgtctaactctctttgtctctctctnacacacacacacacacacacacacacacacacaccgagcaaggacctcggccattnctgatcccctctgcttgggtgacccatcacccttccactcacttcagttcttggagca

SEQ ID NO: 26878 - DNA, 276 bp, Homo sapiens
  D1S2745
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(276): n = A,T,G or C
caccaaagggtatgaaacagataagagacattgtgagatacagattttaaataaaatgcactgggtattgcattgattgaaagataataaanctggaagcagggacatttggttagggtagcaatttggagagatgagccaaggaaacagtaattaagataggcagcaatacttttgaggaaatataccaaacacacacacacacacacacacacacacacacagagtnttccagggangaggncaggncttttaccagctgctttcaatgtgggc

SEQ ID NO: 26879 - DNA, 134 bp, Homo sapiens
  D1S2773
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(134): n = A,T,G or C
tattgacctccattgtgtgccacanccttgggtgancacacacacacacacacacacacacacacacacacacacacacacgcagagtctgggctaaaggctggagctccttgcctccctaaaggtgaggcagt

SEQ ID NO: 26880 - DNA, 159 bp, Homo sapiens
  D1S321
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gatgtgagccactgtgcctggtgagcaattcttaactggttcttaaactctatgtaaacacatacacacacacacacacacacacacacacacacacaccattgcttgaatcttgattttgtcaaatttcgtaattccctggggtaagactattgaatc

SEQ ID NO: 26881 - DNA, 249 bp, Homo sapiens
  D1S450
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(249): n = A,T,G or C
gctccaatgtccaagggcaggagaagacagatgtctcggctcaagcagacagtgaaatcaccttcctctgcctttttgctctattgagcattggccaatgcccacccacataggtgagggtagatcttttttactcggtctcccaattcaaatgctgatctcttctggaagnatacacatacacacacacacacacacacacanacacacacacacacacacaatgttttaccagccatctgagtaccc

SEQ ID NO: 26882 - DNA, 228 bp, Homo sapiens
  D1S511
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ccacagataattccatgcaggtggaatctgttatggttttcacatatccagtccaattacacacacacacacacacacacacacacacacacacacaaatatgtatagtgttttggaatcattgttttagaaaaacagattaaatattagattaaaaaataggttaaaacccccaaaacttaaatctaatcttagtgatgtttacatttatggccatctgcctcagtt

SEQ ID NO: 26883 - DNA, 227 bp, Homo sapiens
  D22S1140
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agtgtccccatctgaatatggggaagcagatcggtttcagccccctccaccagcagttcctggggcctctccccatcacagcacagcacacgaggctcaggcctgctgctggcactgtctctgtctaccaccctgcccacccccttgagggctgtggagagtggggggcgcgcacacacacacacacacacacacacacacacacacacacgtgcgcgtacaccaga

SEQ ID NO: 26884 - DNA, 155 bp, Homo sapiens
  D22S1153
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(155): n = A,T,G or C
tgagccatgatcgcaccacagcactccagcctggntgacagagaaagaccctatctacaaaacacacacacacacacacacacacacacacacacacacacaaaacagatgagaaaactgaggcaccaagaggtgtttctggaatccaaacttgg

SEQ ID NO: 26885 - DNA, 239 bp, Homo sapiens
  D22S1161
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(239): n = A,T,G or C
acggagcatctgtcccctccaggtcctccttnagacaaggtggacccgaatcagacccaggccccatccgccagccacgctnaccagagacccccaagcacgcgtgcatgtgcgcgtnacacacacacacacacacacacacacacgtcggctgcaatcccctgtgacaagatcttcggcttggcctgctatatccggttcctctggccgctgtaacaaaccaccacaaactcgtggct

SEQ ID NO: 26886 - DNA, 209 bp, Homo sapiens
  D2S120
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tcttgccacagaaatctcaccaaggtgttgttaagtttaaaacacacacacacacacacacactctctctctctctctctctctctctctctctctctcttaaaatctgatcacatctaaagaaaaatgacagagaaatatctgggtatatacctctgtattgaaaatgaagtgacaggatgcacaccaaactgccgatactacttggg

SEQ ID NO: 26887 - DNA, 96 bp, Homo sapiens
  D2S125
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcaacagagtgagaccctgacacacacacacacacacacacacacacacacacacacacacatcttatttacacaatcacaatctggttctcagaa

SEQ ID NO: 26888 - DNA, 224 bp, Homo sapiens
  D2S161
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(224): n = A,T,G or C
tcaggagtagactttagacaaaacatagagaattgattgtcattgcttaggagaattggaaagtaaataattacgcttgaattaaaagaaaactattatcaaacacacacacacacacacacacacacacaccccatgctgatccatgtcctttgtgtgtgcatattttaggnacagaggaaacgtgagttgtgagtgggggaaaatgtaaggtatcccctcgc

SEQ ID NO: 26889 - DNA, 87 bp, Homo sapiens
  D2S1888
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tttgaagtttggtgtctgtgtaaacacacacacacacacacacacacacacacacacacacttccctaacatttccaagggacttca

SEQ ID NO: 26890 - DNA, 256 bp, Homo sapiens
  D2S1891
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(256): n = A,T,G or C
tctatgaaccaggaagccagtcctnaccagacaccgaatctgtggtgtctggatctnagacttccagcccgnaaanctgtgggaaatcactcctgttgctgacacccctcaccaacacacacacacacacacacacacacccatctgtggcattttgtnacagcaactcaagggnctacaacaggcgctgtgaccccagtccctttaactgccctcttcctgctgggagaggctctcctggtctcacctcagcatg

SEQ ID NO: 26891 - DNA, 194 bp, Homo sapiens
  D2S2161
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tgttcacccctcaggctcagacaccagcaacagtggtaaccagggtggtcctgaaaattccgtaggcaaatggaactggaactgcagatgtcactggaagcattaataaaacacacacacacacacacacacacacacacacacacacacacacagaaacaggagaggacgcagacagggacaataggagtaat

SEQ ID NO: 26892 - DNA, 121 bp, Homo sapiens
  D2S2165
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ttgggcaacaagcgagaccacatctcttaaaaagattttacacacacacacacacacacacacacacacacacacacgcatccatcttccttcaattaaaactatgcaccttcttgccggg

SEQ ID NO: 26893 - DNA, 205 bp, Homo sapiens
  D2S2206
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(205): n = A,T,G or C
ctgggtgacagagcaagactccatctaaaaaaaattatatatatatacacacacacacacacacacacacacacacacacacacacatatatatatatatatatatatatagagagagagagagagagagagagagagtcttattccggtctcctagcatactcctaaaatccttgggnnctccaaagtctttttgtttgctaat

SEQ ID NO: 26894 - DNA, 229 bp, Homo sapiens
  D2S2253
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(229): n = A,T,G or C
catttctgatgtaaacacaagttggntgtaatatatgatatttgtctatatgtatatgtgtgcatgtaagtacacacacacacacacacacacacacacgcagggtagacttttaagacttttgnttttttcctttctttgtttcttttttgagactgggtcttgctctgtcacccaggntggaatgnagtggngcagtcacaggtcattgcagcctcaaccttgccag

SEQ ID NO: 26895 - DNA, 254 bp, Homo sapiens
  D2S2285
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(254): n = A,T,G or C
aggaccacctcgttgcggagccaggagaaagcgctcagcacggtgtgtgtcgcccagcgatggcaggtgggaaaatgatgagttttttcatattttcaaatcagcatgggcacacagtcaattttgtacacacacacacacacacacacacacacaccccttccaaantctgcccttaaggaaaggtactaaaaccanttttaaaagaatcagcttttcctttatcctaatcagcagcaggcattcacagccat

SEQ ID NO: 26896 - DNA, 211 bp, Homo sapiens
  D2S2308
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(211): n = A,T,G or C
tgctaatcccatttatgagggctccaccctccattaaattaccttctaaaggccttatctctaaatattatcacattggggggtttggatttaacatataaatttggtgggggacacaaacattcaggccataatacttgccctacatatgaacaaacacacacacacacacacacacacacgcctggntcgattagagcaatggtttcca

SEQ ID NO: 26897 - DNA, 198 bp, Homo sapiens
  D2S2322
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(198): n = A,T,G or C
cctttatgggtaacccgacctttctctctggctgagagagaattttnctttttacaccccttccctgtcagccccaccagcctttgccaacacacacacacacacacacacacacacacacattgtttagccagttctgtttttcactatatcctgcagttttagaagtatttggagtgagcaattcctaagtctttc

SEQ ID NO: 26898 - DNA, 216 bp, Homo sapiens
  D2S2329
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(216): n = A,T,G or C
actcctgcctccaaacacacgtgtacacacgcacacacacacacacacacacacacacacacacacacacactgaacctcaagtgcagagaccagagttaatcataantcttagtaaagnacatacagattctntcttgctttatcttatttatttcattcccccttttatcccattcccntcctgtattccacaggggctgagtcaatgtatttg

SEQ ID NO: 26899 - DNA, 106 bp, Homo sapiens
  D2S2353
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(106): n = A,T,G or C
ccttcaggctaataaaatgataataccagtagacagtgataaatgtctacacacacacacacacacacacacacacacacacaaanacacacacgcaacatttaga

SEQ ID NO: 26900 - DNA, 268 bp, Homo sapiens
  D2S2355
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(268): n = A,T,G or C
cactgataataaagacatgcacacatacatatgtatttttaatatatactttatcatattttatgttattaatatttttatattgtttatattatatatnataanaccatattatatgtntataatatatatnnntntganatatacacacacacacacacacacacacacacatatatatgtataaatgcttcctgatgataaggactgtgaaaaagggaganccaggctgaggtgaggcaggagggatgggaatgtgtgtgctgtc

SEQ ID NO: 26901 - DNA, 238 bp, Homo sapiens
  D2S2377
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(238): n = A,T,G or C
ttggggccagatgtatttttcaatttgggtcttccatgtttgagaaaagtaacatgggatatatgccatatattacgtaacacccttagcagggtcttgggagaataccccaaatcaagtgcattaacatatctgtagacacacacacacacacacacacacacactcacacacacaagcaaaagagataaatgaagattacaaattgcntcaaattcagatccattcttgctgacct

SEQ ID NO: 26902 - DNA, 189 bp, Homo sapiens
  D2S2383
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gagaaacattgcctggtaaggattttctgttcttacaattttagcagatttgaaggggatatcatggagatgctcaattatcatcatattagataaaaaaaatccctttcttctctcttttgctgttctggttcctccctcaacacacacacacacacacacacacacacacgccactcactcattttg

SEQ ID NO: 26903 - DNA, 155 bp, Homo sapiens
  D2S2396
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tggtgactgccctcagtttgattaaagcttcctgaattcactattgggtcaacagggatgtatctcacacacacacacacacacacacacacacacacaatctcccacctctatttttttcagaataattgcctgaagcagaggtgttcctggga

SEQ ID NO: 26904 - DNA, 139 bp, Homo sapiens
  D2S280
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ttcaaggcacaatgttttccataaacctagtaaatagaatttaagccatttcgaacaaaaacaacacacacacacacacacacacacacacacacactattctgagcactttgatttgctgcttttgttaaagagtctg

SEQ ID NO: 26905 - DNA, 197 bp, Homo sapiens
  D2S311
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(197): n = A,T,G or C
caattttgagcccggaaggcagaggctgcagcaagcccagatattgcaccattgnactccagcctggatgagagagtgagacctcatctcacacacacacacacacacacacacacacacacacacacacagcacttcagtcaaggaactatcccctgagattttganttaattgctctggaatgcctttctagtca

SEQ ID NO: 26906 - DNA, 218 bp, Homo sapiens
  D2S318
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(218): n = A,T,G or C
gaagaaataggcaaaagtgcaaactatgcaggcaaagtgcatattgcctctgcatagggncattancagtttttgtttgtttgtttggtttctctttttttccctatagcgattaagaataactttatgattttccacacacacacacacacacacacacacacacacaaatgagtgaatgaagtaaataggatttgtgtggtgccttcaagttcccc

SEQ ID NO: 26907 - DNA, 128 bp, Homo sapiens
  D2S319
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gtagacgtggtgacacagttacaatgtatactaaaaattgctaagacagattttcagtgttctcattacacacacacacacacacacacacacacacaaaggcatgcgaggcaatgcatgcgatttag

SEQ ID NO: 26908 - DNA, 286 bp, Homo sapiens
  D2S347
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(286): n = A,T,G or C
cctaccagaacacatgcagattctggactagccctcttctgtaactgcatgagccaattccttaaaatgaatctcttcctctctctctctctctntctcttgccccccacatacatgcacacacacacacacacacacacacacacacacacacacacacacacccagtnggttctgtctcttnggagagcgntgtctacatctgaaaaaaacatnttggngggagnngcagatacanttntttttanagttgacaggagtctanngggctcagttcaggagatat

SEQ ID NO: 26909 - DNA, 169 bp, Homo sapiens
  D2S358
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(169): n = A,T,G or C
tcgtggtctcaagcatcagcagtcaggtaatgancaatgagtgagtattacatatacatataaatacacacacacacacacacacacacacacacacacacacacacacacagnggctccagttgccaaccctacactgttatgctgnagatacctgccaagtccttcc

SEQ ID NO: 26910 - DNA, 222 bp, Homo sapiens
  D2S392
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(222): n = A,T,G or C
tcctatgccaggcttcactgaaaagcctccaggaacagaccttaggttcccacctttttgcatatagtatctgaaaggaatgctgaacctattagcctcaggccgttagtttgtnctctcttacacacacacacacacacacacacacacacacaaaccctccccacccgcaccccctgttcacttgctatcttccaccctgtataccccaaacaatgtggt

SEQ ID NO: 26911 - DNA, 156 bp, Homo sapiens
  D2S395
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
atttaatttgctttgccacccgccccacttctctctctctctctcctctctttctctctctctctctctctctctctcacacacacacacacacacacacacacacacacactcacttactctaccattttattactgctgcctgagatggtagct

SEQ ID NO: 26912 - DNA, 111 bp, Homo sapiens
  D2S401
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gggagatttggagaaacattgtttgctatgtatcttttcagatacacacacacacacacacacacacacacagccatattcaaatgagtttatatggttctgcaacttctg

SEQ ID NO: 26913 - DNA, 147 bp, Homo sapiens
  D3S1267
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(147): n = A,T,G or C
tgtgcanatgcccctccttcactaagtggccacacagaaaccacacacacacacacacacacacacacacacacacacacacacacacacacacagtccctgtgccatccctcggcccttccttggtatgggtgactcccacctggg

SEQ ID NO: 26914 - DNA, 209 bp, Homo sapiens
  D3S1278
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(209): n = A,T,G or C
ggacacatgctcctggaaagccttatacatcgcccttcccccaccacaaacacacacacacacacacacacacacacacacacananacaccccgctgagaacatggacagtggctgtcagcatttatcccacctagcccagtaccaccactctgataccaggntggagacaggaagcagtngntgactgacaactgccctgtagtgca

SEQ ID NO: 26915 - DNA, 144 bp, Homo sapiens
  D3S1573
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(144): n = A,T,G or C
ttcatttttgcttattaagatatgcatatacatacccctccaacgcgcgcgcacacacacacacacacacacacacacacacacacacaaacatatttcattgagaaaaagtcatgaaattggaatagccctgtnatttactgg

SEQ ID NO: 26916 - DNA, 285 bp, Homo sapiens
  D3S1592
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(285): n = A,T,G or C
aggcagaggctacagtattggaagtcctagccaaagcaattgggcaagaaaaagaaataaaacgcatctaaattggaaatgaaggagtaaattgcctttttcctcacatgacaagatcttatatgtagaaaaccctaaagattacacacacacacacacacacacacacacacacacacacacacctattagaactacatttgntcttggccnaaaggccaagaagtgattctgttaggacaaatggacaaatttagnaaagttgcaggatacgaaatcaacaca

SEQ ID NO: 26917 - DNA, 253 bp, Homo sapiens
  D3S1604
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(253): n = A,T,G or C
caccattgtaagaggcttcataanccacacacacacacacacacacacacacacacacaaattagtacatagtgatacagttacacaattctcaatcctttagttaaagaaactacaacagcatgcatatactaagatatctatgtgaggtaatgtatttgttaattggctagacttaatcattccacatgcatatatacttcaaaatancaggttctacatgataaatatacacaattttatgcgtcaattt

SEQ ID NO: 26918 - DNA, 269 bp, Homo sapiens
  D3S2389
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
aatcaatttcctgcaatccattcacagactaaatcctacagtgactttaatgtgcatattactataagcaacagaaactagcattaactatctcaagcctagatagttgattgatagatagatgatagataaaagatagatgatagatagatagatagatagatagatagatagatagatacatacatacatacatacatacatacatacatacatagctgataaataaacagataaataggtaaaagcatttattggaagaatatggg

SEQ ID NO: 26919 - DNA, 219 bp, Homo sapiens
  D3S2419
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(219): n = A,T,G or C
gtggctggttattttccctttctgttactgttctcttaaattcaaactaaacctccatgttaccttcaaataataataataataataataataataataataataataatnntgnatgcagggcttaatacctaggtgatgggttgatagctgcagcaaaccaccacggcacagattcacctatgtaacaaacctgcacatcctgcacatgtatcctgg

SEQ ID NO: 26920 - DNA, 210 bp, Homo sapiens
  D3S3509
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcacttcaaagagttgtgaggatcagataaaataatgtggataacaagtcttgtccagtgcttggtacataggcctttaataaatgttaccttggaatatatgtcctaataatacatgcctgctcattttagtatctgtcttacacacacatgcacacacacacacacacacacacacacacacacacacctcatctgtgtctcatcatt

SEQ ID NO: 26921 - DNA, 247 bp, Homo sapiens
  D3S3513
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(247): n = A,T,G or C
attgcgccattgcactccagcctgggccacagagcaaggctccatctcaaaaaaaaaaaaaaatcttgataaacaggctgggcacagtggctctcacctgtaatcccagcactttgggaggctgaggtgggaggntcacttgagcccaggngttcaagatcagtctggacaacataccaagactgtntctccacacacacacacacacacacacacacaaccacatacagagttgccaggtgtgttg

SEQ ID NO: 26922 - DNA, 267 bp, Homo sapiens
  D3S3521
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cagtaagtccatgccagggcaggaacagattctgagacccaggtctcccattctggcgctgctcctctcattctcatctggcgtggtctggttcctctgctttaaccaaatcttgtaatttatttggttttgttaaccttaaaaattatcagatatcagaaaactaacattacatctggaacatctagaaaccctaggaaaacacacacacacacacacacacacacacacaccccactaccaaaaccactccaaggtaactgctgc

SEQ ID NO: 26923 - DNA, 216 bp, Homo sapiens
  D3S3553
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(216): n = A,T,G or C
ctccaaggtattgcctcctggcaggggcagaggaaaatagaaaaagaaagnaaaaaccaaaatgggattctctctgccgctccctagcagacgcgggggncgcgcgcgcgcacacacacacacacacacacacacacacacacacacacacacacactccccagatgaaaaagagaaggcttctcttggaacgcttcccgtctggacctactacag

SEQ ID NO: 26924 - DNA, 276 bp, Homo sapiens
  D3S3583
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tgcaaagtcacagatgtccaatgacactgaaatatgccacagcccctgcaaaggagcaccctgacatggtgtaagtatcaatacctagatttgtgtaaagcctcagaggtgcatcctccatgcacccgcaacacacacacacacacacacacacacacacacacacaccctgcaagcatggttctgtttatgggatgtcttccagtggggtagaggaagagttactgggagagggtggtacccctcatcctgcccccaacactctggtgcctctcg

SEQ ID NO: 26925 - DNA, 137 bp, Homo sapiens
  D3S3633
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(137): n = A,T,G or C
caggtgtgagccaccgcacccggctagantntttactgtntacataaacacacacacacacacacacacacacacacacacacacacacacagagagagagagagagagtgagggatttataccttcagtaaaagca

SEQ ID NO: 26926 - DNA, 144 bp, Homo sapiens
  D3S3694
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(144): n = A,T,G or C
agtgtccatcaacatgggaatgaataaaganaatgtggcatatgtatgtatacttatacacacacacacacacacacacacacacacacacacaatggaatactattcaggcttaaaaaagaaggaatcctgttatttgtgcga

SEQ ID NO: 26927 - DNA, 198 bp, Homo sapiens
  D3S3712
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agtggtggtttcgtttcaaaccacacgccctgacaggggaacctggttatcaaccaatctgctttctgtctcttgtctctcgattcatcatgatgttgtgcctgcaacacacacacacacacacacacacacacacacacacatctgtccatgctaggtacttctagaatggcactctgatatcagccacagcaatca

SEQ ID NO: 26928 - DNA, 199 bp, Homo sapiens
  D3S3726
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(199): n = A,T,G or C
ggtggaggatctctacatgggnaattacgnaagtcttgtgaaagaagtcagaaatnacacacacacacacacacagacacacacacacacacacacacacacggnaaaacattccatgctcaaggactagnagaatcagtgtcatgaaaatgaccatgctggccaaagcnacttacagattcagtgctactcctattga

SEQ ID NO: 26929 - DNA, 154 bp, Homo sapiens
  D3S3730
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(154): n = A,T,G or C
gactggaaaattcagcctctatgaatataacatatgtgaagaacacacacacacacacacacacacacacacacacacacacacacactcacagtgaccatgggttgaaantagcatgctctgcttaacattgtacatgctcaggactcatctt

SEQ ID NO: 26930 - DNA, 196 bp, Homo sapiens
  D4S1554
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(196): n = A,T,G or C
cttgtttcctgttgagcactccctatcctttattgaaatgctggtcctcgaccagacacacacacacacacacacacacacacacacacacacacacacacacagatggncctatagatagntcatgcacatctntgggaatgttttaagtttttgantataagtggtagatatctgggtgatcagtacatcattc

SEQ ID NO: 26931 - DNA, 237 bp, Homo sapiens
  D4S1583
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(237): n = A,T,G or C
gcctaggtagggccatagaactccagcctgggnaagagagcgagactccatctctctctctctctctctctctctctctctcacatacacacacacacacacacactctctctctctctctctctcacatacacacacacacacacacacacacacacacactctctctctctctctctctcaatatatgctagaatgggnaaagtacagagttctccctaccaaaattaataggtt

SEQ ID NO: 26932 - DNA, 281 bp, Homo sapiens
  D4S2408
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
aataaacttcaacttcaattcatccactgaaatgactgaaaaatagtaaccattagatagatagatagatagatagatagatagatagatagatgcatagctttctattgaactgttatgtaccttaaatgtagaagttcttaacttgctgaatttttttcacttaccctatggaaatgaatcatagtgcacttgaacatgtggtaagatgtcagcttcagtgtgactcctaatcagatgaaataacttctagtttttcctgccaagaagagcctttacct

SEQ ID NO: 26933 - DNA, 263 bp, Homo sapiens
  D4S2914
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(263): n = A,T,G or C
ggactctttactttgggcatgtcaggatgctcagagagacagancccataggatatctgtntgtatatcctattggttctggntctattgtttctntaganctattgtttctgtatatccagaaccagttacgcacacacacacacacacacacacacatatacacatacgtatatatggaggaggagaagaagaagaaagagaagttagaagggatttattggggaattggcttacataattatagaggctgagaaatccca

SEQ ID NO: 26934 - DNA, 178 bp, Homo sapiens
  D4S2916
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(178): n = A,T,G or C
tgaatcatggcccttggctgggccctttattattcagaattctccacagaagcagaaccattagggtatgtacacacacacagagatgnacacacacacacacacacacacacacacacacacactgtaaggaattggttcacacaattttggaggctggtaggttctaaggtccaaa

SEQ ID NO: 26935 - DNA, 151 bp, Homo sapiens
  D4S2921
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(151): n = A,T,G or C
tccttcaggaactggtgcantttcatgtattctgacacaanaacctgtttacaagtctttgtttcntcctgccaaaacacacacacacacacacacacacacacacgagataaagttagtaagagaaatgcccttgtctgtagatttttaa

SEQ ID NO: 26936 - DNA, 219 bp, Homo sapiens
  D4S2930
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(219): n = A,T,G or C
cctcatggtaggttaatcccacgctttgccaaagattaccgtatctttactcacatccccttcctcatgtgtcctttccacttattatcattcnttgggtttttctgtcacctcacccctgtcatacattctcacacacacacacacacacacacacacacgtgtatatacaataagtttctattagggtagcattgtacaaatggcgggcattcaata

SEQ ID NO: 26937 - DNA, 170 bp, Homo sapiens
  D4S2936
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(170): n = A,T,G or C
cactcaagcctgggggacaagagcgagactccgtctgaaancaaacaaaacaaancaaaaaactacacacacacacacacacacacacacacacacacaggtgaacggctggaattatttctccggcgatggttaaatgatacttgggttcagttgttggtgatgtgcca

SEQ ID NO: 26938 - DNA, 250 bp, Homo sapiens
  D4S2937
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(250): n = A,T,G or C
acagtgtcaantgatgcccntaatgnattttcactacagaaactgaaggtttgaatttgacactcaatagtctttaggtgatgttcaaaataatgagatttgaanttttatgtttttggggtacacatatcttttatttatttattttagttggcaaataaaaattgtacatatttatggtatacaacatgatgttttgatacacacacacacacacacacacacacattgttnaatgctaaatcaagct

SEQ ID NO: 26939 - DNA, 175 bp, Homo sapiens
  D4S2941
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(175): n = A,T,G or C
tgtgtatacctaagaaatgcaaatnttnctgtggcaagtnatatctcantaaacccgacttacacacacacacacacacacacacacacacacacacacacaataacaacaacaacaactgtttttcaacaagttgagatgagtctgtattagaaacttgttctacgccaggtac

SEQ ID NO: 26940 - DNA, 111 bp, Homo sapiens
  D4S2957
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(111): n = A,T,G or C
tggggaagtcaggcatacacacacacgcctgacacacacacacacacacacacacaccacccatgcgcagggcaggtgctagtacanaggtgtttacaacgtgctgagggg

SEQ ID NO: 26941 - DNA, 189 bp, Homo sapiens
  D4S2964
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(189): n = A,T,G or C
aagctaagacccaacttctttctgaagctttatcttccttcccaactcacacatgnacacgcgcggacacacacacacacacacacacacacactctaaatacatatacactgcctnactctttcanttgtgcccatgctataccacaaagattctaaaattgaggttaagcctgtgtggattgcatga

SEQ ID NO: 26942 - DNA, 227 bp, Homo sapiens
  D4S2966
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(227): n = A,T,G or C
gaaggctccaccaatagtcctgcctgcaaggacaccaaattaacaactatctacacacacacacacacacacacacacaccttcaaaaggaccaaaattcaagtgagnactcatagtacctggttttaacttcctatcactgaaaaaggcactgaagagttagaaaaaagtaatgaattncaaacaccacctctccgctacccctcgcagcagcagtatggtgccta

SEQ ID NO: 26943 - DNA, 111 bp, Homo sapiens
  D4S2977
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(111): n = A,T,G or C
tgcactccagcctgggcgacagagcgagactgtntcaaacacacacacacacacacacacacacacacacacactcagttctaattggctcctagtcacacacattttaca

SEQ ID NO: 26944 - DNA, 253 bp, Homo sapiens
  D4S2997
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agatcgcgccactgtactccagactgggtgacagagcgaaactttccccccccccaaaaaaaagaaaaacaaaaaaatactgtattactatagcccacttttcccttatggggatctgtgtaaaacatttactttttacacacacacacacacacacacacacacacacacacacacatatatatatgaggagaacatagccttgcctcttaataaagcctaattttggagaagagtggcaattccctgtgta

SEQ ID NO: 26945 - DNA, 174 bp, Homo sapiens
  D4S3010
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ctgtgattttccaggtccctggagggtgccataaaggctactgaagggaaggcccaattttctgcagtttgatgtctaaacaaccacacacacctcctcccccagtacacacacacacacacacacacacacacacacacacacacacacatacacaccccaaacaggactttt

SEQ ID NO: 26946 - DNA, 152 bp, Homo sapiens
  D4S3027
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(152): n = A,T,G or C
ccttgcatcatcaatgttttcntctatacctgatacacacacatacatgcacacacacacacacacacacacacacacacacaccttttttcattcatcctcagtgacatcctacttggtttacttcagaactcaccagatagacccattca

SEQ ID NO: 26947 - DNA, 113 bp, Homo sapiens
  D4S3035
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(113): n = A,T,G or C
cacagatcaggatgctcagaaaacaccaactatggtaaagnttaancacacacacacacacacacacacacacacacacacaccacataaaaacattgtactaaaactgtgga

SEQ ID NO: 26948 - DNA, 169 bp, Homo sapiens
  D4S3039
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(169): n = A,T,G or C
gacagcctattgtagtaacttgtggncatgtaagttaattccttttnnactacacacacacacacacacacacacacacacacacacacacacacacacatctcctattagttatgtataactaanacatacatcctgttagatttgctcccctagagcaccctgacta

SEQ ID NO: 26949 - DNA, 131 bp, Homo sapiens
  D4S3041
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
aatccctaggcaaataccatatttcactctgtgttcttcaaatactcacacacacacacacacacacacacacacacacactcttaagtgatggtaacaatagaatatgatgtagtttcagccactcaaga

SEQ ID NO: 26950 - DNA, 163 bp, Homo sapiens
  D4S3044
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agctcatgattatgtaaaccatggaaattttgtttcaggaaaaatcaaagagagttctacttaatatactggaagacgaacttggagaactcacacacacacacacacacacacacacacacacacacgcatatcccaaactcccagggtggatggagcaaga

SEQ ID NO: 26951 - DNA, 236 bp, Homo sapiens
  D4S3047
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(236): n = A,T,G or C
agaaggcccttgaagtgatataaacatagttggcagtaaaaaaaaaattataattaattgcccagggcaggtnacacacacacacacacacacacacacacacaccctaataaaacagaaatcagaaactaatgattttattttcnctttaatttttttcattttcacattttcattttgttttaaaaattttacttttttcaatataagnagaattaataaccgacctgtcgtca

SEQ ID NO: 26952 - DNA, 129 bp, Homo sapiens
  D4S395
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tactccagcctggatgacagagaccctgtctcaaaacacacacacacacacacacacacacacacacacacacacacacacacacaccaagttgtataatttaaaatataacgtgcttgttatggaaca

SEQ ID NO: 26953 - DNA, 289 bp, Homo sapiens
  D4S405
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
atcaggagatgttgccttgcccttttactctttactgagtccagttacccaatattgagatgatactacagtggcttctccatttggagatatcttcctttttatgtctctctttgcaaaatacacacacacacacacacacacacacacacacacacacacacctctctttttcagaattaaacacagaaggcttttccacctctaataaaaaggagatgtattggcattttattacctctcctgaggcagaaatgattggcagtgatgacatccaatcatagccctg

SEQ ID NO: 26954 - DNA, 142 bp, Homo sapiens
  D4S413
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(142): n = A,T,G or C
tctgaatatagtgctccagaaacagaaatgaaacacacacacacacacacacacacacacacacacacacacacacactaaactnagaaaaatttccacatttgaaaggcaagagtttccagattcaaaaacccactgattg

SEQ ID NO: 26955 - DNA, 189 bp, Homo sapiens
  D4S426
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(189): n = A,T,G or C
atacactgcatccatatatacaaggnggcagtgaatacttgaaattgtctgagacagtagancttnggtgtcctaaccacatacacataatacacanacacacacacacacacacacacacacacacacagaggtaactatgtgtgatgatgattgttaaataacttgactgtggtcatttcacaatgt

SEQ ID NO: 26956 - DNA, 119 bp, Homo sapiens
  D4S430
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(119): n = A,T,G or C
taaccctgtatatgttaatgtgcatatgtaagtccatgnacacacacacacacacacacacacatatgaacgttcaaaagtatttctgagtcttggagaatcatagcaagactgggtcc

SEQ ID NO: 26957 - DNA, 254 bp, Homo sapiens
  D4S432
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
actctgaaggctgagatgggagaatgaattgaggccaggagtaatttgaggctgcagtgaactatgattgtgacactgcactccagcctggactgcagagcaagaccctgtctcttatacatacatacatacacacacacacacacacatacatacatacatacatacatacatacatacatacatacccaggctctacctccagtgattctgactcagtagggctgggtatcccctggggatctgcggttcag

SEQ ID NO: 26958 - DNA, 243 bp, Homo sapiens
  D5S1509
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(243): n = A,T,G or C
tagggaaggagtggttagagccatatgcaagatgaaaaaccatactatttgttgacctgtataattttgtttaggacaagattggtcnctccctccctcccttccttccttccttccttccttccttccttccttccttcctnccttccttcctncgttcctntnttctttttctntctgnttcatatttnttttcatataagcaatggggaatttattggcacatgtaaatatccacagtga

SEQ ID NO: 26959 - DNA, 264 bp, Homo sapiens
  D5S1981
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(264): n = A,T,G or C
cctgtaccaatccatgcngtcctggacaactggtgtccgcaacacacacacacacacacacacacacacacacacacagagacacatacaatgcaccacacacatctagacacagacacacactacacataatatagacacacacacctcatatgccatacacacacatatacacacatcacactatagacatatacacataccacacagcacacacatagacacacacacggacacacacaggcgtggacactcacatggctc

SEQ ID NO: 26960 - DNA, 176 bp, Homo sapiens
  D5S2002
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(176): n = A,T,G or C
cgtacataaaagacccaggcctcctnttttgaganccactgangtcaaggttttcatttatttgccttctctgagtacacaggtttnctgattctntctctccccacctngncacacacacacacacacacacacacacacacacacacacacacaatcactcagcatttgctttg

SEQ ID NO: 26961 - DNA, 113 bp, Homo sapiens
  D5S2036
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(113): n = A,T,G or C
gaaacctcacaatagcaccattgtcttcctatataaagacaaagagtgaaaaactaaacaaatacacacananacacacacacacacacacaaaatcttaggcatgggacagc

SEQ ID NO: 26962 - DNA, 218 bp, Homo sapiens
  D5S2038
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(218): n = A,T,G or C
gcctccttggtactacaagactntggnctggagtntnttgctggagtttgacatgggttcaaatcttgcctttgccattnatnagctttgtaaccttgggcaaatttctaaatctnaaagacacacacacacacacacacacacacacacacacacacacacacacacatttatatttatttaattaatgcagtatctggcatattcaagcaggagct

SEQ ID NO: 26963 - DNA, 215 bp, Homo sapiens
  D5S2045
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(215): n = A,T,G or C
cagagacagtcatttcacagaagagaccgtgaaaggaagagacacacagagaaagatacggatgtgaggcaaagagaaagaggatggagacangtgcacgcgtgcacacacacacacacacacacacacacacacacacacacacacacacacaaagggacatacagaaagaggctgagagnacaaaagggaaaggccaagcaagtatggggctg

SEQ ID NO: 26964 - DNA, 177 bp, Homo sapiens
  D5S2070
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(177): n = A,T,G or C
cctgggaggtagaggcttcantnagccaacactgtgccacagccctntggctggggtgacagagcaagaccccatctgaaacacacacacacacacacacacacacacacacacacacacacacacacacacaaaactnatgaaatttaaatatagtatggcgtttagttaatgaaa

SEQ ID NO: 26965 - DNA, 197 bp, Homo sapiens
  D5S2106
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
acatgcacatacaaacctatacctatatatagacacacccttgtaactacacacacacacacacacacacacacacgtatgtacctatctattcttctatttatacacctttccatcttactatttttatgtcatcctattaattttgtaaggtatggattgtaattaaaataagaatgttctaacttgcttcactg

SEQ ID NO: 26966 - DNA, 211 bp, Homo sapiens
  D5S395
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcagatggaaaacaccacttctttcaccttttctgtcatatggacatcacacacacacacacacacacacacacacacacacacacacacacacacagacacacccgtcagccatctttgttccataacaacatgttttgctcggtctccacagtcctgcctctgctgctgactttgttcctttcctccctgtaatcttccagcagcaggt

SEQ ID NO: 26967 - DNA, 161 bp, Homo sapiens
  D5S665
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agctttcagagattcaaacatattcagagatctttatcacatatgcacctgctgggccctgcaaaacacacacacacacacacacacacacacacacacacacacacacacgttttaatctccagagaggataggagcagagaccaacactggcacttaga

SEQ ID NO: 26968 - DNA, 201 bp, Homo sapiens
  D6S1050
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(201): n = A,T,G or C
cacacttctgcaaagcaatgattgtttagataaatacatagataataggtaggtaggtagatagatggagagatagatgatagacagatagatagatagatagatagatagatagatagatagatagatagatagggcatatacnccnaagnantnatanattcattctatttataaaggcacatgcacatatatgttcct

SEQ ID NO: 26969 - DNA, 291 bp, Homo sapiens
  D6S1555
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(291): n = A,T,G or C
agccaatgcccttaaaagacttgcagttagaaaacaagggaatgnccatatacctgaataattttaaaaagtattggctgcnaancattttttaaaanncctttcaattataaagatatccatctctgctagtaataacacctttgaagaagagagagatgcacacacacacanacacacacacacacacacacacacatacgcacacaaactttaaaaagcactatcatctttaccccttctcttaggggnaaagnagccccnagagttcaatttgtagcttttgttcat

SEQ ID NO: 26970 - DNA, 243 bp, Homo sapiens
  D6S267
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(243): n = A,T,G or C
agaggtagcttagaatgtgctcttcccaaacttctaattattttgtaaacatatattttattgaattaaacccatttttcttaacatacataagtgtgtatatttatgctttngaatgttaatacttggtcttattttaagatgctttgttaaaatgctatatggacataggaattacacacacacacacacacacacacacacacacacacacacaacaagntttgcgacattctttgtcta

SEQ ID NO: 26971 - DNA, 200 bp, Homo sapiens
  D7S2416
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(200): n = A,T,G or C
aaaactacatacctccacggnaaacctaacattactagttactatgtacatgccttacaactacatcagacctcaaaaacgccatagataccacacacacacacacacacacacacacacacagagggnncatatatatgtacatatttgtgcacatacatattnaaaaaantcagaattccccagaatgacttgtaaaa

SEQ ID NO: 26972 - DNA, 242 bp, Homo sapiens
  D7S2448
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(242): n = A,T,G or C
ctggaatcacagcctcatnaaacacacacacacacacacacacacacacacacacacacacatacacacacaccccacacaccccagcaacaacccaggtgcctacacacacacacacacacacaccccagcaacaacccaggtgcctacacacacacacacacaccagcaacaacccaggtgcctatagtcccagccactgggaggctgaggnagaagcatcgcttgaggccaggagttgg

SEQ ID NO: 26973 - DNA, 240 bp, Homo sapiens
  D7S2517
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(240): n = A,T,G or C
agtgaggctgctgctcaagagaggcacgggacaggtcccagaatatggtacgtttcacgttttaattcaccctnttgctcttccttctgtgaaccataaatgcttatggttattnataaaactacatcagttntccacttctaccnaaatatatatttngctatcantaggtatatatatacacacacacacacacacacacacatacacacacacacgtatgtttatgcccaggggaat

SEQ ID NO: 26974 - DNA, 101 bp, Homo sapiens
  D7S2563
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcttcaggcattcaccaagagaggcaagaaatcacacacacacacacacacacacacacacacacacacacacaatgcacatataggccctgtcacgggaa

SEQ ID NO: 26975 - DNA, 222 bp, Homo sapiens
  D7S635
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(222): n = A,T,G or C
ccaggccatgtggaactgtgagnccattaagcctctttttcttcataaattacccagtctcaggtatgtctttatcagcagcatgaaaacanagtaatacaattggtgtccttaggaaaagaatgcagagacacagtgnagagatacacacacacacacacacacacacacacacacacacacacgcgatgatttcagtntnactgacgcaagccaagaact

SEQ ID NO: 26976 - DNA, 148 bp, Homo sapiens
  D8S1078
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(148): n = A,T,G or C
aggcgcgttttcattaganttgctattccaggaaacacacacacacacacacacacacacacacacacaaagaattgttatttccaagagaagtcaggaatataacagcagttttaaaagggaggtgtgtgggtactatgatggatgg

SEQ ID NO: 26977 - DNA, 275 bp, Homo sapiens
  D8S1178
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(275): n = A,T,G or C
agctacttggnaggctgagatgggaggntcacttgaccctaggagtttaaatncagcctgggcaaagtaagactatgtntctncaacacgcacacacacacacacacacacacacacacacacacacacatctatatgtatataataatatcagatacttaaacaactttagttcaaaatatgaggacatttttagttttgtagtttttcttttctttttccattccttgttctcttcccccttttagaagcaggaataacccattcccaatgtt

SEQ ID NO: 26978 - DNA, 92 bp, Homo sapiens
  D8S1716
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(92): n = A,T,G or C
agctcatcccctacaaactcatctagcaacacacacacacacacacacacacanacacaatttttccttctaacaaatgtttgtgttcctta

SEQ ID NO: 26979 - DNA, 257 bp, Homo sapiens
  D8S1733
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cacagtctcaaactcctgggcccaggcaatccttctgccttagcctcctgagtggctgggactataagtgttagccaccacacctggactagtttccacaattttttgaacacaactcacagttagaaatacctttgatatcacaactcacacacacacacacacacacacacttatacttgaaataaaagtttgacacagtatgtgtgcagtgcactctgatattttctattatgttcttgttcatggtttttcgt

SEQ ID NO: 26980 - DNA, 192 bp, Homo sapiens
  D8S1753
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(192): n = A,T,G or C
tgcatttccatttgcagaagtaactatagaactgaaagtcaggancagaaggtcgcaatgtcaccagatgacatggcctctgattggacccctaggcccctctacacacacacacacacacatacaaacacacacacacacacacacacacacacacacagagcactgcctctttcccgagtcactctgtgg

SEQ ID NO: 26981 - DNA, 260 bp, Homo sapiens
  D8S1770
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agcttcagaatgggacttgtattcataatatgtaaagaactcctacaagttaataagaaaaaggtagaatgtccagtagaaaatggataaaagatgtgaacccagaaaagtatatccaaggggtaggaaacatataaaatgttggtcacgtttactaggcatcagagaaatgcaaattaaaaccagaaattgatacaaatacacacacacacacacacacacacatacacacacaccaattctagttttgaaaaagtagc

SEQ ID NO: 26982 - DNA, 231 bp, Homo sapiens
  D8S1796
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(231): n = A,T,G or C
agccagtgttttccatcctgagaacagtttgtccaaatggcaacccaagcagaagcacacacacacacacacacacacacacacacacagacananaatttcagctanctttgctgctgtgctttgtgctgtgtgtgtcccagtaaatttcatgtgtcggaacttgaaacccaaggtgatggtattataaggtagggtctctgggaggtgaataggctgtgaagatggcac

SEQ ID NO: 26983 - DNA, 144 bp, Homo sapiens
  D8S1841
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(144): n = A,T,G or C
aaaaatggtgacaatggtgtactctatgttatgtatttnaacacacacacacacacacacacacacacacacacacacacacacacaggatcagatcatatcattcctttccttggaaacttccagtggtttcccatcacaccc

SEQ ID NO: 26984 - DNA, 217 bp, Homo sapiens
  D8S269
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(217): n = A,T,G or C
cacccagccatgaaaactttttaatacacacacatacacacacacacacaaacacacacacacacacacacacacacaaagcaagagcaagcgagaaagaaatctataccttactaatcaggtttnctactagttatgatggaggtgtagcagtcactnttttctcagatagcacagatgactcctgattcactcatcctgtggggagacactctca

SEQ ID NO: 26985 - DNA, 112 bp, Homo sapiens
  D8S281
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(112): n = A,T,G or C
ctcttcaggccaggggttcaagaccaacttggncaagatagtgaggcatcatctctacacacacacacacacacacacacacacacacactagcctggtgtggtggcataca

SEQ ID NO: 26986 - DNA, 130 bp, Homo sapiens
  D8S519
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ctgtcaccccagcgtccctggactgacttcatacacacacacacacacacacacacacacacacacacacacacacacttctgtgactgcttgacgtgggggcattgcaggtgggagcagaaaggccact

SEQ ID NO: 26987 - DNA, 189 bp, Homo sapiens
  D8S520
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(189): n = A,T,G or C
ctgaagagcaaatggccctgggaagtattcctttagggttacacacacaccacacacacacacacacacacacacacacacacacacacacgaaaatctctaaagagcaatgagcatagcagcctggatggtgctcatccaaggataagtctccagacaaatagcacancagggggccatgtgatctta

SEQ ID NO: 26988 - DNA, 118 bp, Homo sapiens
  D8S531
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ttaggctggagtcctgacctttttaaggtcagagccattatatatatttacacacacacacacacacacacacacacacacacacacggtgtagtcccgtgaaagtgacaatgttccc

SEQ ID NO: 26989 - DNA, 171 bp, Homo sapiens
  D8S554
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tttccagacagggcctaaagagagcagaaggtttcacagtgacataaattcccccaagactgtcctagagtcatagatggcatgaccagcatcacacacacacacacacacacacacacacacacacacacacacactcatatgccaaacttaaaggatgtcctgtgcatt

SEQ ID NO: 26990 - DNA, 146 bp, Homo sapiens
  D8S560
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ggcatttcagaggaccgcttccaaatgaggcctggtagggacacagtttagagaacaacagaatcatcctcccacgaccccccaaccaccaccaacacacacacacacacacacacacacacacacaatctgagcccatctttgca

SEQ ID NO: 26991 - DNA, 140 bp, Homo sapiens
  D9S1779
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(140): n = A,T,G or C
ccctgccaggtgtgcatctgagtgtggtttctattcttcatcaccctctacacacacacacacacacacacacacacacacacacacacacacatccgtcttgtgtttttnngtgggctcagagccacgagggagcctga

SEQ ID NO: 26992 - DNA, 186 bp, Homo sapiens
  D9S260
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(186): n = A,T,G or C
tcattctcaatagcccactgagtttaaaataaaaatattttaaaatatttttcctacagactatttnctgcccttnagatgcctataaacacacacacaaacacacacacgcgcacacacacacacacacacacacacacacacccattcacctctacaaacttcataacgcagaactggttatgc

SEQ ID NO: 26993 - DNA, 179 bp, Homo sapiens
  D9S283
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tgctggatttcaggtagggatgaccagatcctcatcccgggaaatgaaaccagtgttctcccagttcttcaggcctggaacctagactcctccctctctctgcagtcttcttatctgcccaacacacacacacacacacacacacacacacacgcagagaaatacacccgcataaccat

SEQ ID NO: 26994 - DNA, 194 bp, Homo sapiens
  DXS1049
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cgagatggtgctactacacgcacacacacacacacacacacacatacaagtcaagactatgttcacaaatcaatggagatcagaatagtggaactttctgatgaacacaatttttataccattatctgatttgttctattttgttatttacctatgatgtattctttatgtgtacaccgagttttagcttgatg

SEQ ID NO: 26995 - DNA, 155 bp, Homo sapiens
  DXS7105
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(155): n = A,T,G or C
gatacccaactctacacatgataaaactacatagaactaaatagagtatacacacacacacacacacacacacacacacacacacacacacaagtacaggttaatttgggnaattttgaataagtttggtggattatatcaatgtcaatatcctg

SEQ ID NO: 26996 - DNA, 174 bp, Homo sapiens
  DXS7107
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(174): n = A,T,G or C
tgagaatcgcttgagcccaggaggcanaggctgnagtgagccgaaattatggnactgcactccagcctgggcaacagagcgggactccattttananacatanacacacacacacacacacacacacacacacacacccgcaatcacttttgcaccaacctagtataattgggg

SEQ ID NO: 26997 - DNA, 227 bp, Homo sapiens
  DXS7592
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
aggcaattcctagtggctgtgaagaagtagataggagcctgctaccccacttatcacacacacacacacacacacacacacacacacacacccctacacacctgaatttttaccctttctacttacaacactggtatttgtgggttttggttttgttttgttttgtttttgatgtagtctcgctctgttgcccaggctggagggcagtggtgcgatctaggctcaat

SEQ ID NO: 26998 - DNA, 223 bp, Homo sapiens
  DXS7593
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(223): n = A,T,G or C
gatcacacgattgcactccagcctgggcaacaagagtgaaactctatctctctctctttcgntctctctctctctctctctctctctctcacacacacacacacacacacacacacacacacacaaaggccttctgctcttaaatataactctctttcccagtcgcatccccacactatttacttaggatggaaactctcttnaggagggtaagccattcgtt

SEQ ID NO: 26999 - DNA, 149 bp, Homo sapiens
  DXS8017
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(149): n = A,T,G or C
agcttaccactggggtgaggatctgggtgtttncttgtctncttcaaatacatttctctgtgtttaaacacacacacacacacacacacacacaccccaggtcccactatgaacttttccacattcccccattaagagcgtgtcctgaa

SEQ ID NO: 27000 - DNA, 261 bp, Homo sapiens
  DXS8046
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(261): n = A,T,G or C
ggaacagcatcatcaaaggctcaaggataatggaaagtaagtgcatcttgccccccaccagtcaattcagatcgtggtttgtggttggtttggttttgtttaaaggaagtccgactctgttccaaacaccangnncatntaanctaaanggntctatccaaaatctaaaaggcagtcttgccagttgctatggcccataatgcacacacacacacacacacacacacacacacacacanangggctactttttgccattta

SEQ ID NO: 27001 - DNA, 243 bp, Homo sapiens
  DXS8049
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(243): n = A,T,G or C
tcccccagtaccccatgaaggtttcatttttaaaagaataagtaagatattactttnaaacacacacacacacacacacacacacacacacacacacacacatacacaccctcgtcttagtctgtattgtgctgctgtataacagagtattacagactgggnaatttataataaanaaatgtattggctcatggttttggaggctgggaagtctgagattgggggattgcatctggtgagggc

SEQ ID NO: 27002 - DNA, 96 bp, Homo sapiens
  DXS8062
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(96): n = A,T,G or C
atgtctacccacctgcttgctacccaggtgnacacacacacacacacacacacacacacacacacacacacacnacccgccagcaggccagggatc

SEQ ID NO: 27003 - DNA, 145 bp, Homo sapiens
  DXS8065
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gagcgacaccctcgttgtctctctctctctctttatatatatgtatatagatagatatagatagatacacacacacacacacacacacacacacacacacacacacatctatatatgtatttgaaattcattatgtgccagggat

SEQ ID NO: 27004 - DNA, 241 bp, Homo sapiens
  DXS8086
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(241): n = A,T,G or C
gacacataattgtgtattagccagggntctctagataaacaaaaccaataggatgtgtatgtgtgtatatatgtatatacattgcattccctctgggcctcacacacacacacacacacacacacacacacacacacacacagaaagagagagagagagagagancgagatttttttttataaggaattggnttatgcaattatggaggctnacaagtcccnngatctgcagggtgagtca

SEQ ID NO: 27005 - DNA, 164 bp, Homo sapiens
  DXS8090
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(164): n = A,T,G or C
gggtgaaattccatcacaaaacacacacacacacacacacacacacacacacacacacacacacacaattccatcacaaaacacacacacagacacacaccaaacanacaaacnaaaaacttcctcaataagtgaggagatattttttgtacatctgcatttgt

SEQ ID NO: 27006 - DNA, 175 bp, Homo sapiens
  G07809
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
caagatgaactttgggttgggacacagccaatccatctcagatagataggtagatagataaatgacagatagatagatagatagatagatagatagatagatagataatagatagaatatttttttaaatattaagtattacattttaaaaataggatcttagtggtcacagtgg

SEQ ID NO: 27007 - DNA, 154 bp, Homo sapiens
  G07839
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agctaaagcagggcataggtagtttggtaggaagatgatcagatagatagatagatagatagatagatagatagatagatatggttacttagaacttgatattctatattatgacacattaatattaatccatcttaatttccaccaccaggaa

SEQ ID NO: 27008 - DNA, 165 bp, Homo sapiens
  G07886
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(165): n = A,T,G or C
attcttctcccaagaatgccaaaaacaaagaaaaggnaaggaaggaaggaaggaaggaaaggaaggaaggaaggaaggntngnnaggnngggantganngnnaggnganacgtaacagggcatggccgctggaagcactctagcacttctacctcttgagacttg

SEQ ID NO: 27009 - DNA, 241 bp, Homo sapiens
  G07912
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(241): n = A,T,G or C
ggctttgcatccagaatttagatttnggatatttnaccatttatctatctatctatctatctatctatctatctatctatctatctatttatcatctatctatccatcatctatctatctatctgtaatctactgacatctatctatccatctaactatctatctactatggtgtggtttgtttgcgcaccccctgccccacaacctcatgttggaaattggaccctcaatgttggaagtg

SEQ ID NO: 27010 - DNA, 214 bp, Homo sapiens
  G08005
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(214): n = A,T,G or C
ctgtacatccatagggctggtttccgtcttgagaagtcatgaggtggacttaccacaggcaatgtgnncttgaggaagagagaaatagagagatagagatgatatacatagatagatagatagatagatagatagatagatagatagataatgataaatcaggaatttaattagctgagtgactnagatgggaatagtgaagtctaactgggtt

SEQ ID NO: 27011 - DNA, 246 bp, Homo sapiens
  G08008
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(246): n = A,T,G or C
agcagtgccacttgtctttctataaatcagcatatgtgaagatctataagtggttctgagataaagcttactcaattctgtcccactaagaaggtggcacaggnccttggtcatgcctgtatctatcactgcatgtgcatatctatctatctatctatctatctatctatctatctatctatctatctctgtctatctatccatccatcctgtgtttcttttccagaagattttgtagctttagag

SEQ ID NO: 27012 - DNA, 253 bp, Homo sapiens
  G08012
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(253): n = A,T,G or C
cagtgctttggctatatctatctatctatctatctatctatctatatcgacatatatatatgatgatataaatctatatccatctctctatatctatacatagattgattgatcaatcgatctacctacctacctacctgganatatatattgaagccaagggaaggttatttaacttttccaaggtcacacagctangaaatggaaagccaagattcccactcctttgaagctagtgcccttttctaggtta

SEQ ID NO: 27013 - DNA, 136 bp, Homo sapiens
  G08053
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ggtaccagagcaacaccttgtttcaaaacaaactatctatctatctatctatctatctatctatctatctatctatctatctatctatctatcctttagccagcttgcgggcaagggtagggggattttcctttat

SEQ ID NO: 27014 - DNA, 195 bp, Homo sapiens
  G08164
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(195): n = A,T,G or C
tctccaaagaaacagaacggatagggtagacgatagatagatgatagatagatagatagatagatagatagatagatagatagataggaatttattatgggaattggctcacatncttatggaggccaagaagtctcacagtctgctgtctncaacctggcgaaccaggaaagcctatagtgtgatagagcctga

SEQ ID NO: 27015 - DNA, 195 bp, Homo sapiens
  G08288
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(195): n = A,T,G or C
ggaagtgtgaaagcctctgagctcattaccatggacctgctgtcagtcatttatgtgttcattnatttgtccagggtcaggcaaagtccaatgctcagacttgtgggtgcttcagatagatgatagatagatgatagatagatagatagatagatagatagatagatagataacttctcccctctctcaaggagt

SEQ ID NO: 27016 - DNA, 274 bp, Homo sapiens
  G08387
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(274): n = A,T,G or C
ccccacttatgagtgcaaacatatatttggtgtcccattaataagttacttcacttagaataatggtctccaatnccatccagnttgctgtgantgccatnaattncattcctttttatgngctgtgtagtattccatgggtattatatatgtgtngtggtntgtggcntctantcggtggnctggnctatctatctatctatctatctatctatctatctatctatctatctatctatctaccacattttctttatccactcattgggtgttg

SEQ ID NO: 27017 - DNA, 118 bp, Homo sapiens
  G08458
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(118): n = A,T,G or C
tccaactcaccagtatagaatcataaataatgtgaaaatctaaatctatctatctatctatctatctatctatctaaaananaagntnaacngctaccttagggagctaccattctaa

SEQ ID NO: 27018 - DNA, 154 bp, Homo sapiens
  G08694
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ctttgaatggtatttcaatgtcctatccagatagatagatagatagatagatagatagatagatagatagatgatatatgtttgaccttgttttaagcgtaggtttcattattattcaggtatagtgaggtcaatagaccaggagatgactgcc

SEQ ID NO: 27019 - DNA, 220 bp, Homo sapiens
  G08709
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(220): n = A,T,G or C
tatatcttgacccttctcattctgagataggtaggtagattagatagatagatagatagatagatagatagatagatagatagatagacagatagatagataaagcacagagcttttccaaacgtttctcacctagatcacataatccaagatgtctttcaatacttactactgatttacttacgtttgtngctttatcctcaggatcttcctcagcatc

SEQ ID NO: 27020 - DNA, 238 bp, Homo sapiens
  G08758
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(238): n = A,T,G or C
tactttgagcagcaggaggtgaagaacctaggggcagntaccataactcattttctaaagatattctaaaatgtaaactcacataccgataacatgattcctgcccatctatcattcatctatgtatgtatgtatgtatgtatctatctatctatctatctatctatctatctatctatctatcatctgtccatctgtcatctatcatcatgaaggcagagtgaccacaaaatccagg

SEQ ID NO: 27021 - DNA, 208 bp, Homo sapiens
  G09192
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(208): n = A,T,G or C
aaatgactgggccaatgtaacgtggtcaattaatggcagagtggtgattcaacctcatgcttagatagatagatagatagatagatagatagatagatagatagatagatagttggatatagatataaacattttttttttttttcnngagacagagtcttgcttttgttggcccgggctagaatgcaatgttgcaatcttggctcac

SEQ ID NO: 27022 - DNA, 216 bp, Homo sapiens
  G09201
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cccagagtgtccagctctaagacagcctgtcctgggacttctcacctccaccatcacatgagccagtgctcctattgaatatcctctttccatccacctagttagctatctgtttgtctatctatctatctatctatctatctatctatctactctaagacaggctgtcctgggacttctcacctccaccatcacatgagcccattctcctactga

SEQ ID NO: 27023 - DNA, 98 bp, Homo sapiens
  G09261
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ttggtgtttactacagccaggcagtcagtatatcatcatcatcatcatcatcatcatcatcacgtgtacttaatggtcactacttaaagggcttacat

SEQ ID NO: 27024 - DNA, 233 bp, Homo sapiens
  G09578
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(233): n = A,T,G or C
atggtcttctattcataaagacaggtagatagatagatagacagacagacagacagacagacagatagatagatagatagatagatagattatatatatatatgnccatttcataaatntnatatattttttcaagaatatatgtaagactatttcacacacacacacacgattctgccagctttaatggcaggtatcagctctcaattaactatctcccagctctctggaat

SEQ ID NO: 27025 - DNA, 120 bp, Homo sapiens
  G09596
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
actcgatgatagataaattgatggatgatagatagatagatagatagatagatagatagatagatagatagatgagacatagatagtctcaagtacccattacttaccacccttgagggg

SEQ ID NO: 27026 - DNA, 245 bp, Homo sapiens
  G10053
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(245): n = A,T,G or C
gactactgagtttctgcaatagtgtcnttaaatatatatatagtattatatatatagngtnanntatatatagtnttttagctagatagataggtagatagatagatagatagatagatagatagatagatagatagatatagtgacactctcctnaacccagcnggcctcctnntnctcactacatggccatggaccgacgtgttcntcctggtgncccaggcactatttccaggtgcagtgct

SEQ ID NO: 27027 - DNA, 174 bp, Homo sapiens
  G10088
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(174): n = A,T,G or C
tacagggtcatccaagttggcgcaaatgtcgtgactacctaaattccataatgctggatagtattctatctatctcactatctggctatctatctatctatctatctatctatctatctctctcgctatcatgaatctgncgttataccncnctggacacttaggtgtgatcct

SEQ ID NO: 27028 - DNA, 296 bp, Homo sapiens
  G10107
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(296): n = A,T,G or C
caccctgtcatggacttctcaatctcnatagttatatcagcnaaaccctttantaaatnccctttnaaaaatctatctatctatctatctatctatctatctatcatctatctatctatccanccatcctgtnagtnctgcctgnctngagaaccctgaataatacagagagagagaaancaatnacaacagagactcactgcctgtaaaacaattacaaattgtctaatactatgtgtaactagagtttaatattaagtataactggaaagggagagatacagaaatatgtatgg

SEQ ID NO: 27029 - DNA, 129 bp, Homo sapiens
  G10118
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcctgtaatctggtgtatttcgaaggtccgccctatctatctatctatctatctatctatctatctatctatctatctatctatacctattggctacctatttctaaagggtagtcctgaccagttcat

SEQ ID NO: 27030 - DNA, 381 bp, Homo sapiens
  G10119
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(381): n = A,T,G or C
ggaatagtaagctctggggctctggtttgagataaaaacatgtgcacgaccatttcttattcatgtttacatccncttccncagaaatagatgccttatnttagcgaatatctatctatctatatctatctatctatctatctatctatctatctatcatctatctatctatatctctatctatgatataaancgctgggctagagagagcaaatatgntacagancagnatcatnagaaatgttaagttcttagtacgtttaaatagacacaatgacaaactagaatatgtgtcagggaatataggtccctgttactagaagtgtttcagnagatgctagacaaccacttgacaaggatattgcatcatttagaggggac

SEQ ID NO: 27031 - DNA, 145 bp, Homo sapiens
  G10239
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(145): n = A,T,G or C
acttcctaagcatgaatttttacctatcatctatctatctatctatctatctatctatctatctatctatctatctaatctgtntatntatttctatataaggacagggtcccactgtgtcacacggcacaatcgttgctttact

SEQ ID NO: 27032 - DNA, 286 bp, Homo sapiens
  G12391
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(286): n = A,T,G or C
tctctgaagtaagtcaaacagaggaaggaaggatggaaggaaggaaggaaggaaggaaggaaggaaggaaggaaagaaagagggagggacggagggaacaaacaaacctgagaaatatgggatcatgtaaagagaccaaatctatgacacattggcttccttgaaagagagggagagaaatcaagcaaattggaaaacatatttcaggattttttccatgaaaatttctcctcactcactcctcactcactngagggggtcancattctattttcaggaagtgcag

SEQ ID NO: 27033 - DNA, 166 bp, Homo sapiens
  G12397
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ttcctcagaatgtatccccatcattaagggatacatgatagtgtgtgtgtgtctgtctatctatctgtctgtgtatctatctatctatctatctatctatctatctatctatctatctatctatctagatacagatatagcaggtcctcatttcattcagcgtcct

SEQ ID NO: 27034 - DNA, 224 bp, Homo sapiens
  G12399
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(224): n = A,T,G or C
cattgatcattgttgcctgatatgatgctactctgatngttgcaaaatgcttatttatctaacttgagcactttctgnacttttatcatacggcctttggcattctgctggaagaaagcgcccncttctttatctatctgatctgtctgtctatctatctatctatctatctatctatctatcacctattatctatcttatctttcaaatctatcttctggttt

SEQ ID NO: 27035 - DNA, 243 bp, Homo sapiens
  GATA
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tcgactcggtaccacttcctaggttttcttctcgagttgttatggttttaggtctaacatttaagtctttaatctatcttgaattaatagattcaaggtgatagatatacagatagatagatacataggtggagacagatagatgataaatagaagatagatagatagatagatagatagatagatagatagatagatagaaagtataagtaaagagatgatgggtaaaagaattccaagcca

SEQ ID NO: 27036 - DNA, 354 bp, Homo sapiens
  HUMUT1025
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(354): n = A,T,G or C
aagtttacggcacttttacagtatgttagaggactttggtgtttattttaaattagggatttcctaatatnccanntgagananctgagtttccacacggctaatctacttnctggaagccatagagangnccggaaggaaggaaggaaggaaggaaggaaggaaggaaggaaggaaggagggagggagggaaggagggaagggagggagagagggaatnggagggagggaatgggaggggatggagggagggaggtaatgggagggaaggaagggaatatatatatatgtatgcatggaatgagagtctgctgatggatttcctgaggattcttgcctccatatcccagtaga

SEQ ID NO: 27037 - DNA, 353 bp, Homo sapiens
  HUMUT1040
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
acttcacagcctccagaagggtgagaaaaaaaattatgtgctttatgaatttcccaatctcaggtattttgttatagcagcacaaaacagactaagataactctcctgtgtttcagattcttcttctggcaaatagggaaattaatatcttatttgtgagattttttatgaaaaatcagtcaataaatgtaaagcacttagaactattcctagaagacagtaattactctgagccatcacataataattaccatcatcaccatgaccatcagcagcagcagcaatcatcaccatcatcatcatcatcatcatcatcatcatcaggatattgaggctttctcaaggacttggaa

SEQ ID NO: 27038 - DNA, 245 bp, Homo sapiens
  HUMUT1207
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tcacacctcctacatttacctcatactgaaaactgatacttcaaatgatgaccctaagtccatttacaattacaataaaggagaaatggtccattttagattagatgattgattgatagatagatagatagatagatagatttttaatggcaaagtttgaaaagaaaattttctgattaaccttaaattatacaaaactgtaaagaaatagaacatccccaattcccaagcattgtaggaatcac

SEQ ID NO: 27039 - DNA, 118 bp, Homo sapiens
  HUMUT1211
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
agcctgggcaatagagcaagattctgactcaaaaaatatagatagatagatagatagatagatagatagatagatagatagatagatagatagataatgacaaaatgaccacagatga

SEQ ID NO: 27040 - DNA, 250 bp, Homo sapiens
  HUMUT1508
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(250): n = A,T,G or C
cctcagttttctctcctgcaaaataggactaaaaatagttcttaccccatatggatgctgtgagtatttaaagaaaaaaaaagaaagacgaaggaaagaaganagaaagaaagaaaggaagggagggagggaaataaaagaaagaaggaaggaaggaaggganggaagggaagnangntngnaagnnngcangnaaggaaggaaggaaggaaggaaaagaaagtaagtccctgcaaagcatatagcagca

SEQ ID NO: 27041 - DNA, 245 bp, Homo sapiens
  HUMUT1880
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ggtgggaggcttgctgaagcctaggagtaggaggtttcagtgaggcgaactgagacccctgaaggaaggaaggaaggaaggaaggaaggaaggaaggaagggagatagttcagctactgcaattaaaaatctttctagaatggagcctgtttgtcaggtagattccttttagaattgtttccagtctgtaagccctccctactccttccctaagtgacttcacgttcactgagaactgctggcta

SEQ ID NO: 27042 - DNA, 205 bp, Homo sapiens
  HUMUT2069
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(205): n = A,T,G or C
aggcagcagagtgagactctgatagatagatagatagatagatagatagatagatagatagatagatagataggatagattagatagatagatagatagatagatagatagatagatagatagatagtctcatcaggnctgccagaaantaactcacatgaagtttaactttaatgtcagttttttacgtgtggcctaagaaagc

SEQ ID NO: 27043 - DNA, 153 bp, Homo sapiens
  HUMUT216
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(153): n = A,T,G or C
tgacagagcgagaccctgcctcanaaaanaaaaagaaagaaagaaagaaagaaagaaagaaagaaagaaagnaaaagagtctgtatgtgtcncnagtgatatantttancntcatatctantttgtctgacattagtataaccantcccgttc

SEQ ID NO: 27044 - DNA, 366 bp, Homo sapiens
  HUMUT2314
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(366): n = A,T,G or C
ggtgacacagcaagactccatctcaaaaaaaagaaagaaagaaagagagagagaganaggnaggnaggnaggaaggaaggaagganggangganggaaggaaggaaaggaaaggaaaggaaagagagagaaaganaganagagagagagaganaggnaggnaggaaggnnagagaganaganagagaganaganagagaganaganaganaganaganagnnaganaganagaganagataganaganaaaganaganaganagaganagnnagagagaganaganagananaganaanngagcaaggctatgtgaaaaccttttagggaaggttggctgccagggtggctgctacccctactcca

SEQ ID NO: 27045 - DNA, 396 bp, Homo sapiens
  HUMUT2351
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ggtagaggctacagtaagctttggacgccactgcaccacagcctgggtgacagagtgagaccctgtctcaaaagaggaggaggaggaggaggaggagtaggaggaggaggagagggggagggggagggggaggaagaaagaaagagaaaggaaggaaggaagggaagaaaggaagaaaaaggaaggaaggaaagaaggaaggaaggaaaaggaaggaaggaaggaaggaaaagaaaggaaggaaggaacgaaagaaaaaagaaaaaaaaattagaaatatgtggcgccaaatagaccaaagatatagcggaacatggttctccgggcatctttgccccagatgtgggcagtcccctcccctgcaccactgcccctcctgtggctttctctcttctc

SEQ ID NO: 27046 - DNA, 150 bp, Homo sapiens
  HUMUT473
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(150): n = A,T,G or C
tcagagtcgatcaaaatatgtnacatctntggaatgaagaaacatgattngtgtgtgtgtgtgtgtgtgtgtatgnnnctgtgtgaaagagaacaacttccaacaaccatgtcatagcttctttctatagctgcttttcaaactcacatc

SEQ ID NO: 27047 - DNA, 295 bp, Homo sapiens
  HUMUT5180
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(295): n = A,T,G or C
ccagcatgagcaatgagagcaaaactccgtaaaaaagaaaaagagaaagaaaaagaaaagaaganagaaaaagaaagagagaaagaaagaaagaaaagaaagaaagaaaganaggaaggannnnggaaggaaggaaggaaggaaggaaggaaggaaggaaggaaggnaaanggaaaggaaagnaagngagnganngnatgaaaggnaanggaaggnaggaactatggtctgtgggcaataggncaaggacttggctgcncctgtttttaaatacctctcagtatgcacatcacct

SEQ ID NO: 27048 - DNA, 214 bp, Homo sapiens
  HUMUT5210
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(214): n = A,T,G or C
ccagcctgggcaacaagagtnaaactccatctcagaaaaaggaaagaangaaagatagaaagataagaaagaagaaagaaagaaagaaagaaagaaagnaaggaagaaaggnaganngtangaaagnanggaagaggaaggaagtaaagcaaatgaggtgacttctgataaatcacttagcacagagcagagacaggatgccaggagcaaggga

SEQ ID NO: 27049 - DNA, 397 bp, Homo sapiens
  HUMUT5217
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(397): n = A,T,G or C
gcctgggtgagagactctgcctcaaaaagaagaaagagaaggaaagaaagaangaaaggngggagggaaggaaggaaggagagggagagagagagaggaaagaaggaagggacggaaggaaaaggagggagggngggaggaaagatgagggaaggaagacngcnaggaaggaaggaanacaganaganaganagagacgnagananataganacgnaganananagaggaaggnaggnagnaagaatgagagagagatanntnnatnagnaagaaagaaaganagannnnancnnaaagaaggaaggaaggaaagaaagncagaaancnagaaagaaagaaagacananagaangaaanaaanacaaaattcactttcagctgaattttggggagtg

SEQ ID NO: 27050 - DNA, 207 bp, Homo sapiens
  HUMUT5253
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(207): n = A,T,G or C
caagtgccaggataggctccaaagctacacagagaaaccctgtcatggaaaagaaagaaagaaagaaagaaagaaagaaagaaagaaagaaagaaagaaagaaagaaagaaagaaagaaagaaagaangaagaaagaanaaaganagaaagaaaggaaagnnanctgcaaataaagcctcttgctgtttgcatcaacttccgcctct

SEQ ID NO: 27051 - DNA, 224 bp, Homo sapiens
  HUMUT5312
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(244): n = A,T,G or C
ggctgtgggatatcactagaaggcccatgaattttaaggcacttgctgaacgccgctgggccaggccctatcatggacctctcaccttccaaataactgcaggcacaggaccccaggactgnagagcaacttgtcaacatatttgctctntgtgtgtgtgtgtgtgtgtgtatgtgtgtgtgtcttgcggcacacacatgtgtgaatccctcagttttcccacc

SEQ ID NO: 27052 - DNA, 331 bp, Homo sapiens
  HUMUT5386
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(331): n = A,T,G or C
aggtcgatagtgctgtcccatagaaatattatatatgctatatacacaattttaaattttataatantgcttttttaaaaagcacnaagaaatagataaggttgatttaatcattccacaaggggagggagagagagagagtgtgtgtgtgtgtgtgtgtgtgggtgtatctcaaaacatcacattgtgcnccatacatatgtaaaattatgtatcaatttttaagaaattgacaaacagtaattttacgtatttatagtgtacagtaatatttgcccacatggatagaatgtgtaatgataaaatcagagtatttaggatatccagcacc

SEQ ID NO: 27053 - DNA, 356 bp, Homo sapiens
  HUMUT5414
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(356): n = A,T,G or C
gtagcctccctgccatttcctaagcaagttattcccatgcaggtaaagccttaatttttacctagtatgaaatgcatatataaattgtcaccaacatgcttagcatgttacaaagcattacaatggataaaaagatatagtaagtacaatgtgtgctgctcctnanaaggttataatctatttggaaaagtaaagataaatagatagatagatagatagatagatagatagatagatgatagatagatagatagatagatagatagatagatagatagatagagacagacagacagacagacacacngagagagacagagagagaatataattccaaggagctctggaccacaata

SEQ ID NO: 27054 - DNA, 207 bp, Homo sapiens
  HUMUT5980
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(207): n = A,T,G or C
gcttaggcacgagacttgtttgaacctggnggatggaggttgcagtnagtcaagattgcgccactgcactccagcctgngtgacagagtnagactctgtctctaaataaataaataaataaataaataaataaataaataaataaataataaaataataatagagtctagtgatatagctcagcttgaggatgggaaccagcataag

SEQ ID NO: 27055 - DNA, 96 bp, Homo sapiens
  HUMUT61
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(96): n = A,T,G or C
aaaanaatggatctctctgtctctctctatacaaacacacacacacacacacacacacacacacacagtgttactacttccccactactggcccaa

SEQ ID NO: 27056 - DNA, 112 bp, Homo sapiens
  HUMUT66
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(112): n = A,T,G or C
ggtagcaagcaggtaggacttgggtctagttttgtgtgtgtgtgtgtgtgtgagagagagagagagagagagagagagagattacagcctcagactttttttnnactggctc

SEQ ID NO: 27057 - DNA, 205 bp, Homo sapiens
  HUMUT664
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(205): n = A,T,G or C
tctttggaataattcccccatganntnaggtcaagangtatgcatgtgcgtgtntgtgtgtgtgtgtgtgtgtgtgtgtgttggtttattgctcatgaaagcagatttgaatttcttttaagagtgtagccaattctctcattatccaactcagtttcctttagagcctgctaaatcatggacatgctgctatgctaggcctccc

SEQ ID NO: 27058 - DNA, 250 bp, Homo sapiens
  HUMUT7035
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(250): n = A,T,G or C
agttgaaagtatggtatggtgactagaggtaatgatactgtattgtatacctgaaatttnctaagagagtagattttaaatatncccactctaaaacaaacaaaagaaggaaagaggaaaagaaaaaaggaagaaaggaagggaaggaagggaaggaaggaaggaaggnggaaggaaggaaggaagaaaggagggaagnaaggaaagaggaatccatttcctatattggccttgttaacagttgtggtgg

SEQ ID NO: 27059 - DNA, 176 bp, Homo sapiens
  HUMUT7162
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
ccccatctctacaataaatgaaaacattagctgggcatggtgatatgcacctgtatctagaaggaagatagatggtagatagatagatagatagatagatagatagatagatagatagatagatgatagatagatagatgtatatgtatagaaatatacatctctctccctctctc

SEQ ID NO: 27060 - DNA, 337 bp, Homo sapiens
  HUMUT7223
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(337): n = A,T,G or C
ggccaaaaaagcagattggnatcatgctttatgtgtgtccatnctagncctgcacgtgtngaaatgtaagttttnaatgtatggtaaggtagatagatagatncatacatacatncatncatacatncatncatncatacatataaacntgggtaagngggtactttnaatgtatggtangctatgattgccccactgcnttctagcctaggcgncanagcaagnccctgtctctaaaaataantncatnaataaatnaataaatananaaatatttgtaaaaggtatcatagctgtataaaaagnaaagactaaaaagaaagccactcaaattcca

SEQ ID NO: 27061 - DNA, 288 bp, Homo sapiens
  HUMUT726
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(288): n = A,T,G or C
gagctaagatggcgccactncactccagcctgggctacagagtgagactctgtctgagggaaaganaganagangaaagaaaaaganaganagagagagnnagaaagaaaaaaagaaaganagaganagnaagaaaaaagaaagaangagaaagaaagaaagaaaagaaagaaagaaagagaaagaaagaaagaaagaaagaaagaaagaaagaaagaaagaaagaaagaaagaaagaaagaaanaaatgcagaacctcaaggcccacccaaggcctaccgaataaga

SEQ ID NO: 27062 - DNA, 292 bp, Homo sapiens
  HUMUT7415
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gtatttttgtccctctttcatagtctactcttttcctaagtaataacacacagttttatacttttaagcattagctagacatatagatatagagaaatatgcatatatagctagacagatacatagatgatagatagatggatagatagatgatagatagatagatagatagatagatagatagatagatagatagacagatagataggtagatagctctaaattcctatcatcagcccgtattgccccactgaactgaactttatttcacctgcctatttggcagcttaac

SEQ ID NO: 27063 - DNA, 214 bp, Homo sapiens
  HUMUT743
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(214): n = A,T,G or C
actgcactccaacctgggcnacagagcaagactctgtctnnnaaatnaaatnatnaaatnaaattaaatnatnaaataaaaagaagaaagaaagaaagaaaaagaaagaaagaaagaaagaaagaaagaaagaaagaaagaaagaaagaaagaaagaaagaaagaaannaaaaanggaaagaaaggaaaagcaagcaagcaacggcgtaaagaa

SEQ ID NO: 27064 - DNA, 213 bp, Homo sapiens
  HUMUT7454
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(213): n = A,T,G or C
tattcaatccagtatgtgcaaaatatttcantctataatcaatataaaagtttgagatagtatgtagatatatagatagatgatagatagatagatagatagatagatagatagatagatagatagatatacacagacatacttttatgtactaacttttgaaatccatggcgtgttttatactaagaggaggggtcagcaacttgtgtgtcc

SEQ ID NO: 27065 - DNA, 149 bp, Homo sapiens
  HUMUT7726
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(149): n = A,T,G or C
ggataaattaagtgatggatggaatgataggtgtatggatggatnnaaaatgatagatagatagatagatggatagatagatagatagatagatagatagatagatagatagatgatagactgtttttcaagtacaacagctccactag

SEQ ID NO: 27066 - DNA, 246 bp, Homo sapiens
  HUMUT7942
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(246): n = A,T,G or C
gtcgcttgaacccaggaggtggaggttgcagtgagccgagatcacgccattgcactccagcccaggcaacaagagcgaaactccatctcaaaaaaaaaaccagaangaangaangaaggaangaaggaangaaggaangaaggaaggaaggaaggaaggaaggaaggaaggaaaccacatttaaggttggcaggctttgtntcccttagggaaaaaaacaagtgtacagggaaggctttggatgga

SEQ ID NO: 27067 - DNA, 184 bp, Homo sapiens
  HUMUT8052
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
atacctcttgctgagaagccaaaagaaataatatccctatgcaatatagatagatagatagatagatagatagatagatagatagatagacagatagatagatagatagacagatagattgcatagggatattattttatatttattttaaaaaatttttttttcttgagtctcactctgtcac

SEQ ID NO: 27068 - DNA, 205 bp, Homo sapiens
  HUMUT8057
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
atttgtcagagttttccagggagacagaaccaataggatatgtacatagatagatagatagatagatagatagatagatagatagatgtagatatagatgtagatatatgagaagagatttattaagggaattggatccataattatggagcccaagaagtcccttgattggccatctgtaagctagagaccctgggaaactagt

SEQ ID NO: 27069 - DNA, 176 bp, Homo sapiens
  HUMUT8067
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(176): n = A,T,G or C
ggcaacaagagcgaaactctgtctcaaaaaggaaagaaagaaagaaagaaagaaagaaagaaagaaagaaagaaagaaagaaagaaagaaagaaagaaagaaagaaagaaagnggctatcttatccctatgtctgtttttaagacaaacagacctttactagaagcccacaaagcc

SEQ ID NO: 27070 - DNA, 181 bp, Homo sapiens
  HUMUT8182
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cagcctggggcaacaagagcgaaactccgtctcaaaaaaagaaaaaagaaagaaagaaagaaagaaagaaagaaagaaaataaaacatgcagactttgaacaaggaggagaacggttatgttatgaaagttcctccatttccagaagtattctgggagataagctctcttttctgcacctg

SEQ ID NO: 27071 - DNA, 260 bp, Homo sapiens
  HUMUT8184
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(260): n = A,T,G or C
tgggcgacaaggcaagacttcgtcaagaaagaaagaaagaaagacagaaagaaagacagaaagacagaaagaaagacagaaaaagaaagaaagaaagaaaaagaaagaaagaaagaaagaaaganggaaagacagaaaganagaaagaaacagaaagaaagaaagaaaganagagagagagagagagagagagagagaaagaaagaaagaccagcctcaaggtgagcagaggatatccaagtactgcaggcacaggacca

SEQ ID NO: 27072 - DNA, 244 bp, Homo sapiens
  HUMUT831
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(244): n = A,T,G or C
gcaattgggtgtctaggaagtgtgtgtgtgtgtgtgtgtgtgtgtgtgtgtgttatgttaaanggaatcactacttattaaatatataagtaccacagtgaatattaaggccataatagggtatgggaaaggaganaaatgggctgcantcaagtgcatatttctaatcaactacttttttgtattcttctaatcattgtatttgatagtaatggacattcaaggctaaactctgcattgtggc

SEQ ID NO: 27073 - DNA, 187 bp, Homo sapiens
  Z66622
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
gcctcaggaggtctacatgctctaatcaaattgagatgccacacacaaatttccttccaccatacctctctctctctctccctctctctctctctccctctctctctctgtctctctctctctacacacacacacacacacacacacacacacacacacgcacccttaccattcactctgaggggac

SEQ ID NO: 27074 - DNA, 213 bp, Homo sapiens
  Z66629
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(213): n = A,T,G or C
aactctgccctgagaaattcacacacacacacacacacacacacacaaatacttcataaaacaaaatccacattatctttccttttgtgtattctaataattgaacaattagttctctgccagtaaattaaaataaaattacattcttctaaatatccattatccaagtaatttttaataatttcctgtttnctggcactttcagaattgttt

SEQ ID NO: 27075 - DNA, 121 bp, Homo sapiens
  Z66644
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(121): n = A,T,G or C
ggaaggcttcaaaactggttattaaacatataccacacacancacacacacacacacacacacacacanacacgtcctggngtacatataggtttcccaaagccttgacaggtggagtttc

SEQ ID NO: 27076 - DNA, 266 bp, Homo sapiens
  Z66648
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(266): n = A,T,G or C
gcagggcttcttaactcactagaagtccctgactgggccacnggtagttctttgggacaagaggtcctgcttcattttttctcaaactttgtttttcatcatcatcccatgccaaggaaacttttttgagactttttttcctaatcaccctccctcttcccccgtgaaatttttataccacgtacacacatacacacacacacacacacacacacaaacatatgttccttgacctacaatgggattacattcagataaaccaaccg

SEQ ID NO: 27077 - DNA, 213 bp, Homo sapiens
  Z66687
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(213): n = A,T,G or C
aagaagtgaacctaacctttcaaaatccaagagcataaaataaggatgtagtttaaaattagaaaacactgtgtatnacacacacacacacacacacacacacacacacacacacacaccttttaggagaagtaaaacgggttagtttcataaacagagtcaattgttttaaaagggtaaagaaaagagagaaaatacaggcatttttaaagt

SEQ ID NO: 27078 - DNA, 212 bp, Homo sapiens
  Z67141
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(212): n = A,T,G or C
tttgtcactttctgtggattganancaataaagcaatatttcanggtaaaanagcataggncaaggccccanttcatgtatctaaaanannttttcagantaantaantncacacacacacacacacacacacacacacacgaggcaggggaggtgaattaggaatgtagtgtggaagtcaaaagggntaagtttgagaagggtcaaatggc

SEQ ID NO: 27079 - DNA, 227 bp, Homo sapiens
  Z67196
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
cagaatgatatggtcctggcagcctgggagagtgaggtggggacgagtgaagggaagatgcagaagacaaaaacaggagaagtttatgcatgagaaaagacaaacacacacacacacacacacacacactcacacatatgccccactcccatcgctggctggggaagccctttgaaatggctggctggcactgggtgctctctcatttcttggatcacacatgcaca

SEQ ID NO: 27080 - DNA, 216 bp, Homo sapiens
  Z67204
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(216): n = A,T,G or C
aaggtcccacccttaggtcaaactttaaaaatgccatattcataacacaaaaaactccagcctattggaatgctggctacatcacaatatcacagtttccatttattcgaaattaccatttattagaaattaaccatcccccctatacacacacacacacacacacacaccctgaaagggntttccttgtcttaagcctctgtgtatgaaacactc

SEQ ID NO: 27081 - DNA, 206 bp, Homo sapiens
  Z67244
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(206): n = A,T,G or C
ccattggcaaactactaatctaatctagtatatatttagtaatcaaatatatatactatatatatttgtgtctatataccaacacagacacacacacacacacacacacacgaagacctgtataaactatccaattatctaagaatgntcaaagtttacttgaaaagagacaaatctaaataggagactgatttccccataaaagg

SEQ ID NO: 27082 - DNA, 145 bp, Homo sapiens
  Z67517
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(145): n = A,T,G or C
gtgcatgatctggggacttccttgcatataacacttcaataaaacaatttcccaaattgcaaagaacacatgtacacacacacacacacacacacacacacatctagaaactaggaaagtcagagnccctgaggttgcctttcaa

SEQ ID NO: 27083 - DNA, 218 bp, Homo sapiens
  Z67540
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(218): n = A,T,G or C
ctcccaacccacccgacacatacacacacacacacacacacacacacacacacacacacacacgaagagagaganagnanttagagcactgancntttctctcntagacnaantattttaacattattttcagccacnttattaantgtggggttaagggtagganagatctaatgcccatttcacatgtgttgcaacatcagagattatggttttca

SEQ ID NO: 27084 - DNA, 233 bp, Homo sapiens
  Z67604
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(233): n = A,T,G or C
agtccttggattagattggctttttgttttaatgggcaaatcatactattgactttgacactatagcctgctgaaattcccatttgtatgttttaaatttcagaaaggaaaatatttnctctctctctctctctctctcacacacacacacacacacacacacacacacacactttgagttatggccatacgtgtaagctatgtaagctcttcttaggttttgccaaatcacg

SEQ ID NO: 27085 - DNA, 272 bp, Homo sapiens
  Z67609
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(272): n = A,T,G or C
tctgagaagtttgaccagggatagaagtgaggcaaagcagataactggccaccacagaggtaaagctctctccaatgtcaagaatatcacatgcctatatatatatatatatntatatatatncncncncacacacacacacacacangtatatatatacacatatatacatacacacacatatacatatacatatatatatatatggggnatatcacatgcaacctgaactgaccactacagagagaaactaataatagagcatcaggcac

SEQ ID NO: 27086 - DNA, 259 bp, Homo sapiens
  Z67622
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(259): n = A,T,G or C
ttgacctattagttgcctggaagcctaccagtaagaataaatctgtctctctctctctctctcacagacacacacacacacacacacacacacatacacatacacacacacacacacacacatacacacacacacacanagaatcattccttctagattatctggattcttagtctttggttatatgttgccttcgtggtcttgttttttggaaatataatagataaatttggcctatttttctcgggtcaggtaaacc

SEQ ID NO: 27087 - DNA, 229 bp, Homo sapiens
  Z67659
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
tggctagtgtccagtgcagacacacacacacacacatacacacacacacacacacacacaccattccttagtacagtcaaagctcacaggagaaagaaaaatgttttctaataccttcttaatttgcaagaaggtgttaggaattcaagggatggtatgcatagtgatgttagtttcatttcttcagctccttcctccaactcatgttctgtagggacttctgggacta

SEQ ID NO: 27088 - DNA, 235 bp, Homo sapiens
  Z67706
  Located on chromosome -
  Distance between a terminus base of telomere on chromosomal short arm and 5'-terminus of this base sequence : -
  Distance between 3'-terminus of neighbour sequence of sequence listing upward to telomere on chrosomal short arm and 5'-terminus of this base sequence : -
  misc_feature (1)...(235): n = A,T,G or C
gctgggcaatcttgagcaagtctctgaattttactaaatttcaatttcctccctatcgtgaggattaaatgagatgcaaatttaaaatgcttatcttggtacttgcatgtatgttatgaaatacacacacacacacacacacacacacacacacacagatatacgtacacgtggtagctattttctggtagttactaccaggaaaagnaagtttgtgaaagtcaaacccacatga

SEQ ID NO: 27089 - DNA, 28 bp, Artificial sequence
  primer
aatagccatgagaagctatgtgggggag

SEQ ID NO: 27090 - DNA, 29 bp, Artificial sequence
  primer
ctacctccttgccaaacttgctgtttgtg

SEQ ID NO: 27091 - DNA, 21 bp, Artificial sequence
  primer
cgagaacaactggcaggactg

SEQ ID NO: 27092 - DNA, 23 bp, Artificial sequence
  primer
gacagtcctcattagcgctgagg

SEQ ID NO: 27093 - DNA, 24 bp, Artificial sequence
  primer
cagtagtaagccagaagctattac

SEQ ID NO: 27094 - DNA, 24 bp, Artificial sequence
  primer
aagtcaagcatatctgccatttgg

SEQ ID NO: 27095 - DNA, 20 bp, Artificial sequence
  primer
tagaaaacgcaatctcggcc

SEQ ID NO: 27096 - DNA, 20 bp, Artificial sequence
  primer
ctggattaacctggagactc

SEQ ID NO: 27097 - DNA, 20 bp, Artificial sequence
  primer
cagtgacaagcacctggcac

SEQ ID NO: 27098 - DNA, 19 bp, Artificial sequence
  primer
gccagatgtggtggcatgc

SEQ ID NO: 27099 - DNA, 20 bp, Artificial sequence
  primer
tgttcagacctcttcctgcc

SEQ ID NO: 27100 - DNA, 20 bp, Artificial sequence
  primer
gactagctcttgactacttg

SEQ ID NO: 27101 - DNA, 20 bp, Artificial sequence
  primer
tagggatggtcccaaacgtg

SEQ ID NO: 27102 - DNA, 20 bp, Artificial sequence
  primer
cccgtgcaggactgatctcc

SEQ ID NO: 27103 - DNA, 24 bp, Artificial sequence
  primer
ggcttgacttgaaactcagagacc

SEQ ID NO: 27104 - DNA, 24 bp, Artificial sequence
  primer
ttatctacttatagtctatcacgg

SEQ ID NO: 27105 - DNA, 25 bp, Artificial sequence
  primer
gagccacggagagtctccctttatc

SEQ ID NO: 27106 - DNA, 25 bp, Artificial sequence
  primer
tccaggaactgtgagtagtaagaac

SEQ ID NO: 27107 - DNA, 26 bp, Artificial sequence
  primer
tcttctgtgcaagcaatgcactgtac

SEQ ID NO: 27108 - DNA, 25 bp, Artificial sequence
  primer
atgttacttttagaagataacactc

SEQ ID NO: 27109 - DNA, 22 bp, Artificial sequence
  primer
agatggcatttggagagtgcag

SEQ ID NO: 27110 - DNA, 22 bp, Artificial sequence
  primer
tccttacagcagagatatgtgg
